(12) United States Patent
Fotin-Mleczek et al.

(10) Patent No.: US 11,078,247 B2
(45) Date of Patent: Aug. 3, 2021

(54) RNA ENCODING A THERAPEUTIC PROTEIN

(71) Applicant: CureVac AG, Tübingen (DE)

(72) Inventors: Mariola Fotin-Mleczek, Sindelfingen (DE); Ingmar Hoerr, Stuttgart (DE)

(73) Assignee: CureVac AG, Tübingen (DE)

( * ) Notice: Subject to any disclaimer, the term of this patent is extended or adjusted under 35 U.S.C. 154(b) by 58 days.

(21) Appl. No.: 16/098,844

(22) PCT Filed: May 4, 2017

(86) PCT No.: PCT/EP2017/060692
§ 371 (c)(1),
(2) Date: Nov. 2, 2018

(87) PCT Pub. No.: WO2017/191274
PCT Pub. Date: Nov. 9, 2017

(65) Prior Publication Data
US 2019/0241633 A1    Aug. 8, 2019

(30) Foreign Application Priority Data
May 4, 2016   (WO) ............... PCT/EP2016/060111

(51) Int. Cl.
| | | |
|---|---|---|
| A61K 48/00 | (2006.01) | |
| C07K 14/505 | (2006.01) | |
| A61K 31/7088 | (2006.01) | |
| A61K 38/00 | (2006.01) | |

(52) U.S. Cl.
CPC ........ *C07K 14/505* (2013.01); *A61K 31/7088* (2013.01); *A61K 48/005* (2013.01); *A61K 38/00* (2013.01); *A61K 48/00* (2013.01)

(58) Field of Classification Search
CPC .. A61K 31/7088; A61K 48/005; A61K 48/00; C12N 2320/30; C12N 15/111
See application file for complete search history.

(56) References Cited

U.S. PATENT DOCUMENTS

| | | | |
|---|---|---|---|
| 2005/0032730 | A1 | 2/2005 | von der Mülbe et al. |
| 2005/0059624 | A1 | 3/2005 | Hoerr et al. |
| 2005/0250723 | A1 | 11/2005 | Hoerr et al. |
| 2006/0188490 | A1 | 8/2006 | Hoerr et al. |
| 2008/0025944 | A1 | 1/2008 | Hoerr et al. |
| 2008/0267873 | A1 | 10/2008 | Hoerr et al. |
| 2009/0324584 | A1 | 12/2009 | Hoerr et al. |
| 2010/0048883 | A1 | 2/2010 | Ketterer et al. |
| 2010/0189729 | A1 | 7/2010 | Hoerr et al. |
| 2010/0203076 | A1 | 8/2010 | Fotin-Mleczek et al. |
| 2010/0291156 | A1 | 11/2010 | Barner et al. |
| 2010/0305196 | A1 | 12/2010 | Probst et al. |
| 2011/0053829 | A1 | 3/2011 | Baumhof et al. |
| 2011/0250225 | A1 | 10/2011 | Fotin-Mleczek et al. |
| 2012/0021043 | A1 | 1/2012 | Kramps et al. |
| 2012/0258046 | A1 | 10/2012 | Mutzke |
| 2013/0129754 | A1 | 5/2013 | Thess et al. |
| 2013/0142818 | A1 | 6/2013 | Baumhof et al. |
| 2013/0259879 | A1 | 10/2013 | Baumhof et al. |
| 2013/0280283 | A1 | 10/2013 | Lorenz et al. |
| 2013/0295043 | A1 | 11/2013 | Kallen et al. |
| 2013/0336998 | A1 | 12/2013 | Kallen et al. |
| 2014/0010861 | A1 | 1/2014 | Bancel et al. |
| 2015/0037326 | A1 | 2/2015 | Butler-Ransohoff et al. |
| 2015/0050302 | A1 | 2/2015 | Thess |
| 2015/0057340 | A1 | 2/2015 | Thess et al. |
| 2015/0093413 | A1 | 4/2015 | Thess et al. |
| 2015/0118183 | A1 | 4/2015 | Baumhof |
| 2015/0118264 | A1 | 4/2015 | Baumhof et al. |
| 2015/0165006 | A1 | 6/2015 | Thess et al. |
| 2015/0184195 | A1 | 7/2015 | Thess et al. |
| 2015/0218554 | A1 | 8/2015 | Thess |
| 2015/0306249 | A1 | 10/2015 | Baumhof et al. |
| 2015/0320847 | A1 | 11/2015 | Thess et al. |
| 2016/0130345 | A1 | 5/2016 | Fotin-Mleczek et al. |
| 2016/0166668 | A1 | 6/2016 | Kallen et al. |
| 2016/0166678 | A1 | 6/2016 | Kallen et al. |
| 2016/0166710 | A1 | 6/2016 | Baumhof |
| 2016/0166711 | A1 | 6/2016 | Schnee et al. |
| 2016/0168207 | A1 | 6/2016 | Kramps et al. |
| 2016/0168227 | A1 | 6/2016 | Kallen et al. |
| 2016/0235864 | A1 | 8/2016 | Schlake et al. |
| 2016/0304883 | A1 | 10/2016 | Grund et al. |
| 2016/0304938 | A1 | 10/2016 | Wochner |
| 2016/0326575 | A1 | 11/2016 | von der Mülbe |
| 2016/0331844 | A1 | 11/2016 | Fotin-Mleczek et al. |
| 2017/0014496 | A1 | 1/2017 | Fotin-Mleczek et al. |
| 2017/0029847 | A1 | 2/2017 | Thess |
| 2017/0114378 | A1 | 4/2017 | Wochner et al. |
| 2017/0252430 | A1 | 9/2017 | Fotin-Mleczek et al. |
| 2017/0326225 | A1 | 11/2017 | Rauch et al. |
| 2018/0044687 | A1 | 2/2018 | Thess et al. |

(Continued)

FOREIGN PATENT DOCUMENTS

| | | |
|---|---|---|
| WO | WO 2002/098443 | 12/2002 |
| WO | WO 2005/021707 | 3/2005 |
| WO | WO 2008/118258 | 10/2008 |
| WO | WO 2009/127230 | 10/2009 |
| WO | WO 2013/143700 | 10/2013 |
| WO | WO 2015/062738 | 5/2015 |

(Continued)

OTHER PUBLICATIONS

Haabeth et al. (Cancer Res. Apr. 1, 2019 ;79(7): 1624-1634).*

(Continued)

*Primary Examiner* — Amy H Bowman
(74) *Attorney, Agent, or Firm* — Parker Highlander PLLC

(57) ABSTRACT

The present invention relates to an RNA encoding a therapeutic protein. In particular, the present invention relates to RNA suitable for use as a medicament. The present invention concerns such novel RNA as well as compositions and kits comprising the RNA. Furthermore, the present invention relates to the RNA, compositions or kits as disclosed herein for use as a medicament. The present invention also provides the use of the RNA, compositions or kits as disclosed herein far increasing the expression of said encoded protein, in particular in gene therapy.

18 Claims, 4 Drawing Sheets

Specification includes a Sequence Listing.

(56) References Cited

U.S. PATENT DOCUMENTS

| | | |
|---|---|---|
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |

FOREIGN PATENT DOCUMENTS

| | | |
|---|---|---|
| WO | WO 2015/138348 | 9/2015 |
| WO | WO 2016/184576 | 11/2016 |
| WO | WO 2017/021546 | 2/2017 |
| WO | WO 2017/025447 | 2/2017 |
| WO | WO 2017/064146 | 4/2017 |
| WO | WO 2017/081110 | 5/2017 |
| WO | WO 2017/109134 | 6/2017 |
| WO | WO 2017/137095 | 8/2017 |
| WO | WO 2017/140345 | 8/2017 |
| WO | WO 2017/140905 | 8/2017 |
| WO | WO 2017/149139 | 9/2017 |
| WO | WO 2017/162297 | 9/2017 |
| WO | WO 2017/182634 | 10/2017 |
| WO | WO 2017/186928 | 11/2017 |
| WO | WO 2017/191258 | 11/2017 |
| WO | WO 2017/191264 | 11/2017 |
| WO | WO 2017/203008 | 11/2017 |
| WO | WO 2017/212006 | 12/2017 |
| WO | WO 2017/212007 | 12/2017 |
| WO | WO 2017/212009 | 12/2017 |
| WO | WO 2019/008001 | 1/2019 |

OTHER PUBLICATIONS

McKinlay et al. (Proc Natl Acad Sci U S A. Jan. 24, 2017;114(4):E448-E456).*

International Search Report and Written Opinion issued in corresponding PCT Application No. PCT/EP2017/060692, dated Jan. 11, 2018.

Qi et al., "Septin1, a new interaction partner for human serine/threonine kinase aurora-B", *Biochem. Biophys. Res. Comm.*, 336:994-1000, 2005.

Partial Search Report issued in corresponding European Application No. 17727793, dated Feb. 19, 2020.

Stiles et al., "CYP7B1: One Cytochrome P450, Two Human Genetic Diseases, and Multiple Physiological Functions", *J. Biol. Chem.*, 284(42):28485-28489, 2009.

\* cited by examiner a b

RNA ENCODING A THERAPEUTIC PROTEIN

This application is a national phase application under 35 U.S.C. § 371 of International Application No. PCT/EP2017/060692, filed May 4, 2017, which claims benefit of International Application No. PCT/EP2016/060111, filed May 4, 2016, the entire contents of each of which are hereby incorporated by reference.

The present invention relates to an RNA encoding a therapeutic protein. In particular, the present invention relates to RNA suitable for use as a medicament. The present invention concerns such novel RNA as well as compositions and kits comprising the RNA. Furthermore, the present invention relates to the RNA, compositions or kits as disclosed herein for use as a medicament. The present invention also provides the use of the RNA, compositions or kits as disclosed herein for increasing the expression of said encoded protein, in particular in gene therapy.

In gene therapy, nucleic acids are typically used as a pharmaceutical agent for treating a disease. It derives its name from the idea that nucleic acids can be used to supplement or alter the expression of a gene within an individual's cells as a therapy for treating or preventing a disease. The most common form of gene therapy involves the use of nucleic acids encoding a functional, therapeutic protein in order to replace a mutated gene. Other approaches involve direct correction of a mutation, or using nucleic acids that encode a therapeutic protein drug to provide treatment.

Gene therapy is a method of molecular medicine, which have already been proven in the therapy and prevention of certain diseases and generally exhibit a considerable effect on daily medical practice, in particular on the treatment or prevention of diseases as mentioned herein. Gene therapy is based on the introduction of a nucleic acid into a patient's cells or tissue and subsequent processing of the information encoded by the nucleic acid that has been introduced into the cells or tissue, that is to say the (protein) expression of the desired polypeptides.

Gene therapy may be beneficial for a large number of inherited or acquired diseases, inter alia infectious diseases, neoplasms (e.g. cancer or tumour diseases), diseases of the blood and blood-forming organs, endocrine, nutritional and metabolic diseases, diseases of the nervous system, diseases of the circulatory system, diseases of the respiratory system, diseases of the digestive system, diseases of the skin and subcutaneous tissue, diseases of the musculoskeletal system and connective tissue, and diseases of the genitourinary system.

In gene therapy approaches, typically DNA is used even though RNA is also known in recent developments. Importantly, in all these gene therapy approaches mRNA functions as messenger for the sequence information of the encoded protein, irrespectively of whether DNA, viral RNA or mRNA is used.

In general RNA is considered an unstable molecule: RNases are ubiquitous and notoriously difficult to inactivate. Furthermore, RNA is also chemically more labile than DNA. Also for that reason, many gene therapy approaches normally use DNA to transfer the coding information into the cell, which is then transcribed into mRNA, carrying naturally occurring elements of an mRNA, such as a 5'-CAP structure and a 3' poly(A) sequence to ensure expression of the encoded therapeutic protein.

However, in many cases expression systems based on the introduction of such nucleic acids into the patient's cells or tissue and the subsequent expression of the desired polypeptides encoded by these nucleic acids do not exhibit the desired, or even the required, level of expression which may allow for an efficient therapy, irrespectively of whether DNA or RNA is used.

In the prior art, different attempts have hitherto been made to increase the yield of the expression of an encoded protein, in particular by use of improved expression systems, both in vitro and/or in vivo. Methods for increasing expression described generally in the prior art are conventionally based on the use of expression vectors or cassettes containing specific promoters and corresponding regulation elements. As these expression vectors or cassettes are typically limited to particular cell systems, these expression systems have to be adapted for use in different cell systems. Such adapted expression vectors or cassettes are then usually transfected into the cells, which are typically treated depending on the specific cell line. Therefore, preference is given primarily to those nucleic acid molecules which are capable of expressing the encoded proteins in a target cell by systems inherent in the cell, independent of promoters and regulation elements which are specific for particular cell types. In this context, there can be distinguished between mRNA stabilizing elements and elements, which increase translation efficiency of mRNA.

mRNAs which are optimized in their coding sequence and which are generally suitable for such a purpose are described in application WO 02/098443 (CureVac GmbH). For example, WO 02/098443 describes mRNAs that are stabilised in general form and optimised for translation in their coding regions. WO 02/098443 further discloses a method for determining sequence modifications. WO 02/098443 additionally describes possibilities for substituting adenine and uracil nucleotides in mRNA sequences in order to increase the guanine/cytosine (G/C) content of the sequences. According to WO 02/098443, such substitutions and adaptations for increasing the G/C content can be used for gene therapeutic applications but also genetic vaccines in the treatment of cancer or infectious diseases. In this context, WO 02/098443 generally mentions sequences as a base sequence for such modifications, in which the modified mRNA codes for at least one biologically active peptide or polypeptide, which is translated in the patient to be treated, for example, either not at all or inadequately or with faults. Alternatively, WO 02/098443 proposes mRNAs coding for antigens e.g. tumour antigens or viral antigens as a base sequence for such modifications.

In a further approach to increase the expression of an encoded protein the application WO 2007/035355 describes the positive effect of long poly(A) sequences (particularly longer than 120 bp) and the combination of at least two 3' untranslated regions of the beta globin gene on mRNA stability and translational activity.

However, even though some of these prior art documents try to provide quite efficient tools for gene therapy approaches and additionally improved mRNA stability and translational activity, there still remains the problem of a generally lower stability of RNA-based applications versus DNA vaccines and DNA based gene therapeutic approaches. Accordingly, there still exists a need in the art to provide improved tools for gene therapy approaches or as a supplementary therapy for conventional treatments as discussed above, which allow for better provision of encoded proteins in vivo, e.g. via further improved mRNA stability and/or translational activity, preferably for gene therapy.

Furthermore despite of all progress in the art, efficient expression of an encoded peptide or protein in cell-free systems, cells or organisms (recombinant expression) is still a challenging problem.

It is thus an object of the present invention to provide a system suitable for use in gene therapy. In particular, it is an object to provide a system for expressing a therapeutic protein, preferably by stabilization of the mRNA and/or an increase of the translational efficiency of such an mRNA with respect to such nucleic acids known from the prior art. It is a further object of the invention to provide such a system, which allows treatment and/or prophylaxis of inherited or acquired diseases, particularly as defined herein, in a safe and effective manner.

The object underlying the present invention is solved by the claimed subject matter.

The present application is filed together with a sequence listing in electronic format. The sequence listing is provided as a file entitled CU01P222W02 SEQlist.txt, created on Apr. 28, 2017, which is 229,437 KB in size. The information contained in the electronic format of the sequence listing filed together with this application is incorporated herein by reference in its entirety. Where reference is made herein to a "SEQ ID NO:", the corresponding nucleic acid sequence or amino acid sequence in the sequence listing having the respective identifier is referred to.

For the sake of clarity and readability the following definitions are provided. Any technical feature mentioned for these definitions may be read on each and every embodiment of the invention. Additional definitions and explanations may be specifically provided in the context of these embodiments.

Adaptive immune response: The adaptive immune response is typically understood to be an antigen-specific response of the immune system. Antigen specificity allows for the generation of responses that are tailored, for example, to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells, which induces their proliferation and differentiation into armed effector T cells. The most important function of effector T cells is the killing of infected cells by CD8+ cytotoxic T cells and the activation of macrophages by Th1 cells, which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hypermutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant/adjuvant component: An adjuvant or an adjuvant component in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention, the term "antigen" typically refers to a substance, which is capable of being recognized by the immune system, preferably by the adaptive immune system, and which is capable of eliciting an antigen-specific immune response, e.g. by formation of antibodies and/or antigen-specific T cells as part of an adaptive immune response. Typically, an antigen may be or may comprise a peptide or protein, which may be presented by the MHC to T-cells. In this context, also fragments, variants and derivatives of an antigen, such as a peptide or a protein, comprising at least one epitope are understood as antigens.

Artificial nucleic acid molecule: An artificial nucleic acid molecule may typically be understood to be a nucleic acid molecule, e.g. a DNA or an RNA that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context, an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an RNA, preferably an mRNA, that typically may have two (bicistronic) or more (multicistronic) open reading frames (DRF). An open reading frame in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated with its cargo by covalent or non-covalent interaction. A carrier may transport nucleic acids, e.g. RNA or DNA, to the target cells. The carrier may for some embodiments be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein, which is positively charged under physiological conditions, particularly under physiological conditions in vivo. A "cationic peptide or protein" may contain at least one positively charged amino acid, or more than one positively charged amino acid, e.g. selected from Arg, His, Lys or kn. Accordingly, "polycationic" components are also within the scope exhibiting more than one positive charge under the conditions given.

5'-cap: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5' cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety.

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying tumor antigens. Further characteristics may be activation of macrophages and natural killer cells, enabling them to destroy pathogens and stimulation of cells to secrete a variety of cytokines that influence the function of other cells involved in adaptive immune responses and innate immune responses.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are by themselves composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and 8/C-base-pairing.

Epitope: In the context of the present invention, the term "epitope" typically refers to a fragment of an antigen or a variant of an antigen, wherein said fragment is presented by an MHC complex Such a fragment comprising or consisting of an epitope as used herein may typically comprise from about 5 to about 20 amino acids. An epitope may also be referred to herein as "antigen determinant". Epitopes can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or ID, (or even 11, or 12 amino acids), or fragments as processed and presented by MHC class II molecules, preferably having a length of about 13 or more amino acids, e.g. 13, 14, 15, 15, 17, IS, 19, 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having G to 9 amino acids, which may be recognized by antibodies, i.e. in their native form. Such epitopes of proteins or peptides may furthermore be selected from any of the herein mentioned variants of such proteins or peptides. In this context, antigenic determinants can be conformational or discontinuous epitopes, which are composed of segments of the proteins or peptides as defined herein that are discontinuous in the amino acid sequence of the proteins or peptides as defined herein but are brought together in the three-dimensional structure or continuous or linear epitopes, which are composed of a single polypeptide chain.

Fragment of a sequence: A fragment of a sequence may typically be a shorter portion of a full-length sequence of e.g.

a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule, from which the fragment is derived.

G/C modified: A G/C-modified nucleic acid may typically be a nucleic acid, preferably an artificial nucleic acid molecule as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule. As used herein, the term "G/C modification" comprises, in particular, the modifications of the number of guanosine and/or cytosine nucleotides in the RNA according to the invention, such as GC optimization of sequences, adaptation of sequences to human codon usage, codon optimization, or C-optimization of sequences.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an RNA as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient. The term "gene therapy" as used herein typically comprises treatment as well as prevention or prophylaxis of a disease.

Heterologous sequence: Two sequences are typically understood to be "heterologous" if they are not derivable from the same gene. I.e., although heterologous sequences may be derivable from the same organism, they naturally (in nature) do not occur in the same nucleic acid molecule, such as in the same mRNA.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention, an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component, which is able to induce an immune response, is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule. The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Immunostimulatory RNA: An immunostimulatory RNA (isRNA) in the context of the invention may typically be an RNA that is able to induce an innate immune response. It usually does not have an open reading frame and thus does not provide a peptide-antigen or immunogen but elicits an immune response e.g. by binding to a specific kind of Toll-like-receptor (TLR) or other suitable receptors. However, of course also mRNAs having an open reading frame and coding for a peptide/protein may induce an innate immune response and, thus, may be immunostimulatory RNAs.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLRB, TLR9, TLR10, a ligand of murine Toll-like receptor TLR1, TLR2, TLR3, TLR4, TLR5, TLR6, TLR7, TLRB, TLR9, TLR10, TLR11, TLR12 or TLR13, a ligand of a NOD-like receptor, a ligand of a RIG-1 like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (DRF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An DRF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "(protein) coding region" or, preferably, "coding sequence".

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and GOO monomeric units.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

Poly(A) sequence: A poly(A) sequence, also called poly (A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. As used herein, a poly(A) sequence may also comprise about ID to 200 adenosine nucleotides, preferably about 10 to 100 adenosine nucleotides, more preferably about 40 to 80 adenosine nucleotides or even more preferably about 50 to 70 adenosine nucleotides. A poly(A) sequence is typically located at the 3 end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to B nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribo-nucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity, the sequences to be compared are considered to exhibit the same length, i.e. the length of the longest sequence of the sequences to be compared. This means that a first sequence consisting of B nucleotides is BO % identical to a second sequence consisting of 10 nucleotides comprising the first sequence. In other words, in the context of the present invention, identity of sequences preferably relates to the percentage of nucleotides of a sequence which have the same position in two or more sequences having the same length. Gaps are usually regarded as non-identical positions, irrespective of their actual position in an alignment.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound.

3'-untranslated region (3'-UTR): Generally, the term "3'-UTR" refers to a part of the artificial nucleic acid molecule, which is located 3' (i.e. "downstream") of an open reading frame and which is not translated into protein. Typically, a 3'-UTR is the part of an mRNA which is located between the protein coding region (open reading frame (DRF) or coding sequence (CDS)) and the poly(A) sequence of the mRNA. In the context of the invention, the term 3'-UTR may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene, which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5' capping, splicing the pre-mature mRNA to excise optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA, which is located between the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites. The 5'-UTR may be post-transcriptionally modified, for example by addition of a 5'-CAP. In the context of the present invention, a 5'-UTR corresponds to the sequence of a mature mRNA, which is located between the 5'-CAP and the start codon. Preferably, the 5'-UTR corresponds to the sequence, which extends from a nucleotide located 3' to the 5'-CAP, preferably from the nucleotide located immediately 3' to the 5'-CAP, to a nucleotide located 5' to the start codon of the protein coding region, preferably to the nucleotide located immediately 5' to the start codon of the protein coding region. The nucleotide located immediately 3' to the 5'-CAP of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR. By the inventive embodiments such a 5'-UTR may be provided 5'-terminal to the coding sequence. Its length is typically less than 500, 400, 300, 250 or less than 200 nucleotides. In other embodiments its length may be in the range of at least 10, 20, 30 or 40, preferably up to 100 or 150, nucleotides.

5'Terminal Oligopyrimidine Tract (TOP): The 5'terminal oligopyrimidine tract (TOP) is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5' terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5' TOP as defined above. Thus, a TOP motif in the context of the present invention is preferably a stretch of pyrimidine nucleotides having a length of 3-30 nucleotides. Preferably, the TOP motif consists of at least 3 pyrimidine nucleotides, preferably at least 4 pyrimidine nucleotides, preferably at least 5 pyrimidine nucleotides, more preferably at least G nucleotides, more preferably at least 7 nucleotides, most preferably at least B pyrimidine nucleotides, wherein the stretch of pyrimidine nucleotides preferably starts at its 5'-end with a cytosine nucleotide. In TOP genes and TOP mRNAs, the TOP motif preferably starts at its 5'-end with the transcriptional start site and ends one nucleotide 5' to the first purin residue in said gene or mRNA. A TOP motif in the sense of the present invention is preferably located at the 5'-end of a sequence, which represents a 5'-UTR, or at the 5'-end of a sequence, which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-CAP to the nucleotide located 5' to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID NOs:1-1353 of the patent application WD 2013/

143700, whose disclosure is incorporated herewith by reference. In this context, a particularly preferred fragment of a 5'-UTR of a TOP gene is a 5'-UTR of a TOP gene lacking the 5'-TOP motif. The terms "5'-UTR of a TOP gene" or "5"-TOP UTR" preferably refer to the 5'-UTR of a naturally occurring TOP gene.

The present invention provides an RNA comprising at least one coding sequence encoding a peptide or protein comprising or consisting of a therapeutic protein, or a fragment or variant of a therapeutic protein.

A "therapeutic protein" as defined herein is typically a peptide or a protein, which is beneficial for the treatment or prophylaxis of any inherited or acquired disease or which improves the condition of an individual. Particularly, therapeutic proteins play a key role in the design of new therapeutic agents that could modify and repair genetic deficiencies, destroy cancer cells or pathogen infected cells, treat or prevent immune system disorders, or treat or prevent metabolic or endocrine disorders, among other functions. For instance, Erythropoietin (EPO), a protein hormone, can be utilized in treating patients with erythrocyte deficiency, which is a common cause of kidney complications. Furthermore, adjuvant proteins are encompassed by therapeutic proteins and also hormone replacement therapy which is e.g. used in the therapy of women in menopause. In more recent approaches, somatic cells of a patient are used for reprogramming them into pluripotent stem cells, which may substitute the disputed stem cell therapy. Also these proteins used for reprogramming of somatic cells or used for differentiating of stem cells are defined herein as therapeutic proteins. Furthermore therapeutic proteins may be used for other purposes e.g. wound healing, tissue regeneration, angiogenesis, etc.

Therefore, a therapeutic protein as used herein may be a peptide or protein suitable for use for various purposes including treatment or prevention of various diseases like e.g. infectious diseases, neoplasms (e.g. cancer or tumour diseases), diseases of the blood and blood-forming organs, endocrine, nutritional and metabolic diseases, diseases of the nervous system, diseases of the circulatory system, diseases of the respiratory system, diseases of the digestive system, diseases of the skin and subcutaneous tissue, diseases of the musculoskeletal system and connective tissue, and diseases of the genitourinary system, independently if they are inherited or acquired.

In the context of the present invention, the term "therapeutic protein" typically comprises peptides as well as proteins. Furthermore, the term "therapeutic protein" may also refer to a peptide or protein comprising a therapeutic protein as defined herein. For example, the term may refer to a polypeptide comprising a therapeutic protein as defined herein, wherein the polypeptide further comprises (preferably at the N-terminal or at the C-terminal side or on both sides of the therapeutic protein) a further amino acid sequence, which is not derived from a therapeutic protein. In particular, the term "therapeutic protein" as used herein comprises precursor proteins comprising a therapeutic protein or fusion proteins comprising a therapeutic protein and another amino acid sequence. Accordingly, the expression "therapeutic protein encoded by the at least one coding sequence" as used herein may refer to a therapeutic protein as defined herein or to a peptide or protein comprising a therapeutic protein as defined herein. In other words, a "coding sequence encoding a therapeutic protein" as used herein may refer to a coding sequence encoding a therapeutic protein or a fragment or variant thereof, or to a coding sequence encoding a protein or peptide comprising a therapeutic protein or a fragment or variant thereof.

The inventors surprisingly found that the RNA according to the invention is capable of providing sufficient expression of the therapeutic protein encoded in the at least one coding region upon administration of the RNA to cells or to a patient. In particular, expression levels of the therapeutic protein can surprisingly be obtained by using the RNA of the invention which are increased in comparison with the expression levels obtained by using a reference construct known in the art encoding the respective therapeutic protein.

The RNA according to the present invention preferably comprises at least one coding sequence encoding a peptide or protein comprising or consisting of a therapeutic protein, or a fragment or variant thereof, wherein the therapeutic protein is selected from
   (i) therapeutic proteins for use in the treatment of metabolic or endocrine disorders,
   (ii) therapeutic proteins for use in the treatment of blood disorders, diseases of the circulatory system, diseases of the respiratory system, cancer or tumour diseases, infectious diseases or immunedeficiencies,
   (iii) therapeutic proteins used for hormone replacement therapy,
   (iv) therapeutic proteins used for reprogramming of somatic cells into pluri- or omnipotent stem cells, and
   (v) therapeutic proteins selected from adjuvant or immunostimulating proteins.

Adjuvant or immunostimulating proteins are also encompassed in the term therapeutic proteins. Adjuvant or immunostimulating proteins may be used in this context to induce, alter or improve an immune response in an individual to treat a particular disease or to ameliorate the condition of the individual. In this context adjuvant proteins may be selected from mammalian, in particular human adjuvant proteins, which typically comprise any human protein or peptide, which is capable of eliciting an innate immune response (in a mammal), e.g. as a reaction of the binding of an exogenous TLR ligand to a TLR.

Therapeutic proteins for the treatment of blood disorders, diseases of the circulatory system, diseases of the respiratory system, cancer or tumour diseases, infectious diseases or immunedeficiencies or adjuvant proteins are typically proteins of mammalian origin, preferably of human origin, depending on which animal shall be treated. A human is e.g. preferably treated by a therapeutic protein of human origin.

In a further embodiment therapeutic proteins may be used for hormone replacement therapy, particularly for the therapy of women in the menopause. These therapeutic proteins are preferably selected from oestrogens, progesterone or progestins, and sometimes testosterone.

Furthermore, therapeutic proteins may be used for reprogramming of somatic cells into pluri- or omnipotent stem cells.

As used herein, the term "therapeutic protein" preferably refers to any one of the peptides or proteins described herein, more preferably to any one of the peptides or proteins specified in Table 1 herein. The at least one coding sequence of the RNA according to the invention thus preferably encodes a peptide or protein comprising or consisting of a therapeutic protein selected from the peptides or proteins provided in Table 1, or a fragment or variant thereof, whereby the characteristic features of each peptide or protein of the invention is represented by the formula "c1 (Peptide or protein or gene) c2(NCBI Ref Seq ID) c3(Protein SEQ ID NO) c4(RNA SEQ ID NOs) c5(Related disease, disorder or condition)". As Table 1 is depicted as a running text, each entry (i.e. peptide or protein of the invention) is separated by a semicolon and, for ease of readability; each entry is preluded by the number sign (#).

Accordingly, each characteristic feature of the corresponding individual peptide or protein of the invention is depicted after c1, c2, c3, c4, and c5 in brackets, wherein the abbreviations as disclosed under feature c5 are to be read from the Abbreviation Dictionary for the "Related disease, disorder or condition" as shown in Table C, whereby each abbreviation is depicted with a specific "Related disease, disorder or condition" in written form, f.e. prostate cancer corresponds to "A".

According to this, exemplarily the first protein as disclosed in Table 1 i.e. "c1(37135 (Sep-01)) c2(NP_443070) c3(1) c4(26115, 39172, 52229, 13058, 65286) c5(d, c, e, b)" resembles the peptide or protein shown in Table A.

TABLE A

Exemplary depiction from the first entry as disclosed io Table 1 (c1, c2, c3, c4, and c5 correspond to the corresponding entry coder column 1, column 2, column 3, column 4 and column 5) in accordance with formula "c1(Peptide or protein or gene) c2(NCBI RefSeq ID) c3(Protein SEQ ID ND) c4(RNA SEQ ID NDs) c5(Related disease, disorder or condition)" and the Abbreviation Dictionary as disclosed in Table C - emphasis added for corresponding entry data (italics, underlined).

| column 1 (i.e. feature c1) Peptide or protein | column 2 (i.e. feature c2) NCBI RefSeq ID | column 3 (i.e. feature c3) Protein SEQ ID ND | column 4 (i.e. feature c4) RNA SEQ ID ND | column 5 (i.e. feature c5) Related disease, disorder or condition |
| --- | --- | --- | --- | --- |
| *37135(Sep-01)* | *NP_443070* | *1* | *26115, 39172, 52229, 13058, 65286* | *cancer; duchenne muscular dystrophy; squamous cell carcinoma; tongue squamous cell carcinoma* |

In this context, particularly preferred therapeutic proteins which can be used inter alia in the treatment of metabolic or endocrine disorders are selected from: 37135 (Sep-01); 37500 (Sep-02); 37865 (Sep-03); 38231 (Sep-04); 38596 (Sep-05); 38961 (Sep-06); 39326 (Sep-07); 40057 (Sep-09); 40422 (Sep-10); 40787 (Sep-11); 41153 (Sep-12); 4E3 (Sep-14); A1BG; A1CF; A2M; A2ML1; A4GNT; AAAS; AACS; AADAC; AAGAB; AAK1; AANAT; AARD; AARS2; AARS; AASDH; AASDHPPT; AASS; AATF; AATK; ABAT; ABCA12; ABCA13; ABCA1; ABCA2; ABCA3; ABCAS; ABCA6; ABCA7; ABCA9; ABCB11; ABCB1; ABCB4; ABCBS; ABCB6; ABCB7; ABCB8; ABCB9; ABCC10; ABCC11; ABCC12; ABCC1; ABCC2; ABCC3; ABCC4; ABCCS; ABCC6; ABCC8; ABCC9; ABCD1; ABCD2; ABCD3; ABCD4; ABCE1; ABCF1; ABCF2; ABCG1; ABCG2; ABCG4; ABCGS; ABCG8; ABHD12B; ABHD12; ABHD16A; ABHD17B; ABHD2; ABHDS; ABHD6; ABI1; ABI2; ABI3BP; ABI3; ABL1; ABL2; ABLIM1; ABLIM2; ABO; ABRA; ABR; ABT1; ACAA1; ACAA2; ACACA; ACACB; ACAD10; ACAD8; ACAD9; ACADL; ACADSB; ACADS; ACADVL; ACAN; ACAT1; ACAT2; ACBD3; ACBD4; ACBD5; ACBD6; ACCS; ACD; ACE2; ACE; ACER2; ACER3; ACHE; ACINI; ACKR1; ACKR2; ACKR3; ACKR4; ACLY; ACMSD; ACO1; ACO2; ACOT13; ACOT1; ACOT2; ACOT9; ACOX1; ACOX2; ACOX3; ACOXL; ACP1; ACP2; ACP5; ACP6; ACPP; ACRBP; ACRC; ACR; ACRV1; ACSBG1; ACSBG2; ACSF3; ACSL1; ACSL3; ACSL5; ACSL6; ACSM1; ACSM2B; ACSM3; ACSS1; ACSS2; ACSS3; ACTA1; ACTA2; ACTB; ACTBL2; ACTC1; ACTG1; ACTG2; ACTL6A; ACTL6B; ACTL8; ACTL9; ACTN1; ACTN2; ACTN3; ACTN4; ACTR1A; ACTR1B; ACTR2; ACTR3B; ACTR3; ACTR5; ACTRT1; ACVR1B; ACVR1C; ACVR1; ACVR2A; ACVR2B; ACVRL1; ACYL; ACY3; ACYP2; ADAD1; ADA; ADAM10; ADAM11; ADAM12; ADAM15; ADAM17; ADAM19; ADAM20; ADAM21; ADAM22; ADAM23; ADAM28; ADAM29; ADAM2; ADAM33; ADAM7; ADAMS; ADAMS; ADAMDEC1; ADAMTS10; ADAMTS12; ADAMTS13; ADAMTS14; ADAMTS15; ADAMTS16; ADAMTS17; ADAMTS18; ADAMTS19; ADAMTS1; ADAMTS20; ADAMTS2; ADAMTS3; ADAMTS4; ADAMTS5; ADAMTS6; ADAMTS7; ADAMTS8; ADAMTS9; ADAMTSL1; ADAMTSL2; ADAMTSL3; ADAMTSL4; ADAMTSLS; ADAP1; ADAP2; ADARB1; ADARB2; ADAR; ADAT2; ADAT3; ADCK3; ADCK4; ADCY10; ADCY1; ADCY2; ADCY3; ADCYS; ADCY6; ADCY7; ADCY8; ADCY9; ADCYAP1; ADCYAP1R1; ADD1; ADD2; ADD3; ADGB; ADGRA1; ADGRA2; ADGRA3; ADGRB1; ADGRB2; ADGRB3; ADGRD1; ADGRD2; ADGRE1; ADGRE2; ADGRE5; ADGRF5; ADGRG1; ADGRG2; ADGRG3; ADGRG6; ADGRG7; ADGRL1; ADGRL3; ADGRV1; ADH1A; ADH1B; ADH4; ADHS; ADH6; ADH7; ADHFE1; AM; ADIG; ADIPOQ; ADIPOR1; ADIPOR2; ADIRF; ADK; ADM2; ADM; ADNP; ADO; ADORAL; ADORA2A; ADORA2B; ADPGK; ADPRH; ADPRHL1; ADPRHL2; ADRA1A; ADRA1B; ADRA1D; ADRA2A; ADRA2B; ADRA2C; ADRB1; ADRB2; ADRB3; ADRBK1; ADRBK2; ADRM1; ADSL; ADSS; ADSSL1; ADTRP; AEBP2; AEN; AES; AFAP1; AFAP1L1; AFAP1L2; AFF1; AFF2; AFF3; AFF4; AFG3L2; AFM; AFP; AGA; AGAP1; AGAP2; AGAP3; AGAP4; AGBL1; AGBL2; AGBL3; AGBL4; AGER; AGFG1; AGFG2; AGGF1; AGK; AGMO; AGO2; AGPAT1; AGPAT2; AGPAT3; AGPAT4; AGPAT9; AGPS; AGR2; AGR3; AGRN; AGRP; AGT; AGTPBP1; AGTR1; AGTR2; AGXT2; AGXT; AHCY; AHCYL2; AHI1; AHNAK; AHR; AHRR; AHSA1; AHSA2; AHSG; AICDA; AIDA; AIF1; AIFM1; AIFM2; AIFM3; AIG1; AIM1; AIM2; AIMP1; AIMP2; AIP; AIPL1; AIRE; AJAP1; AJUBA; AK1; AK3; AK6; AK7; AK8; AK9; AKAP10; AKAP12; AKAP13; AKAP17A; AKAP1; AKAP2; AKAP3; AKAP4; AKAPS; AKAP6; AKAP7; AKAP9; AKIP1; AKIRIN2; AKNA; AKR1B10; AKR1B1; AKR1C1; AKR1C2; AKR1C3; AKR1C4; AKR1D1; AKR1E2; AKR7A3; AKT1; AKT1S1; AKT2; AKT3; AKTIP; ALAD; ALAS1; ALAS2; ALB; ALCAM; ALDH16A1; ALDH18A1; ALDH1A1; ALDH1A2; ALDH1A3; ALDH1B1; ALDH1L1; ALDH2;

ALDH3A1; ALDH3A2; ALDH3B1; ALDH4A1; ALDH5A1; ALDH6A1; ALDH7A1; ALDH9A1; ALDOA; ALDOB; ALDOC; ALG10B; ALG10; ALG11; ALG12; ALG13; ALG1; ALG1L; ALG2; ALG3; ALG8; ALG9; ALKBH1; ALKBH2; ALKBH3; ALKBH7; ALKBH8; ALK; ALLC; ALMS1; ALOX12B; ALOX12; ALOX15B; ALOX15; ALOX5AP; ALOX5; ALOXE3; ALPI; ALPK1; ALPK2; ALPK3; ALPP; ALPPL2; ALS2CL; ALS2CR12; ALS2; ALX1; ALX4; ALYREF; AMACR; AMBN; AMBP; AMBRA1; AMD1; AMELX; AMELY; AMER1; AMER2; AMER3; AMFR; AMH; AMHR2; AMICA1; AMIGO2; AMMECR1; AMN; AMOT; AMOTL1; AMPD2; AMPD3; AMPH; AMT; AMZ1; ANAPC10; ANAPC11; ANAPC13; ANAPC1; ANAPC2; ANAPC4; ANAPC5; ANAPC7; ANG; ANGPT1; ANGPT2; ANGPT4; ANGPTL1; ANGPTL2; ANGPTL4; ANGPTL6; ANK1; ANK2; ANK3; ANKFN1; ANKFY1; ANKHD1-EIF4EBP3; ANKHD1; ANKH; ANKK1; ANKLET; ANKLE2; ANKMY1; ANKRD10; ANKRD11; ANKRD12; ANKRD18A; ANKRD1; ANKRD23; ANKRD26; ANKRD28; ANKRD2; ANKRD30A; ANKRD36B; ANKRD36; ANKRD37; ANKRD44; ANKRD45; ANKRD46; ANKRD50; ANKRD55; ANKRD6; ANKRD7; ANKS1A; ANKS1B; ANKS4B; ANKS6; ANLN; AN010; ANO1; ANO2; ANO3; ANO4; ANDS; ANO6; ANO7; ANP32A; ANP32B; ANP32D; ANPEP; ANTXR1; ANTXR2; ANXA10; ANXA11; ANXA13; ANXA1; ANXA2; ANXA2R; ANXA3; ANXA4; ANXA5; ANXA6; ANXA7; ANXA8; ANXA8L1; AOAH; AOC1; AOC2; AOC3; AOX1; AP1AR; AP1B1; AP1G1; AP1M1; AP1M2; AP1S1; AP1S2; AP1S3; AP2A1; AP2B1; AP2M1; AP2S1; AP3B1; AP3D1; AP3M2; AP3S1; AP3S2; AP4B1; AP4E1; AP4M1; AP4S1; AP5M1; AP5Z1; APAF1; APBA1; APBA2; APBA3; APBB1; APBB1IP; APBB2; APBB3; APC2; APCDD1; APCDD1L; APC; APCS; APEH; APEX1; APEX2; APH1B; APIS; APIP; APLN; APLNR; APLP1; APLP2; APOA1BP; APOA2; APOA4; APOA5; APOBEC1; APOBEC2; APOBEC3A_B; APOBEC3B; APOBEC3C; APOBEC3F; APOBEC3G; APOBEC3H; APOB; APOBR; APOC1; APOC2; APOC3; APOC4; APOD; APOE; APOF; APOH; APOL1; APOL2; APOL3; APOL4; APOL6; APOLD1; APOM; APOO; APOPT1; APPBP2; APP; APPL1; APPL2; APRT; APTX; AQP10; AQP1; AQP2; AQP3; AQP4; AQP5; AQP6; AQP7; AQP8; AQP9; ARAF; ARAP1; ARAP3; ARC; ARCN1; AREG; ARF1; ARF3; ARF4; ARF6; ARFGAP1; ARFGAP2; ARFGAP3; ARFGEF1; ARFGEF2; ARFGEF3; ARFIP1; ARFRP1; ARG1; ARGLU1; ARHGAP10; ARHGAP11A; ARHGAP11B; ARHGAP15; ARHGAP18; ARHGAP1; ARHGAP20; ARHGAP21; ARHGAP22; ARHGAP23; ARHGAP24; ARHGAP25; ARHGAP26; ARHGAP27; ARHGAP28; ARHGAP30; ARHGAP31; ARHGAP32; ARHGAP35; ARHGAP42; ARHGAP4; ARHGAP5; ARHGAP6; ARHGAP9; ARHGD1A; ARHGD1B; ARHGEF10; ARHGEF10L; ARHGEF11; ARHGEF12; ARHGEF15; ARHGEF16; ARHGEF17; ARHGEF1; ARHGEF25; ARHGEF26; ARHGEF28; ARHGEF2; ARHGEF38; ARHGEF3; ARHGEF4; ARHGEF5; ARHGEF6; ARHGEF7; ARHGEF9; AR; ARID1B; ARID2; ARID3A; ARID3B; ARID4A; ARID4B; ARID5B; ARIH1; ARL11; ARL13A; ARL13B; ARL14EP; ARL14; ARL15; ARL1; ARL2BP; ARL2; ARL3; ARL4A; ARL4C; ARL4D; ARL5A; ARL5B; ARL6; ARL6IP1; ARL6IP5; ARMC10; ARMC1; ARMC2; ARMC3; ARMC4; ARMC5; ARMC8; ARMC9; ARMCX1; ARMS2; ARMT1; ARNT2; ARNT; ARNTL2; ARNTL; ARPC1A; ARPC1B; ARPC2; ARPC3; ARPC5; ARPIN; ARPP21; ARR3; ARRB1; ARRB2; ARRDC2; ARRDC3; ARRDC4; ARSA; ARSB; ARSD; ARSE; ARSF; ARSG; ARSH; ARSI; ARSJ; ARSK; ART1; ART3; ART4; ARVCF; ARX; AS3MT; ASAH1; ASAH2; ASAP1; ASAP2; ASB10; ASB13; ASB15; ASB18; ASB1; ASB2; ASB6; ASB7; ASCC1; ASCC2; ASCC3; ASCL1; ASCL2; ASCL4; ASF1A; ASF1B; ASH1L; ASH2L; ASIC1; ASIC2; ASIC3; ASIC4; ASIC5; ASIP; ASL; ASMT; ASMTL; ASNA1; ASNS; ASPA; ASPG; ASPH; ASPM; ASPN; ASPRV1; ASPSCR1; ASRGL1; ASS1; ASTN2; ASUN; ASXL1; ASXL2; ASXL3; ASZ1; ATAD2; ATAD3B; ATAD3C; ATAD5; ATAT1; ATCAY; ATE1; ATFL; ATF2; ATF3; ATF4; ATF5; ATF6B; ATF6; ATF7; ATF7IP; ATG10; ATG12; ATG16L1; ATG2B; ATG3; ATG4A; ATG4B; ATG4C; ATG5; ATG7; ATG9A; ATIC; ATL1; ATL2; ATL3; ATM; ATN1; ATOH1; ATOH7; ATOX1; ATP10A; ATP10B; ATP10D; ATP11A; ATP11AUN; ATP11B; ATP12A; ATP13A3; ATP13A4; ATP1A2; ATP1A3; ATP1A4; ATP1B1; ATP1B2; ATP2A1; ATP2A2; ATP2A3; ATP2B1; ATP2B2; ATP2B3; ATP2B4; ATP2C1; ATP2C2; ATP4A; ATP4B; ATP5A1; ATP5B; ATP5C1; ATP5D; ATP5E; ATP5G1; ATP5G2; ATP5G3; ATP5H; ATP5J2; ATP5J; ATP5L; ATP5O; ATP6AP1; ATP6AP1L; ATP6AP2; ATP6V0A1; ATP6V0A2; ATP6V0A4; ATP6V0C; ATP6V0D1; ATP6V0E1; ATP6V0E2; ATP6V1B1; ATP6V1B2; ATP6V1C1; ATP6V1D; ATP6V1E1; ATP6V1F; ATP6V1G1; ATP6V1G2; ATP6V1G3; ATP7A; ATP7B; ATP8A1; ATP8A2; ATP8B1; ATP8B3; ATP8B4; ATP9B; ATPAF2; ATRAID; ATR; ATRIP; ATRN; ATRNL1; ATRX; ATXN10; ATXN1; ATXN1L; ATXN2; ATXN2L; ATXN3; ATXN7; ATXN7L3B; AUH; AURKA; AURKB; AURKC; AUTS2; AVEN; AVP; AVPI1; AVPR1A; AVPR1B; AVPR2; AWAT1; AXDND1; AXIN1; AXIN2; AXL; AZGP1; AZI2; AZIN1; AZIN2; AZUL; B2M; B3GALNT1; B3GALNT2; B3GALT2; B3GALT4; B3GALT5; B3GALTL; B3GAT1; B3GAT2; B3GAT3; B3GNT2; B3GNT3; B3GNT5; B3GNT6; B3GNT8; B3GNTL1; B4GALNT1; B4GALNT2; B4GALNT3; B4GALT1; B4GALT3; B4GALT4; B4GALT5; B4GALT6; B4GALT7; B4GAT1; B9D1; B9D2; BAALC; BAAT; BABAM1; BACE1; BACE2; BACH1; BACH2; BAD; BAG1; BAG3; BAG4; BAG5; BAG6; BAIAP2L1; BAIAP3; BAK1; BAMBI; BANF1; BANK1; BANP; BAP1; BARD1; BARHL1; BARX1; BARX2; BASP1; BATF2; BATF; BAX; BAZ1A; BAZ1B; BAZ2A; BAZ2B; BBC3; BBIP1; BBOX1; BBS10; BBS12; BBS1; BBS2; BBS4; BBS5; BBS7; BBS9; BBX; BCAM; BCAN; BCAP29; BCAP31; BCAR1; BCAS1; BCAS3; BCAS4; BCAT1; BCAT2; BCCIP; BCDIN3D; BCHE; BCKDHA; BCKDHB; BCKDK; BCL10; BCL11A; BCL11B; BCL2A1; BCL2; BCL2L10; BCL2L11; BCL2L12; BCL2L13; BCL2L14; BCL2L1; BCL2L2; BCL2L2-PABPN1; BCL3; BCL6B; BCL6; BCL7A; BCL7B; BCL7C; BCL9L; BCLAF1; BCO1; BCO2; BCOR; BCORL1; BCR; BCS1L; BDH1; BDH2; BDKRB1; BDKRB2; BDNF; BDP1; BEAN1; BEGAIN; BEND3; BEND4; BEST1; BEST2; BET1; BET1L; BEX1; BEX2; BEX4; BFAR; BFSP1; BFSP2; BGLAP; BGN; BHLHA15; BHLHA9; BHLHB9; BHLHE22; BHLHE23; BHLHE40; BHLHE41; BHMT2; BHMT; BICC1; BICD1; BICD2; BID; BIN1; BIN2; BIN3; BIRC2; BIRC3; BIRC5; BIRC6; BIRC7; BIVM; BLCAP; BLID; BLK; BLMH; BLM; BLNK; BLOC1S2; BLOC1S3; BLOC1S4; BLOC1S5; BLOC1S6; BLVRA; BLVRB; BLZF1; BMF; BMI1; BMP10; BMP15; BMP1; BMP2; BMP2K; BMP3; BMP4; BMP5; BMP6; BMP7; BMP8B; BMPER; BMPR1A; BMPR1B; BMPR2; BMS1; BMX; BNC1; BNC2; BNIP1; BNIP2; BNIP3; BNIP3L; BNIPL; BOC; BOD1L2; BOK;

BOLA3; BOLL; BOP1; BORA; BPGM; BPIFA1; BPIFA2; BPIFA3; BPIFB1; BPIFB2; BPIFC; BPI; BPNT1; BPTF; BPY2; BRAF; BRAP; BRAT1; BRCA1; BRCA2; BRCC3; BRD1; BRD2; BRD3; BRD4; BRD7; BRD8; BRE; BRF1; BRF2; BRI3BP; BRI3; BRINP1; BRINP2; BRINP3; BRIP1; BRK1; BRMS1; BRMS1L; BRS3; BRSK1; BRSK2; BRWD1; BRWD3; BSCL2; BSG; BSN; BSPH1; BSPRY; BST1; BST2; BSX; BTBD10; BTBD11; BTBD16; BTBD1; BTBD2; BTBD3; BTBD9; BTC; BTD; BTF3; BTG1; BTG2; BTG3; BTG4; BTK; BTLA; BTN1A1; BTN2A1; BTN2A2; BTN3A1; BTN3A2; BTN3A3; BTNL2; BTRC; BUB1B; BUB1; BUB3; BUD13; BUD31; BVES; BYSL; BZRAP1; BZW1; C10orf107; C10orf10; C10orf113; C10orf11; C10orf2; C10orf32; C10orf35; C10orf54; C10orf67; C10orf82; C10orf88; C10orf90; C11orf21; C11orf30; C11orf53; C11orf65; C11orf68; C11orf73; C11orf74; C11orf80; C11orf87; C11orf95; C12orf10; C12orf42; C12orf43; C12orf50; C12orf57; C12orf5; C12orf65; C12orf66; C12orf75; C12orf77; C14orf166; C14orf177; C14orf1; C15orf32; C15orf41; C15orf48; C15orf53; C15orf59; C16orf72; C16orf74; C16orf78; C16orf95; C17orf51; C17orf53; C17orf64; C17orf96; C18orf54; C18orf8; C19orf12; C19orf18; C19orf24; C19orf26; C19orf33; C19orf40; C19orf45; C19orf48; C19orf57; C19orf68; C1D; C1GALT1C1; C1GALT1; C1orf106; C1orf109; C1orf110; C1orf112; C1orf115; C1orf127; C1orf141; C1orf167; C1orf204; C1orf226; C1orf228; C1orf27; C1orf61; C1orf86; C1QB; C1QBP; C1QL1; C1QL3; C1QTNF1; C1QTNF3; C1QTNF5; C1QTNF6; C1QTNF7; C1QTNF9B-AS1; C1R; C1RL; C1S; C20orf194; C20orf196; C20orf27; C20orf85; C21orf2; C21orf33; C21orf59; C21orf62; C21orf91; C22orf29; C2CD3; C2CD4A; C2CD4B; C2CD5; C2; C2orf16; C2orf40; C2orf43; C2orf47; C2orf57; C2orf61; C3AR1; C3; C3orf17; C3orf18; C3orf20; C3orf35; C3orf56; C3orf58; C3orf67; C3orf79; C4A; C4B_2; C4B; C4BPA; C4BPB; C4orf22; C4orf26; C4orf27; C4orf32; C4orf33; C4orf36; C4orf48; C4orf51; C5AR1; C5AR2; C5; C5orf22; C5orf30; C5orf34; C5orf38; C5orf42; C5orf63; C6; C6orf106; C6orf10; C6orf15; C6orf25; C6orf47; C6orf48; C6orf89; C7; C7orf49; C7orf57; C7orf60; C7orf62; C7orf65; C7orf69; C7orf72; C8orf34; C8orf37; C8orf46; C8orf48; C8orf4; C8orf86; C9; C9orf106; C9orf135; C9orf152; C9orf156; C9orf170; C9orf171; C9orf3; C9orf43; C9orf66; C9orf72; C9orf85; C9orf91; C9orf9; CA10; CA11; CA12; CA13; CA1; CA2; CA3; CA4; CA5A; CA6; CA8; CAB39; CAB39L; CABIN1; CABLES1; CABP2; CABP4; CABS1; CABYR; CACNA1A; CACNA1B; CACNA1C; CACNA1D; CACNA1E; CACNA1F; CACNA1G; CACNA1H; CACNA1I; CACNA1S; CACNA2D1; CACNA2D2; CACNA2D3; CACNA2D4; CACNB1; CACNB2; CACNB3; CACNB4; CACNG2; CACNG3; CACNG4; CACNG5; CACNG6; CACUL1; CACYBP; CAD; CADM1; CADM2; CADM3; CADM4; CADPS2; CADPS; CAGE1; CALB1; CALB2; CALCA; CALCB; CALCOCO1; CALCOCO2; CALCR; CALCRL; CALD1; CALHM1; CALHM2; CALHM3; CALM2; CALML3; CALML5; CALN1; CALR3; CALR; CALU; CALY; CAMK1D; CAMK1G; CAMK1; CAMK2A; CAMK2B; CAMK2D; CAMK2G; CAMK4; CAMKK1; CAMKK2; CAMKMT; CAMLG; CAMP; CAMSAP1; CAMSAP2; CAMTA1; CAND1; CAND2; CANT1; CANX; CAP1; CAP2; CAPG; CAPN10; CAPN13; CAPN14; CAPN1; CAPN2; CAPN3; CAPN5; CAPN6; CAPN7; CAPN9; CAPNS1; CAPRIN1; CAPRIN2; CAPS2; CAPS; CAPSL; CAPZA2; CAPZA3; CARD10; CARD11; CARD14; CARD16; CARD6; CARD8; CARDS; CARF; CARKD; CARM1; CARS; CARTPT; CASC1; CASC3; CASC4; CASC5; CASD1; CASK; CASP10; CASP14; CASP1; CASP2; CASP3; CASP4; CASP5; CASP6; CASP7; CASP8AP2; CASP8; CASP9; CASQ1; CASR; CASS4; CAST; CASZ1; CAT; CATSPER1; CATSPER2; CAV1; CAV2; CAV3; CBFA2T2; CBFA2T3; CBFB; CBLB; CBL; CBLL1; CBLN1; CBLN2; CBLN4; CBR1; CBR3; CBR4; CBS; CBX1; CBX2; CBX3; CBX4; CBX5; CBX6; CBX7; CBX8; CBY1; CC2D1A; CC2D1B; CC2D2A; CCAR1; CCAR2; CCBE1; CCBL1; CCDC101; CCDC102B; CCDC103; CCDC105; CCDC108; CCDC114; CCDC115; CCDC121; CCDC122; CCDC129; CCDC130; CCDC134; CCDC136; CCDC140; CCDC141; CCDC148; CCDC151; CCDC167; CCDC169-SOHLH2; CCDC170; CCDC171; CCDC175; CCDC176; CCDC178; CCDC180; CCDC181; CCDC185; CCDC22; CCDC28A; CCDC39; CCDC3; CCDC40; CCDC42B; CCDC42; CCDC50; CCDC54; CCDC60; CCDC62; CCDC63; CCDC65; CCDC66; CCDC67; CCDC68; CCDC6; CCDC78; CCDC80; CCDC83; CCDC85A; CCDC86; CCDC88A; CCDC88C; CCDC8; CCDC91; CCDC94; CCDC97; CCHCR1; CCKAR; CCKBR; CCK; CCL11; CCL13; CCL14; CCL15; CCL16; CCL17; CCL18; CCL19; CCL1; CCL20; CCL21; CCL22; CCL23; CCL24; CCL25; CCL26; CCL27; CCL28; CCL2; CCL3; CCL3L3; CCL4; CCL4L1; CCL4L2; CCL5; CCL7; CCL8; CCM2; CCNA1; CCNA2; CCNB1; CCNB2; CCNB3; CCNC; CCND1; CCND2; CCND3; CCNDBP1; CCNE1; CCNE2; CCNF; CCNG1; CCNG2; CCNH; CCNI; CCNJ; CCNJL; CCNK; CCNL1; CCNL2; CCNO; CCNT1; CCNY; CCP110; CCR10; CCR1; CCR2; CCR3; CCR4; CCR5; CCR6; CCR7; CCR8; CCR9; CCRL2; CCRN4L; CCSER1; CCS; CCT2; CCT3; CCT4; CCT5; CCT6A; CCT6B; CCT7; CD109; CD14; CD151; CD163; CD163L1; CD164; CD177; CD180; CD19; CD1A; CD1B; CD1C; CD1D; CD1E; CD200; CD200R1; CD207; CD209; CD226; CD22; CD244; CD247; CD248; CD24; CD274; CD276; CD27; CD28; CD2AP; CD300A; CD300C; CD300LF; CD302; CD320; CD33; CD34; CD36; CD37; CD38; CD30; CD3EAP; CD3E; CD3G; CD40; CD40LG; CD44; CD46; CD47; CD48; CD4; CD55; CD59; CD5; CD5L; CD63; CD68; CD69; CD6; CD72; CD74; CD79A; CD79B; CD7; CD80; CD81; CD82; CD83; CD84; CD86; CD8A; CD8B; CD93; CD96; CD99; CDADC1; CDAN1; CDC123; CDC14A; CDC14B; CDC16; CDC20B; CDC23; CDC25A; CDC25B; CDC25C; CDC27; CDC34; CDC37; CDC37L1; CDC42BPA; CDC42BPB; CDC42BPG; CDC42EP1; CDC42EP3; CDC42SE2; CDC45; CDC5L; CDC6; CDC73; CDC7; CDCA2; CDCA3; CDCA5; CDCA7; CDCA7L; CDCP1; CDH10; CDH11; CDH13; CDH15; CDH16; CDH17; CDH18; CDH19; CDH1; CDH20; CDH22; CDH23; CDH26; CDH2; CDH3; CDH4; CDH5; CDH6; CDH7; CDH8; CDH9; CDHR1; CDHR2; CDHR3; CDHR5; CDIPT; CDK10; CDK11B; CDK12; CDK13; CDK14; CDK15; CDK16; CDK17; CDK18; CDK19; CDK1; CDK20; CDK2AP1; CDK2AP2; CDK2; CDK3; CDK4; CDK5; CDK5R1; CDK5R2; CDK5RAP1; CDK5RAP2; CDK5RAP3; CDK6; CDK7; CDK8; CDK9; CDKAL1; CDKL1; CDKL2; CDKL3; CDKL4; CDKL5; CDKN1A; CDKN1B; CDKN1C; CDKN2A; CDKN2AIP; CDKN2B; CDKN2C; CDKN20; CDKN3; CDNF; CDO1; CDON; CDR1; CDR2; CDS2; CDT1; CDV3; CDX1; CDX2; CDX4; CDY1B; CDY2B; CDYL2; CDYL; CEACAM16; CEACAM19; CEACAM1; CEACAM21; CEACAM3; CEACAM4; CEACAM5; CEACAM6; CEACAM7; CEACAM8; CEBPA; CEBPB; CEBPD; CEBPE; CEBPG; CEBPZ; CECR1; CECR2; CELA1;

CELA3B; CELF1; CELF2; CELF4; CELF5; CELF6; CEL; CELSR1; CELSR3; CEMIP; CEMP1; CEND1; CENPA; CENPB; CENPC; CENPE; CENPF; CENPH; CENPJ; CENPK; CENPN; CENPO; CENPQ; CENPU; CENPV; CENPW; CEP112; CEP120; CEP128; CEP131; CEP135; CEP152; CEP162; CEP164; CEP170; CEP192; CEP19; CEP250; CEP290; CEP41; CEP55; CEP57; CEP63; CEP68; CEP72; CEP76; CEP83; CEP85L; CEP89; CERT; CERK; CERKL; CERS1; CERS2; CERS3; CERS4; CERS6; CES1; CES2; CES3; CETN1; CETN2; CETN3; CETP; CFAP126; CFAP36; CFAP44; CFAP52; CFAP53; CFAP57; CFAP58; CFAP61; CFAP69; CFAP97; CFB; CFC1B; CFC1; CFD; CFDP1; CFH; CFHR1; CFHR2; CFHR3; CFHR4; CFHR5; CFI; CFL1; CFL2; CFLAR; CFP; CFTR; CGA; CGB1; CGB2; CGB5; CGB7; CGN; CGNL1; CGRRF1; CH25H; CHAC1; CHAD; CHAF1A; CHAF1B; CHAMP1; CHAT; CHCHD10; CHCHD1; CHCHD3; CHCHD5; CHCHD6; CHCHD7; CHD1; CHD2; CHD3; CHD4; CHD6; CHD7; CHD8; CHDH; CHEK1; CHEK2; CHERP; CHFR; CHGA; CHGB; CHI3L1; CHIC1; CHIC2; CHIT1; CHKA; CHKB; CHL1; CHM; CHML; CHMP1A; CHMP1B; CHMP2B; CHMP3; CHMP4A; CHMP4B; CHMP4C; CHMP5; CHN1; CHN2; CHODL; CHORDC1; CHP1; CHP2; CHPF; CHPT1; CHRAC1; CHRD; CHRDL1; CHRFAM7A; CHRM1; CHRM2; CHRM3; CHRM4; CHRM5; CHRNA10; CHRNA1; CHRNA2; CHRNA3; CHRNA4; CHRNA5; CHRNA6; CHRNA7; CHRNB1; CHRNB2; CHRNB3; CHRNB4; CHRND; CHRNE; CHRNG; CHST10; CHST11; CHST12; CHST13; CHST14; CHST15; CHST1; CHST2; CHST3; CHST4; CHST5; CHST6; CHST8; CHST9; CHSY1; CHSY3; CHTF18; CHTOP; CHURC1; CIAO1; CIAPIN1; CIB1; CIB2; CIC; CIDEB; CIDEC; CIITA; CILP2; CILP; CINP; CIPC; CIR1; CIRBP; CIRH1A; CISD1; CISD2; CISH; CITED1; CITED2; CIT; CIZ1; CKAP2; CKAP2L; CKAP4; CKAP5; CKB; CKLF; CKM; CKMT1A; CKMT1B; CKMT2; CKS1B; CKS2; CLASP1; CLASP2; CLCA2; CLCA4; CLCF1; CLC; CLCN1; CLCN2; CLCN3; CLCN4; CLCN5; CLCN6; CLCN7; CLCNKB; CLDN10; CLDN11; CLDN14; CLDN15; CLDN16; CLDN18; CLDN1; CLDN23; CLDN2; CLDN5; CLDN6; CLDN7; CLDN8; CLDN9; CLEC10A; CLEC11A; CLEC12A; CLEC14A; CLEC16A; CLEC1B; CLEC2A; CLEC2B; CLEC20; CLEC2L; CLEC3B; CLEC4A; CLEC4C; CLEC40; CLEC4E; CLEC4G; CLEC4M; CLEC5A; CLEC6A; CLEC7A; CLEC9A; CLECL1; CLGN; CLIC1; CLIC3; CLIC5; CLIC6; CLINT1; CLIP1; CLIP2; CLK1; CLK2; CLLU1; CLMN; CLMP; CLN3; CLN5; CLN6; CLN8; CLNK; CLNS1A; CLOCK; CLP1; CLPP; CLPS; CLPTM1; CLPTM1L; CLRN1; CLSPN; CLSTN1; CLSTN2; CLTA; CLTC; CLTCL1; CLUAP1; CLU; CLUL1; CLVS1; CLYBL; CMA1; CMAS; CMCJ; CMC2; CMC4; CMIP; CMKLR1; CMPK2; CMSS1; CMTM3; CMTM5; CMTM7; CMTM8; CMTR1; CMTR2; CMYA5; CNBD1; CNBP; CNDP1; CNDP2; CNGA1; CNGA3; CNGB1; CNGB3; CNIH3; CNKSR1; CNKSR2; CNKSR3; CNN1; CNN2; CNNM1; CNNM2; CNNM4; CNOT1; CNOT2; CNOT3; CNOT4; CNOT6; CNOT6L; CNOT7; CNOT8; CNP; CNPY2; CNPY3; CNR1; CNR2; CNRIP1; CNST; CNTF; CNTFR; CNTLN; CNTN1; CNTN2; CNTN3; CNTN4; CNTN5; CNTN6; CNTNAP1; CNTNAP2; CNTNAP3; CNTNAP4; CNTNAP5; CNTRL; CNTROB; COAL; COA5; COASY; COBL; COBLL1; COCH; COG1; COG2; COG3; COG4; COG5; COG6; COG7; COGS; COIL; COL10A1; COL11A1; COL11A2; COL12A1; COL13A1; COL14A1; COL15A1; COL16A1; COL17A1; COL18A1; COL1A1; COL1A2; COL20A1; COL21A1; COL22A1; COL23A1; COL24A1; COL25A1; COL26A1; COL27A1; COL28A1; COL2A1; COL3A1; COL4A1; COL4A2; COL4A3BP; COL4A3; COL4A4; COL4A5; COL4A6; COL5A1; COL5A2; COL5A3; COL6A1; COL6A2; COL6A3; COL6A5; COL7A1; COL8A1; COL8A2; COL9A1; COL9A2; COL9A3; COLCA1; COLCA2; COLEC10; COLEC11; COLEC12; COLGALT2; COLQ; COMMD10; COMMD1; COMMD3-BMI1; COMMD5; COMMD7; COMP; COMT; COPA; COPB1; COPB2; COPE; COPG2; COPRS; COPS2; COPS3; COPS4; COPS5; COPSE; COPS7A; COPSE; COPZ2; COQ2; COQ3; COQ4; COQ5; COQ6; COQ7; COQ9; CORIN; CORO1A; CORO1B; CORO1C; CORO2A; CORO2B; CORO6; CORO7; CORO7-PAM16; COTL1; COX10; COX11; COX14; COX15; COX16; COX17; COX18; COX19; COX4I1; COX4I2; COX5A; COX5B; COX6A1; COX6A2; COX6B1; COX6C; COX7A1; COX7A2; COX7A2L; COX7B2; COX7B; COX7C; COX8A; CPA1; CPA2; CPA3; CPA4; CPA6; CPAMD8; CPB1; CPB2; CPD; CPEB1; CPEB3; CPEB4; CPED1; CPE; CP; CPLX1; CPLX2; CPLX3; CPLX4; CPM; CPN1; CPN2; CPNE1; CPNE2; CPNE3; CPNE4; CPNE7; CPNE8; CPO; CPDX; CPPED1; CPQ; CPS1; CPSF1; CPSF2; CPSF3; CPSF3L; CPSF4; CPSF6; CPSF7; CPT1A; CPT1B; CPT1C; CPVL; CPXCR1; CPZ; CR1; CR2; CRABP1; CRABP2; CRACR2A; CRADD; CRAMP1L; CRAT; CRB1; CRB2; CRB3; CRBN; CRCP; CRCT1; CREB1; CREB3; CREB3L1; CREB3L2; CREB3L3; CREB3L4; CREB5; CREBBP; CREBRF; CREBZF; CREG1; CRELD1; CRELD2; CREM; CRHBP; CRH; CRHR1; CRHR2; CRIM1; CRIP2; CRIP3; CRIPAK; CRIPT; CRISP1; CRISP2; CRISP3; CRISPLD1; CRISPLD2; CRK; CRKL; CRLF1; CRLF2; CRLF3; CRLS1; CRMP1; CRNKL1; CRNN; CROCC; CROT; CRP; CRTAC1; CRTAM; CRTAP; CRTC1; CRTC2; CRTC3; CRX; CRY1; CRY2; CRYAB; CRYBA1; CRYBA2; CRYBA4; CRYBB1; CRYBB2; CRYBB3; CRYGB; CRYGC; CRYGD; CRYGS; CRYL1; CRYM; CRYZL1; CSAD; CSAG3; CSE1L; CSF1R; CSF2; CSF2RA; CSF2RB; CSF3; CSGALNACT1; CSGALNACT2; CSH1; CSH2; CSHL1; CS; CSK; CSMD1; CSMD2; CSMD3; CSN1S1; CSN2; CSN3; CSNK1A1; CSNK1D; CSNK1G3; CSNK2A1; CSNK2A2; CSNK2B; CSPG4; CSPG5; CSPP1; CSRNP1; CSRNP3; CSRP1; CSRP2BP; CSRP2; CSRP3; CST1; CST2; CST3; CST4; CST5; CST6; CST7; CST8; CST9; CST9L; CSTA; CSTB; CSTF1; CSTF2; CSTF2T; CSTL1; CT45A1; CT55; CT83; CTAG1A; CTAG2; CTAGE1; CTAGE5; CTBP1; CTBP2; CTC1; CTCF; CTCFL; CTDP1; CTDSP1; CTDSP2; CTDSPL; CTF1; CTGF; CTHRC1; CTIF; CTLA4; CTNNA1; CTNNA2; CTNNA3; CTNNAL1; CTNNB1; CTNNBL1; CTNND1; CTNND2; CTNS; CTPS1; CTR9; CTRB1; CTRB2; CTRC; CTRL; CTSA; CTSB; CTSC; CTSD; CTSE; CTSF; CTSG; CTSH; CTSL; CTSO; CTSV; CTSW; CTSZ; CTTNBP2; CTTN; CTU1; CTXN3; CUBN; CUEDC1; CUEDC2; CUL1; CUL2; CUL3; CUL4A; CUL4B; CUL5; CULT; CUL9; CUTA; CUX1; CUX2; CUZD1; CWC22; CWC27; CWF19L1; CWF19L2; CWH43; CX3CL1; CX3CR1; CXADR; CXCL10; CXCL11; CXCL12; CXCL13; CXCL14; CXCL16; CXCL17; CXCL1; CXCL2; CXCL3; CXCL5; CXCL6; CXCL8; CXCL9; CXCR1; CXCR2; CXCR3; CXCR4; CXCR5; CXCR6; CXorf36; CXorf66; CXorf67; CXXC1; CXXC4; CYB561D2; CYB561; CYB5A; CYB5B; CYB5R3; CYB5R4; CYBA; CYBB; CYBRD1; CYC1; CYCS; CYFIP1; CYFIP2; CYGB; CYLC1; CYLC2; CYLD; CYP11A1; CYP11B1; CYP11B2; CYP17A1; CYP19A1; CYP1A1; CYP1A2; CYP1B1;

CYP21A2; CYP24A1; CYP26A1; CYP26B1; CYP26C1; CYP27A1; CYP27B1; CYP27C1; CYP2A13; CYP2A6; CYP2A7; CYP2B6; CYP2C18; CYP2C19; CYP2C8; CYP2C9; CYP2D6; CYP2E1; CYP2F1; CYP2R1; CYP2S1; CYP2U1; CYP2W1; CYP39A1; CYP3A43; CYP3A4; CYP3A5; CYP3A7-CYP3A51P; CYP3A7; CYP46A1; CYP4A11; CYP4B1; CYP4F11; CYP4F12; CYP4F22; CYP4F2; CYP4F3; CYP4F8; CYP4V2; CYP51A1; CYP7A1; CYP7B1; CYP8B1; CYST; CYS-LTR1; CYTH1; CYTH3; CYTIP; CYTL1; CYYR1; D2HGDH; DAAM1; DAAM2; DAB2; DAB2IP; DACH1; DACH2; DACT1; DACT2; DACT3; DAD1; DAG1; DAND5; DAOA; DAO; DAP3; DAP; DAPK1; DAPK2; DAPK3; DARS2; DARS; DAW1; DAXX; DAZ1; DAZ2; DAZ3; DAZ4; DAZAP1; DAZAP2; DAZL; DBF4; DBH; DBI; DBN1; DBNL; DBP; DBR1; DBX1; DCAF12; DCAF13; DCAF17; DCAF4; DCAF5; DCAF6; DCAF7; DCAF8; DCANP1; DCBLD1; DCBLD2; DCC; DCDC2C; DCDC2; DCD; DCHS1; DCHS2; DCK; DCLK1; DCLK2; DCLK3; DCLRE1A; DCLRE1C; DCN; DCP1A; DCP1B; DCPS; DCST1; DCST2; DCSTAMP; DCTD; DCT; DCTN1; DCTN2; DCTN3; DCTN4; DCTN5; DCTN6; DCUN1D1; DCX; DCXR; DDAH1; DDAH2; DDB1; DDB2; DDC; DDHD1; DDHD2; DDI1; DDIAS; DDIT3; DDIT4; DDIT4L; DDN; DDO; DDR1; DDR2; DDRGK1; DDT; DDTL; DDX10; DDX11; DDX17; DDX18; DDX19A; DDX1; DDX21; DDX25; DDX27; DDX28; DDX31; DDX39A; DDX39B; DDX3X; DDX3Y; DDX41; DDX42; DDX43; DDX46; DDX4; DDX50; DDX51; DDX52; DDX53; DDX54; DDX56; DDX58; DDX59; DDX5; DDX60; DDX6; DEAF1; DEC1; DECR1; DEDD; DEF6; DEFA1B; DEFA3; DEFA4; DEFA5; DEFA6; DEFB103B; DEFB104B; DEFB105A; DEFB106A; DEFB108B; DEFB112; DEFB125; DEFB126; DEFB1; DEFB4A; DEGS1; DEGS2; DEK; DENND1A; DENND1B; DENND2A; DENND4A; DENR; DEPDC1B; DEPDC5; DEPTOR; DERA; DERL1; DERL2; DERL3; DES; DESI2; DEXI; DFFB; DFNA5; DFNB31; DFNB59; DGAT1; DGAT2; DGCR2; DGCR6L; DGCR8; DGKA; DGKB; DGKD; DGKE; DGKG; DGKH; DGKI; DGKK; DGKQ; DGKZ; DGUOK; DHCR7; DHDH; DHFR; DHFRL1; DHH; DHODH; DHPS; DHRS11; DHRS2; DHRS4; DHRS7C; DHRS9; DHTKD1; DHX15; DHX16; DHX32; DHX34; DHX36; DHX38; DHX40; DHX58; DHX8; DHX9; DIABLO; DIAPH1; DIAPH2; DIAPH3; DICER1; DIDO1; DIEXF; DIP2A; DIP2B; DIP2C; DIRAS1; DIRAS2; DIRC1; DIRC2; DIS3; DIS3L2; DIS3L; DISC1; DISP1; DIXDC1; DKC1; DKK1; DKK2; DKK3; DKK4; DKKL1; DLAT; DLC1; DLD; DLEC1; DLEU7; DLG1; DLG2; DLG3; DLG4; DLG5; DLGAP1; DLGAP2; DLGAP3; DLGAP5; DLK1; DLL1; DLL3; DLL4; DLST; DLX1; DLX2; DLX3; DLX4; DLX5; DLX6; DMBT1; DMC1; DMD; DMGDH; DMKN; DMP1; DMPK; DMRT1; DMRT2; DMRT3; DMRTA1; DMTF1; DMTN; DMWD; DMXL1; DMXL2; DNA2; DNAAF1; DNAAF2; DNAAF3; DNAAF5; DNAH11; DNAH12; DNAH17; DNAH1; DNAH2; DNAH3; DNAH5; DNAH6; DNAH7; DNAH8; DNAH9; DNAI1; DNAI2; DNAJA1; DNAJA2; DNAJA3; DNAJB11; DNAJB13; DNAJB1; DNAJB2; DNAJB5; DNAJB6; DNAJB7; DNAJB8; DNAJB9; DNAJC10; DNAJC12; DNAJC13; DNAJC14; DNAJC15; DNAJC18; DNAJC19; DNAJC1; DNAJC27; DNAJC28; DNAJC2; DNAJC3; DNAJC5; DNAJC7; DNAL1; DNASE1; DNASE1L2; DNASE1L3; DNASE2B; DNASE2; DND1; DNER; DNHD1; DNLZ; DNM1; DNM1L; DNM2; DNM3; DNMBP; DNMT1; DNMT3A; DNMT3B; DNMT3L; DNPEP; DNTT; DOC2A; DOC2B; DOCK10; DOCK11; DOCK1; DOCK2; DOCK3; DOCK4; DOCK5; DOCK6; DOCK7; DOCK8; DOCK9; DOHH; DOK1; DOK2; DOK3; DOK4; DOK5; DOK6; DOK7; DOLK; DONSON; DOPEY2; DOT1L; DPAGT1; DPCD; DPCR1; DPEP1; DPEP2; DPEP3; DPF1; DPF3; DPH1; DPH3; DPH6; DPH7; DPM1; DPM2; DPM3; DPP10; DPP3; DPP4; DPP6; DPP7; DPP8; DPP9; DPPA2; DPPA3; DPPA4; DPT; DPY19L2; DPY19L3; DPY30; DPYS; DPYSL2; DPYSL3; DPYSL4; DPYSL5; DRAM1; DRAP1; DRC1; DRD1; DRD2; DRD3; DRD4; DRD5; DRG1; DRGX; DROSHA; DRP2; DSC1; DSC2; DSC3; DSCAM; DSCAML1; DSCC1; DSCR4; DSE; DSEL; DSG1; DSG2; DSG3; DSG4; DSP; DSPP; DST; DSTN; DSTYK; DTD1; DTHD1; DTL; DTNA; DTNB; DTNBP1; DTX1; DTX2; DTX3; DTX4; DTYMK; DUOX1; DUOX2; DUOXA1; DUOXA2; DUPD1; DUS2; DUSP10; DUSP11; DUSP12; DUSP13; DUSP14; DUSP15; DUSP16; DUSP18; DUSP1; DUSP21; DUSP22; DUSP23; DUSP27; DUSP28; DUSP2; DUSP3; DUSP4; DUSP5; DUSP6; DUSP7; DUSP8; DUSP9; DUT; DUX4; DVL2; DVL3; DXO; DYM; DYNAP; DYNC1H1; DYNC1I1; DYNC1I2; DYNC1LI1; DYNC2H1; DYNLL1; DYNLL2; DYNLRB1; DYNLT1; DYNLT3; DYRK1A; DYRK1B; DYRK2; DYRK3; DYSF; DYX1C1; DZIP1; E2F1; E2F3; E2F4; E2F5; E2F6; E2F7; E2F8; E4F1; EAF1; EAF2; EARS2; EBAG9; EBF1; EBF2; EBF3; EBF4; EBI3; EBP; EBPL; ECD; ECE2; ECEL1; ECHDC1; ECHDC3; ECHS1; ECI1; ECI2; ECSCR; ECSIT; ECT2; EDA2R; EDA; EDARADD; EDAR; EDC4; EDEM1; EDIL3; EDN1; EDN3; EDNRA; EDNRB; EEA1; EED; EEF1A1; EEF1A2; EEF1B2; EEF1D; EEF1E1; EEF1G; EEF2; EEFSEC; EFCAB11; EFCAB1; EFEMP1; EFEMP2; EFHB; EFHC1; EFHC2; EFHD1; EFNA1; EFNA2; EFNA3; EFNA4; EFNA5; EFNB1; EFNB2; EFNB3; EFR3A; EFR3B; EFS; EFTUD1; EFTUD2; EGF; EGFL6; EGFL7; EGFL8; EGFLAM; EGFR; EGLN1; EGLN2; EGLN3; EGR1; EGR2; EGR3; EGR4; EHBP1; EHD1; EHD2; EHD3; EHD4; EHF; EHHADH; EHMT1; EHMT2; EI24; EID1; EIF1AD; EIF1AX; EIF1AY; EIF1; EIF2A; EIF2AK1; EIF2AK2; EIF2AK3; EIF2AK4; EIF2B1; EIF2B2; EIF2B3; EIF2B4; EIF2B5; EIF2S1; EIF2S2; EIF2S3; EIF3A; EIF3B; EIF3C; EIF3E; EIF3F; EIF3H; EIF3J; EIF3K; EIF3M; EIF4A1; EIF4A2; EIF4A3; EIF4B; EIF4E2; EIF4E3; EIF4EBP1; EIF4EBP2; EIF4EBP3; EIF4E; EIF4EIF1; EIF4G1; EIF4G2; EIF4H; EIF5A2; EIF5A; EIF5; EIF6; ELAC1; ELAC2; ELANE; ELAVL1; ELAVL2; ELAVL3; ELAVL4; ELF1; ELF2; ELF3; ELF4; ELF5; ELK1; ELK3; ELK4; ELL2; ELL; ELMO1; ELMO2; ELMOD1; ELMOD2; ELMOD3; ELM-SAN1; ELN; ELOF1; ELOVL2; ELOVL4; ELOVL5; ELOVL6; ELOVL7; ELP2; ELP3; ELP4; ELP6; ELSPBP1; EMB; EMC10; EMC2; EMC3; EMC7; EMC8; EMCN; EMD; EME1; EMG1; EMILIN1; EMILIN2; EMILIN3; EML1; EML2; EML4; EML5; EML6; EMP1; EMP2; EMX1; EMX2; EN1; EN2; ENAH; ENAM; ENC1; ENDOG; ENDOU; ENDOV; ENGASE; ENG; ENHO; ENO2; ENO3; ENO4; ENOPH1; ENOSF1; ENOX1; ENOX2; ENPEP; ENPP1; ENPP2; ENPP3; ENPP5; ENPP7; ENTHD2; ENTPD1; ENTPD2; ENTPD4; ENTPD5; ENTPD6; ENTPD7; EOGT; EOMES; EP300; EP400; EPAS1; EPB41L1; EPB41L2; EPB41L3; EPB41L4A; EPB41L4B; EPB42; EPC1; EPC2; EPCAM; EPDR1; EPG5; EPGN; EPHA1; EPHA3; EPHA4; EPHA5; EPHA6; EPHA7; EPHB1; EPHB3; EPHB4; EPHB6; EPHX1; EPHX2; EPHX3; EPM2A; EPM2AIP1; EPN1; EPO; EPOR; EPPIN; EPPIN-WFDC6; EPPK1; EPRS; EPS15L1; EPS8; EPS8L2; EPSTI1; EPX; EPYC; ERAL1; ERAP1; ERAP2; ERAS; ERBB2; ERBB2IP; ERBB3;

ERBB4; ERCT; ERC2; ERCC1; ERCC2; ERCC3; ERCC4; ERCC5; ERCC6; ERCC6L2; ERCC6-PGBD3; ERCC8; EREG; ERF; ERG; ERGIC1; ERGIC2; ERGIC3; ERI3; ERICH5; ERICH6B; ERLEC1; ERLIN1; ERLIN2; ERMAP; ERMARD; ERMP1; ERN1; ERN2; ERO1LB; ERO1L; ERP29; ERP44; ERV3-1; ERVW-1; ESAM; ESCO1; ESCO2; ESD; ESF1; ESM1; ESPL1; ESPN; ESR1; ESR2; ESRP1; ESRP2; ESRRA; ESRRB; ESRRG; ESX1; ESYT1; ESYT2; ESYT3; ETAA1; ETF1; ETFA; ETFB; ETFDH; ETHE1; ETNK1; ETNK2; ETNPPL; ETS1; ETS2; ETV1; ETV3; ETV4; ETV5; ETV6; ETV7; EVA1A; EVA1C; EVC2; EVC; EVI2A; EVI2B; EVI5; EVL; EVPL; EVX1; EVX2; EWSR1; EXD2; EXD3; EXO1; EXOC1; EXOC2; EXOC3L1; EXOC3L2; EXOC4; EXO05; EXOC7; EXOG; EXOSC1; EXOSC2; EXOSC3; EXOSC4; EXOSC5; EXOSC6; EXOSC7; EXOSC8; EXPH5; EXT1; EXT2; EXTL2; EXTL3; EYA1; EYA2; EYA4; EYS; EZH1; EZH2; EZR; F10; F11; F11R; F12; F13A1; F13B; F2; F2R; F2RL1; F2RL2; F2RL3; F5; F7; F8; F9; FA2H; FAAH2; FABP1; FABP2; FABP4; FABP5; FABP6; FABP7; FABP9; FADD; FADS1; FADS2; FADS3; FAF2; FAHD2A; FAH; FAIM2; FAIM3; FAM102A; FAM103A1; FAM105A; FAM107A; FAM107B; FAM109A; FAM110A; FAM110B; FAM110C; FAM111B; FAM114A1; FAM120B; FAM120C; FAM124B; FAM126A; FAM129A; FAM129B; FAM134B; FAM135A; FAM135B; FAM136A; FAM13A; FAM13C; FAM149A; FAM150B; FAM155A; FAM160B1; FAM161A; FAM163A; FAM163B; FAM167A; FAM168A; FAM168B; FAM169B; FAM170A; FAM172A; FAM173B; FAM174A; FAM175A; FAM175B; FAM177A1; FAM177B; FAM178A; FAM178B; FAM179B; FAM180A; FAM184A; FAM184B; FAM187B; FAM188A; FAM188B; FAM189B; FAM193B; FAM196A; FAM196B; FAM198B; FAM19A1; FAM19A2; FAM19A4; FAM19A5; FAM204A; FAM205A; FAM20A; FAM20B; FAM20C; FAM210B; FAM213A; FAM214A; FAM216A; FAM220A; FAM227B; FAM32A; FAM3A; FAM3B; FAM3C; FAM3D; FAM46A; FAM46D; FAM49A; FAM49B; FAM50B; FAM53B; FAM57A; FAM58A; FAM60A; FAM63B; FAM64A; FAM65B; FAM69C; FAM71F1; FAM71F2; FAM72B; FAM78B; FAM81B; FAM83A; FAM83B; FAM83D; FAM83H; FAM84A; FAM84B; FAM89A; FAM92A1; FAM92B; FAM9B; FAN1; FANCA; FANCB; FANCC; FANCD2; FANCE; FANCF; FANCG; FANCI; FANCL; FANCM; FANK1; FAP; FAR1; FARP1; FARP2; FARS2; FARSA; FAS; FASLG; FASN; FASTKD2; FASTK; FAT1; FAT2; FAT3; FAT4; FATE1; FAU; FBF1; FBL; FBLIM1; FBLN1; FBLN2; FBLN5; FBN1; FBN2; FBN3; FBP1; FBP2; FBRS; FBXL15; FBXL17; FBXL19; FBXL20; FBXL2; FBXL3; FBXL4; FBXL5; FBXL7; FBXO10; FBXO11; FBXO15; FBXO17; FBXO18; FBXO28; FBXO30; FBXO31; FBXO32; FBXO33; FBXO38; FBXO3; FBXO40; FBXO47; FBXO4; FBXO5; FBXO7; FBXO8; FBXO9; FBXW11; FBXW4; FBXW7; FBXW8; FCAR; FCER1A; FCER1G; FCER2; FCGBP; FCGR2A; FCGR2B; FCGR3A; FCGR3B; FCGRT; FCH01; FCHO2; FCHSD2; FCN1; FCN2; FCRL1; FCRL2; FCRL3; FCRL4; FCRL5; FCRL6; FCRLA; FCRLB; FDFT1; FDPS; FDX1; FDX1L; FDXR; FECH; FEM1A; FEM1B; FEM1C; FEN1; FERD3L; FER; FERMT1; FERMT2; FERMT3; FES; FEV; FEZ1; FEZ2; FEZF1; FEZF2; FFAR1; FFAR2; FFAR3; FFAR4; FGA; FGB; FGD1; FGD2; FGD3; FGD4; FGD5; FGD6; FGF10; FGF11; FGF12; FGF13; FGF14; FGF16; FGF17; FGF18; FGF19; FGF1; FGF20; FGF21; FGF23; FGF2; FGF3; FGF4; FGF5; FGF6; FGF7; FGF8; FGF9; FGFBP1; FGFBP2; FGFBP3; FGFR1; FGFR10P2; FGFR10P; FGFR2; FGFR3; FGFR4; FGFRL1; FGG; FGGY; FGL1; FGL2; FGR; FHDC1; FH; FHIT; FHL1; FHL2; FHL5; FHOD1; FHOD3; FIBP; FIG4; FIGF; FIGLA; FIGN; FILIP1; FILIP1L; FIP1L1; FIST; FITM1; FITM2; FJX1; FKBP10; FKBP11; FKBP14; FKBP15; FKBP1A; FKBP1B; FKBP2; FKBP3; FKBP4; FKBP5; FKBP6; FKBP7; FKBP8; FKBP9; FKBPL; FKRP; FKTN; FLAD1; FLCN; FLG2; FLG; FLI1; FLII; FLNA; FLNB; FLNC; FLOT1; FLOT2; FLRT2; FLRT3; FLT1; FLT3; FLT3LG; FLT4; FLVCR1; FLVCR2; FMN1; FMN2; FMNL1; FMNL2; FMNL3; FMO1; FMO2; FMO3; FMO4; FMOD; FMR1; FN1; FN3K; FN3KRP; FNBP1; FNDC1; FNDC3A; FNDC3B; FNDC4; FNTA; FNTB; FOCAD; FOLH1; FOLR1; FOLR2; FOLR3; FOPNL; FOSB; FOS; FOSL1; FOSL2; FOXA1; FOXA2; FOXA3; FOXB1; FOXC1; FOXC2; FOXD1; FOXE1; FOXF1; FOXF2; FOXG1; FOXH1; FOXI1; FOXJ1; FOXJ2; FOXK1; FOXK2; FOXL1; FOXL2; FOXM1; FOXN1; FOXN2; FOXN3; FOXO1; FOXO3; FOXO4; FOXO6; FOXP1; FOXP2; FOXP3; FOXP4; FOXQ1; FOXR1; FOXR2; FOXRED1; FPGS; FPR1; FPR2; FPR3; FRAS1; FRAT1; FRAT2; FREM1; FREM2; FREM3; FRG1; FRG2; FRK; FRMD3; FRMD4A; FRMD4B; FRMD5; FRMD6; FRMD7; FRMPD1; FRMPD2; FRMPD4; FRRS1L; FRS2; FRS3; FRY; FRYL; FRZB; FSBP; FSCN1; FSCN2; FSD1; FSD1L; FSD2; FSHB; FSHR; FSIP1; FST; FSTL1; FSTL3; FSTL4; FSTL5; FTCD; FTH1; FTL; FTMT; FTO; FTSJ1; FTSJ2; FTSJ3; FUBP1; FUBP3; FUCA1; FUCA2; FUNDC1; FUNDC2; FURIN; FUS; FUT10; FUT11; FUT1; FUT2; FUT3; FUT4; FUT5; FUT6; FUT7; FUT8; FUT9; FUZ; FXN; FXR1; FXR2; FXYD1; FXYD2; FXYD3; FXYD5; FXYD6; FYB; FYCO1; FYN; FZD10; FZD1; FZD2; FZD3; FZD4; FZD5; FZD6; FZD7; FZD8; FZD9; FZR1; GOS2; G2E3; G3BP1; G6PC2; G6PC3; G6PC; G6PD; GAA; GAB1; GAB2; GAB3; GABARAP; GABARAPL1; GABARAPL2; GABBR1; GABBR2; GABPA; GABPB1; GABRA1; GABRA2; GABRA3; GABRA4; GABRA5; GABRA6; GABRB1; GABRB2; GABRB3; GABRE; GABRG1; GABRG2; GABRG3; GABRP; GABRQ; GABRR1; GABRR2; GAD1; GAD2; GADD45B; GADD45G; GADD45GIP1; GADL1; GAGE10; GAGE1; GAK; GALC; GAL; GALK1; GALK2; GALM; GALNS; GALNT12; GALNT13; GALNT14; GALNT15; GALNT18; GALNT1; GALNT2; GALNT3; GALNT4; GALNT5; GALNT6; GALNT7; GALNT8; GALNT9; GALNTL6; GALP; GALR1; GALR2; GALR3; GALT; GAMT; GANAB; GANC; GAN; GAP43; GAPDH; GAPDHS; GAR1; GAREM; GARNL3; GARS; GART; GAS1; GAS2; GAS2L1; GAS6; GAS7; GASB; GAST; GATA1; GATA2; GATA3; GATA4; GATA5; GATA6; GATAD1; GATAD2A; GATAD2B; GATB; GATM; GBA2; GBA; GBAS; GBE1; GBF1; GBGT1; GBX1; GBX2; GCA; GCC1; GCDH; GCFC2; GCG; GCGR; GCH1; GCHFR; GC; GCK; GCKR; GCLC; GCM1; GCM2; GCN1L1; GCNT1; GCNT2; GCNT3; GCNT7; GCOM1; GCSAM; GCSAML; GCSH; GDA; GDAP1; GDE1; GDF10; GDF11; GDF15; GDF1; GDF2; GDF3; GDF5; GDF6; GDF7; GDF9; GDI1; GDI2; GDNF; GDPD3; GDPD5; GEM; GEMIN2; GEMIN4; GEMIN6; GEN1; GET4; GFAP; GFER; GFI1B; GFI1; GFM1; GFPT1; GFPT2; GFRA1; GFRA2; GFRA3; GFRA4; GGA1; GGA3; GGACT; GGCT; GGCX; GGH; GGNBP2; GGN; GGPS1; GGT1; GGT2; GGT5; GGTLC1; GH1; GH2; GHITM; GHRH; GHR; GHRHR; GHRL; GHSR; GIDS; GIF; GIGYF1; GIGYF2; GIMAP5; GIMAP7; GIMAP8; GIN1; GINS1; GINS2; GIPC1; GIPC3; GIP; GIPR; GIT1; GIT2; GJA1; GJA3; GJA8; GJB1; GJB2; GJB6; GJC1; GJC2; GJC3;

GJD2; GJD3; GK; GKN1; GKN2; GLA; GLB1; GLCCI1; GLCE; GLDC; GLDN; GLE1; GLG1; GLI1; GLI2; GLI3; GLIPR1; GLIPR2; GLIS2; GLIS3; GLMN; GL01; GLOD4; GLP1R; GLP2R; GLRA1; GLRA2; GLRA3; GLRB; GLRX2; GLRX3; GLRX5; GLRX; GLS2; GLS; GLT1D1; GLT6D1; GLT8D1; GLTSCR1; GLTSCR2; GLUD1; GLUD2; GLUL; GLYAT; GLYATL3; GLYCTK; GM2A; GMCL1; GMDS; GMFB; GMFG; GMIP; GML; GMNN; GMPPA; GMPPB; GMPR2; GMPR; GMPS; GNA11; GNA12; GNA13; GNA14; GNA15; GNAI1; GNAI2; GNAL; GNAO1; GNAQ; GNAS; GNAT1; GNAT3; GNAZ; GNB1L; GNB2L1; GNB3; GNB4; GNB5; GNE; GNG10; GNG11; GNG2; GNG4; GNG7; GNG8; GNGT1; GNGT2; GNL1; GNL3; GNL3L; GNLY; GNMT; GNPAT; GNPDA1; GNPDA2; GNPTAB; GNPTG; GNRH1; GNRH2; GNRHR; GNS; GOLGA1; GOLGA2; GOLGA3; GOLGA4; GOLGA5; GOLGA8B; GOLGB1; GOLM1; GOLPH3; GOLT1A; GOLT1B; GON4L; GOPC; GORAB; GORASP1; GORASP2; GOSR1; GOSR2; GOT1; GOT2; GP1BA; GP1BB; GP2; GPS; GP6; GP9; GPA33; GPAA1; GPALPP1; GPAM; GPANK1; GPAT2; GPATCH1; GPATCH2; GPATCH2L; GPATCH8; GPBAR1; GPC1; GPC2; GPC3; GPC4; GPC5; GPC6; GPCPD1; GPD1; GPD1L; GPD2; GPER1; GPHA2; GPHN; GPIHBP1; GPI; GPKOW; GPLD1; GPM6A; GPM6B; GPN1; GPNMB; GPR101; GPR119; GPR12; GPR132; GPR135; GPR137C; GPR139; GPR143; GPR148; GPR149; GPR150; GPR151; GPR152; GPR153; GPR155; GPR156; GPR158; GPR15; GPR160; GPR161; GPR162; GPR171; GPR174; GPR176; GPR179; GPR17; GPR180; GPR182; GPR183; GPR19; GPR1; GPR20; GPR22; GPR26; GPR34; GPR35; GPR37; GPR37L1; GPR39; GPR4; GPR50; GPR52; GPR55; GPR65; GPR68; GPR6; GPR75; GPR78; GPR83; GPR87; GPRASP1; GPRC5A; GPRC5B; GPRC5C; GPRC5D; GPRC6A; GPRIN1; GPRIN2; GPRIN3; GPS2; GPSM1; GPSM2; GPSM3; GPT2; GPT; GPX5; GRAMD1B; GRAMD3; GRAMD4; GRAP2; GRAP; GRASP; GRB10; GRB14; GRB2; GRB7; GREB1; GREM1; GREM2; GRHL1; GRHL2; GRHPR; GRIA1; GRIA2; GRIA3; GRIA4; GRID1; GRID2; GRIK1; GRIK2; GRIK4; GRIK5; GRIN1; GRIN2A; GRIN2B; GRIN2C; GRIN2D; GRIN3A; GRIN3B; GRINA; GRIP1; GRK1; GRK4; GRK5; GRK6; GRK7; GRM1; GRM2; GRM3; GRM4; GRM5; GRM6; GRM7; GRM8; GRN; GRPEL1; GRP; GRPR; GRSF1; GRXCR1; GRXCR2; GSC2; GSC; GSDMA; GSDMB; GSDMC; GSDMD; GSE1; GSG1L; GSK3A; GSK3B; GSN; GSPT1; GSPT2; GSR; GSS; GSTA1; GSTA2; GSTA4; GSTA5; GSTCD; GSTK1; GSTM3; GSTO1; GSTO2; GSTP1; GSTT1; GSTT2B; GSTT2; GSTZ1; GSX1; GSX2; GTDC1; GTF2A1; GTF2A1L; GTF2A2; GTF2E1; GTF2E2; GTF2F1; GTF2F2; GTF2H1; GTF2H2C_2; GTF2H2C; GTF2H2; GTF2H3; GTF2H4; GTF2H5; GTF2I; GTF2IRD1; GTF2IRD2; GTF3A; GTF3C1; GTPBP1; GTPBP3; GTPBP4; GTSF1; GUCA1A; GUCA1B; GUCD1; GUCY1A2; GUCY1A3; GUCY1B3; GUCY2C; GUCY2D; GUCY2F; GUK1; GULP1; GUSB; GYG1; GYG2; GYLTL1B; GYPA; GYPB; GYPC; GYPE; GYS1; GYS2; GZF1; GZMA; GZMB; GZMH; GZMK; GZMM; H1FO; H1FX; H2AFJ; H2AFX; H2AFY2; H2AFY; H2AFZ; H2BFWT; H3F3B; HAAO; HABP2; HABP4; HACD1; HACD2; HACD4; HACE1; HACL1; HADHA; HADHB; HADH; HAGH; HAL; HAMP; HAND1; HAND2; HAO1; HAO2; HAP1; HAPLN1; HAPLN4; HARS2; HARS; HAST; HAS2; HAS3; HAT1; HAVCR1; HAVCR2; HAX1; HBA2; HBB; HBD; HBE1; HBEGF; HBG1; HBG2; HBM; HBP1; HBQ1; HBS1L; HBZ; HCAR1; HCAR2; HCAR3; HCCS; HCFC1; HCFC2; HCK; HCLS1; HCN1; HCN2; HCN3; HCN4; HCRT; HCRTR2; HCST; HDAC10; HDAC11; HDAC1; HDAC2; HDAC3; HDAC4; HDAC5; HDAC6; HDAC7; HDAC8; HDAC9; HDC; HDDC2; HDGF; HDGFL1; HDGFRP3; HDHD1; HDLBP; HEATR1; HEATR3; HEATR5B; HEATR6; HEBP1; HEBP2; HECA; HECTD2; HECTD4; HECW1; HECW2; HEG1; HELLS; HELQ; HELT; HELZ2; HELZ; HEMGN; HEPACAM; HEPH; HEPN1; HERC1; HERC2; HERC3; HERC5; HERC6; HERPUD1; HES1; HES2; HES6; HEST; HESX1; HEXA; HEXB; HEXDC; HEXIM1; HEY1; HEY2; HFE; HFM1; HGD; HGFAC; HGF; HGH1; HGS; HGSNAT; HHAT; HHATL; HHEX; HHIP; HHIPL1; HHLA1; HHLA2; HIAT1; HIBADH; HIBCH; HIC1; HIC2; HID1; HIF1A; HIF1AN; HIF3A; HIGD1A; HIGD1C; HIGD2A; HILPDA; HINFP; HINT1; HINT2; HIP1; HIP1R; HIPK1; HIPK2; HIPK3; HIRA; HIRIP3; HIST1H1A; HIST1H1B; HIST1H1C; HIST1H1D; HIST1H1E; HIST1H1T; HIST1H2AE; HIST1H2AH; HIST1H2BG; HIST1H2BH; HIST1H2BM; HIST1H3G; HIST1H4D; HIST3H3; HIVEP1; HIVEP2; HJURP; HK1; HK2; HK3; HKDC1; HLA-A; HLA-B; HLA-C; HLA-DMA; HLA-DMB; HLA-DOA; HLA-DOB; HLA-DPA1; HLA-DPB1; HLA-DQA1; HLA-DQA2; HLA-DQB1; HLA-DQB2; HLA-DRA; HLA-DRB1; HLA-DRB3; HLA-DRB4; HLA-DRB5; HLA-E; HLA-F; HLA-G; HLCS; HLF; HLTF; HLX; HM13; HMBOX1; HMBS; HMCN1; HMG20A; HMG20B; HMGA1; HMGA2; HMGB1; HMGB2; HMGB3; HMGCR; HMGCS1; HMGN1; HMGN4; HMGN5; HMGXB3; HMGXB4; HMHA1; HMMR; HMOX1; HMOX2; HMP19; HMSD; HMX1; HN1; HN1L; HNF1A; HNF1B; HNF4A; HNF4G; HNMT; HNRNPAO; HNRNPA1; HNRNPA2B1; HNRNPA3; HNRNPAB; HNRNPC; HNRNPD; HNRNPDL; HNRNPF; HNRNPH1; HNRNPH2; HNRNPK; HNRNPL; HNRNPM; HNRNPR; HNRNPU; HNRNPUL1; HOGA1; HOMER1; HOMER2; HOMER3; HOMEZ; HOOK2; HOOK3; HOPX; HORMAD2; HOXA10; HOXA11; HOXA13; HOXA1; HOXA2; HOXA3; HOXA4; HOXA5; HOXA6; HOXA7; HOXA9; HOXB13; HOXB1; HOXB2; HOXB3; HOXB4; HOXB5; HOXB6; HOXB7; HOXB8; HOXB9; HOXC10; HOXC11; HOXC12; HOXC13; HOXC4; HOXC5; HOXC6; HOXC8; HOXC9; HOXD10; HOXD11; HOXD12; HOXD13; HOXD1; HOXD3; HOXD4; HOXD8; HOXD9; HP1BP3; HPCAL1; HPD; HPGD; HPGDS; HP; HPN; HPR; HPRT1; HPS1; HPS3; HPS4; HPS5; HPS6; HPSE2; HPSE; HPX; HRAS; HRASLS; HRC; HRG; HRH1; HRH2; HRH3; HRH4; HR; HRK; HRNR; HRSP12; HS1BP3; HS3ST1; HS3ST2; HS3ST3A1; HS3ST3B1; HS3ST4; HS3ST5; HS3ST6; HS6ST1; HS6ST2; HS6ST3; HSBP1; HSD11B1; HSD11B1L; HSD11B2; HSD17B10; HSD17B11; HSD17B12; HSD17B13; HSD17B14; HSD17B1; HSD17B2; HSD17B3; HSD17B4; HSD17B6; HSD17B7; HSD17B8; HSD3B1; HSD3B7; HSDL1; HSDL2; HSF1; HSF2; HSF4; HSF5; HSFY2; HSH2D; HSP90AA1; HSP90AB1; HSP90B1; HSPA12A; HSPA12B; HSPA13; HSPA14; HSPA1A; HSPAIL; HSPA2; HSPA4; HSPA4L; HSPA5; HSPA6; HSPA8; HSPA9; HSPB1; HSPB2; HSPB3; HSPB6; HSPB7; HSPB8; HSPB9; HSPBAP1; HSPBP1; HSPD1; HSPE1; HSPG2; HSPH1; HTATIP2; HTN1; HTN3; HTR1A; HTR1B; HTR1E; HTR1F; HTR2A; HTR2B; HTR2C; HTR3A; HTR3B; HTR3C; HTR3D; HTR3E; HTR4; HTR5A; HTR7; HTRA1; HTRA2; HTRA3; HTRA4; HTT; HUNK; HUS1B; HUS1; HUWE1; HVCN1; HYAL1; HYAL2; HYAL3; HYAL4; HYDIN; HYKK; HYLS1; HYOU1; HYPM; IAPP; IARS2; IARS; IBA57; TBSP; IBTK; ICA1; ICAM1; ICAM2; ICAM3;

ICAM4; ICAM5; ICE1; ICE2; ICK; ICMT; ICOS; ICOSLG; ID1; ID2; ID4; IDE; IDH1; IDH2; IDH3B; IDNK; IDOL; ID02; IDS; IDUA; IER2; IER3; IER3IP1; IER5; IFF01; IFF02; IFI16; IFI27; IFI30; IFI35; IFI44; IFIH1; IFIT1; IFIT2; IFIT3; IFIT5; IFITM1; IFITM2; IFITM3; IFITM5; IFNA10; IFNA13; IFNA14; IFNA16; IFNA17; IFNA1; IFNA21; IFNA2; IFNA4; IFNA5; IFNA6; IFNA7; IFNA8; IFNAR1; IFNAR2; IFNB1; IFNE; IFNG; IFNGR1; IFNGR2; IFNK; IFNL1; IFNL2; IFNL3; IFNW1; IFRD1; IFT122; IFT140; IFT172; IFT27; IFT43; IFT57; IFT74; IFT80; IFT88; IGBP1; IGDCC3; IGF1; IGF1R; IGF2BP1; IGF2BP2; IGF2BP3; IGF2; IGF2R; IGFALS; IGFBP1; IGFBP2; IGFBP3; IGFBP4; IGFBP5; IGFBP6; IGFBP7; IGFBPL1; IGFL1; IGFLR1; IGHMBP2; IGJ; IGLL1; IGSF10; IGSF11; IGSF1; IGSF5; IGSF6; IGSF8; IHH; IKBKAP; IKBKB; IKBKE; IKBKG; IK; IKZF1; IKZF2; IKZF3; IKZF4; IL10; IL10RA; IL10RB; IL11; IL11RA; IL12A; IL12B; IL12RB1; IL13; IL13RA1; IL13RA2; IL15; IL15RA; IL16; IL17A; IL17B; IL17C; IL170; IL17F; IL17RA; IL17RB; IL17RC; IL17RD; IL17RE; IL17REL; IL18BP; IL18; IL18R1; IL18RAP; IL19; IL1A; IL1B; IL1F10; IL1R1; IL1R2; IL1RAP; IL1RAPL1; IL1RAPL2; IL1RL1; IL1RL2; IL1RN; IL20; IL20RA; IL20RB; IL21; IL21R; IL22; IL22RA2; IL23A; IL23R; IL24; IL25; IL26; IL27; IL27RA; IL2; IL2RA; IL2RB; IL2RG; IL31; IL31RA; IL32; IL33; IL34; IL36A; IL36B; IL36G; IL36RN; IL37; IL3; IL3RA; IL4; IL4I1; IL4R; ILS; IL5RA; IL6; IL6R; IL6ST; IL7; IL7R; IL9; IL9R; ILDR1; ILDR2; ILF2; ILF3; ILK; IMMP1L; IMMP2L; IMMT; IMP3; IMPA1; IMPA2; IMPACT; IMPAD1; IMPDH1; IMPDH2; IMPG1; IMPG2; INADL; INA; INCENP; INF2; ING1; ING2; ING3; ING4; ING5; INHA; INHBA; INHBB; INHBC; INHBE; INO80B; INO80D; INO80; INPP1; INPP4A; INPP4B; INPP5A; INPP5B; INPP5D; INPP5E; INPP5F; INPP5K; INPPL1; INSC; INS; INSIG1; INSIG2; INS-IGF2; INSL3; INSL4; INSL6; INSM1; INSM2; INSR; INSRR; INTS12; INTS1; INTS2; INTS3; INTS4; INTS5; INTS6; INTS7; INTS8; INTU; INVS; IP6K1; IP6K2; IP6K3; IPCEF1; IPMK; IP011; IP013; IP07; IP08; IP09; IQCB1; IQCG; IQCH; IQCJ; IQCJ-SCHIP1; IQCK; IQGAP1; IQGAP2; IQGAP3; IQSEC1; IQSEC2; IQSEC3; IRAK1BP1; IRAK1; IRAK2; IRAK3; IRAK4; IREB2; IRF1; IRF2BP2; IRF2BPL; IRF2; IRF3; IRF4; IRF5; IRF6; IRF7; IRF8; IRF9; IRG1; IRGM; IRS1; IRS2; IRS4; IRX1; IRX2; IRX3; IRX4; IRX5; ISCU; ISG20; ISL1; ISM1; ISM2; ISPD; IST1; ISX; ISYNA1; ITCH; ITFG1; ITFG3; ITGA10; ITGA11; ITGA1; ITGA2B; ITGA2; ITGA3; ITGA4; ITGA5; ITGA6; ITGA7; ITGA8; ITGA9; ITGAD; ITGAE; ITGAL; ITGAM; ITGAV; ITGAX; ITGB1BP1; ITGB1; ITGB2; ITGB3; ITGB4; ITGB5; ITGB6; ITGB7; ITGB8; ITGBL1; ITIH1; ITIH2; ITIH3; ITIH4; ITIH5; ITK; ITLN1; ITLN2; ITM2A; ITM2B; ITM2C; ITPA; ITPK1; ITPKA; ITPKC; ITPR1; ITPR2; ITPR3; ITSN1; ITSN2; IVD; IVL; IVNS1ABP; IYD; IZUMO1; JADE1; JADE2; JAG1; JAG2; JAGN1; JAK2; JAK3; JAKMIP1; JAKMIP2; JAKMIP3; JAM2; JAM3; JARID2; JAZF1; JDP2; JMJD1C; JMJD6; JMY; JPH2; JPH3; JPH4; JRK; JSRP1; JTB; JUNB; JUND; JUP; KAL1; KALRN; KANK1; KANK2; KANK4; KANSL1; KANSL3; KARS; KAT2A; KAT2B; KAT5; KAT6A; KAT6B; KAT7; KATE; KATNA1; KATNAL2; KATNB1; KAZALD1; KAZN; KBTBD11; KBTBD13; KBTBD8; KCMF1; KCNA1; KCNA4; KCNA5; KCNA6; KCNA7; KCNAB1; KCNAB2; KCNAB3; KCNB1; KCNB2; KCNC1; KCNC2; KCNC3; KCND2; KCNE1; KCNE2; KCNE3; KCNE4; KCNE5; KCNG3; KCNG4; KCNH1; KCNH2; KCNH3; KCNH4; KCNH5; KCNH6; KCNH7; KCNH8; KCNIP1; KCNIP2; KCNIP3; KCNIP4; KCNJ10; KCNJ11; KCNJ12; KCNJ13; KCNJ14; KCNJ15; KCNJ16; KCNJ18; KCNJ1; KCNJ2; KCNJ3; KCNJ4; KCNJ5; KCNJ6; KCNJ8; KCNJ9; KCNK10; KCNK12; KCNK16; KCNK17; KCNK18; KCNK1; KCNK2; KCNK3; KCNK5; KCNK6; KCNK9; KCNMA1; KCNMB1; KCNMB2; KCNMB3; KCNMB4; KCNN1; KCNN2; KCNN3; KCNN4; KCNQ1; KCNQ2; KCNQ3; KCNQ5; KCNRG; KCNS1; KCNS3; KCNT1; KCNT2; KCNU1; KCNV1; KCNV2; KCTD10; KCTD11; KCTD12; KCTD13; KCTD15; KCTD16; KCTD1; KCTD21; KCTD2; KCTD3; KCTD6; KCTD7; KCTD9; KDELC1; KDELR1; KDM2A; KDM2B; KDM3A; KDM3B; KDM4B; KDM4C; KDM5A; KDM5B; KDM5C; KDM50; KDM6A; KDM6B; KDR; KDSR; KEAP1; KEL; KERA; KHDC3L; KHDRBS2; KHDRBS3; KHK; KHSRP; KIAA0020; KIAA0040; KIAA0100; KIAA0101; KIAA0196; KIAA0226; KIAA0226L; KIAA0232; KIAA0319; KIAA0319L; KIAA0355; KIAA0391; KIAA0586; KIAA0825; KIAA0907; KIAA0922; KIAA1024; KIAA1033; KIAA1109; KIAA1147; KIAA1161; KIAA1211; KIAA1211L; KIAA1217; KIAA1279; KIAA1324; KIAA1324L; KIAA1377; KIAA1456; KIAA1462; KIAA1468; KIAA1524; KIAA1549; KIAA1551; KIAA1598; KIAA1715; KIAA1804; KIAA1841; KIAA1919; KIAA2022; KIDINS220; KIF11; KIF13A; KIF14; KIF15; KIF16B; KIF17; KIF18A; KIF1A; KIF1C; KIF20A; KIF20B; KIF21A; KIF21B; KIF22; KIF23; KIF24; KIF25; KIF26A; KIF26B; KIF2A; KIF2B; KIF2C; KIF3A; KIF3B; KIF3C; KIF4A; KIF4B; KIF5A; KIF5B; KIF5C; KIF6; KIF7; KIF9; KIFAP3; KIFC1; KIFC3; KIN; KIR2DL1; KIR2DL2; KIR2DL3; KIR2DL4; KIR2DL5A; KIR2DL5B; KIR2DS1; KIR2DS2; KIR2DS3; KIR2DS4; KIR3DL1; KIR3DL2; KIR3DL3; KIRREL2; KIRREL3; KIRREL; KISS1; KISS1R; KIT; KITLG; KLB; KLC1; KLF10; KLF11; KLF12; KLF13; KLF14; KLF15; KLF16; KLF1; KLF2; KLF3; KLF4; KLF5; KLF6; KLF7; KLF8; KLF9; KLHDC1; KLHDC2; KLHDC8A; KLHDC8B; KLHL10; KLHL12; KLHL1; KLHL20; KLHL25; KLHL26; KLHL29; KLHL2; KLHL31; KLHL35; KLHL3; KLHL40; KLHL41; KLHL42; KLHL5; KLHL6; KLHL7; KLHL9; KL; KLK10; KLK11; KLK12; KLK13; KLK14; KLK15; KLK1; KLK2; KLK3; KLK4; KLK5; KLK6; KLK7; KLK8; KLK9; KLKB1; KLLN; KLRB1; KLRC1; KLRC2; KLRC4; KLRC4-KLRK1; KLRD1; KLRG1; KLRG2; KMO; KMT2A; KMT2B; KMT2C; KMT2D; KMT2E; KNG1; KNSTRN; KNTC1; KPNA1; KPNA2; KPNA3; KPNA4; KPNA6; KPNA7; KPNB1; KPRP; KPTN; KRAS; KRBOX4; KREMEN1; KRIT1; KRT10; KRT12; KRT13; KRT14; KRT15; KRT16; KRT17; KRT18; KRT19; KRT1; KRT20; KRT23; KRT2; KRT31; KRT32; KRT34; KRT35; KRT3; KRT4; KRT5; KRT6A; KRT6B; KRT6C; KRT71; KRT72; KRT74; KRT75; KRT76; KRT78; KRT7; KRT80; KRT81; KRT82; KRT83; KRT85; KRT86; KRT8; KRT9; KRTAP11-1; KRTAP5-1; KRTAP5-9; KSR1; KSR2; KTN1; KYNU; L1CAM; L2HGDH; L3MBTL1; L3MBTL2; L3MBTL3; L3MBTL4; LACC1; LACE1; LACRT; LACTB; LAD1; LAG3; LAIR1; LAIR2; LALBA; LAMA1; LAMA2; LAMA3; LAMA4; LAMAS; LAMB1; LAMB2; LAMB3; LAMB4; LAMC1; LAMC2; LAMC3; LAMP1; LAMP2; LAMP3; LAMTOR1; LAMTOR2; LAMTOR3; LANCL1; LANCL2; LAP3; LAPTM4B; LARGE; LARP1; LARP4; LARP6; LARP7; LARS2; LARS; LAS1L; LASP1; LAT2; LAT; LATS1; LATS2; LAX1; LAYN; LBH; LBP; LBR; LBX1; LBX2; LCA5; LCAT; LCE1C; LCE3A; LCE3B; LCE3C; LCE30; LCE3E; LCE5A; LCK; LCLAT1; LCMT1; LCN1; LCN2; LCOR; LCP1; LCP2; LCT; LDB1;

LDB2; LDB3; LDHA; LDHAL6B; LDHB; LDHC; LDHD; LDLRAD3; LDLRAD4; LDLR; LDOC1; LDOC1L; LEAP2; LECT1; LECT2; LEF1; LEFTY1; LEFTY2; LEKR1; LEMD2; LEMD3; LE01; LEP; LEPROTL1; LETM1; LETMD1; LEUTX; LFNG; LGALS12; LGALS13; LGALS14; LGALS16; LGALS1; LGALS2; LGALS3BP; LGALS3; LGALS4; LGALS7B; LGALS8; LGALS9; LGALSL; LGI1; LGI2; LGI4; LGMN; LGR4; LGR5; LGR6; LGSN; LHB; LHCGR; LHFP; LHFPL1; LHFPL2; LHFPL3; LHFPL4; LHFPL5; LHPP; LHX1; LHX2; LHX3; LHX4; LHX5; LHX6; LHX9; LIAS; LIF; LIFR; LIG1; LIG3; LIG4; LILRA1; LILRA2; LILRA3; LILRA4; LILRA5; LILRB1; LILRB2; LILRB3; LILRB4; LILRB5; LIM2; LIMA1; LIMCH1; LIMD1; LIMD2; LIMK1; LIMK2; LIMS1; LIMS2; LIN28B; LIN52; LIN7A; LIN7B; LIN7C; LIN9; LINGO1; LINGO2; LINGO4; LINS; LIPA; LIPC; LIPE; LIPF; LIPG; LIPH; LIPI; LIPN; LIPT1; LIPT2; LITAF; LIX1; LLGL1; LLGL2; LMAN1; LMAN1L; LMAN2L; LMBR1; LMBRD1; LMBRD2; LMCD1; LMF1; LMLN; LMNA; LMNB1; LMNB2; LMNTD1; LMO1; LMO2; LMO3; LMO7; LMOD1; LMOD3; LMTK2; LMTK3; LMX1A; LMX1B; LNPEP; LNX1; LNX2; LOC100288966; LOC101060321; LOC102723475; LOC102723996; LOC102724127; LOC102724560; LOC102724770; LOC102725016; LOC102725035; LOC400499; LOC400927-CSNK1E; LOC645177; LONP1; LONRF1; LOR; LOXHD1; LOX; LOXL1; LOXL2; LOXL3; LOXL4; LPA; LPAR1; LPAR2; LPAR3; LPAR6; LPCAT1; LPCAT2; LPCAT3; LPCAT4; LPGAT1; LPIN1; LPIN2; LPL; LPO; LPP; LPPR2; LPPR4; LPXN; LRAT; LRBA; LRCH1; LRCH4; LRFN2; LRFN5; LRG1; LRGUK; LRIF1; LRIG1; LRIG3; LRIT1; LRIT3; LRMP; LRP10; LRP12; LRP1B; LRP1; LRP2BP; LRP2; LRP4; LRP5; LRP6; LRPAP1; LRPPRC; LRR1; LRRC15; LRRC16A; LRRC16B; LRRC17; LRRC18; LRRC1; LRRC20; LRRC26; LRRC30; LRRC32; LRRC37A; LRRC37B; LRRC39; LRRC49; LRRC4B; LRRC4C; LRRC4; LRRC52; LRRC59; LRRC61; LRRC63; LRRC69; LRRC6; LRRC74A; LRRC7; LRRC8A; LRRC8C; LRRCC1; LRRFIP1; LRRFIP2; LRRK1; LRRK2; LRRN1; LRRN2; LRRN3; LRRN4; LRRTM1; LRRTM2; LRRTM3; LRRTM4; LRSAM1; LRTM1; LRTOMT; LSAMP; LSM11; LSM1; LSM2; LSM3; LSM4; LSM5; LSM6; LSM7; LSP1; LSR; LSS; LST1; LTA4H; LTA; LTB4R2; LTB4R; LTB; LTBP1; LTBP2; LTBP3; LTBP4; LTBR; LTC4S; LTF; LTK; LUC7L3; LUC7L; LUM; LURAP1L; LUZP4; LUZP6; LVRN; LXN; LY6D; LY6E; LY6G5B; LY6G5C; LY6G6C; LY6G6F; LY6K; LY75-CD302; LY75; LY86; LY96; LY9; LYL1; LYN; LYNX1; LYPD1; LYPD2; LYPD3; LYPD4; LYPD5; LYPD6; LYPD8; LYPLA1; LYPLAL1; LYRM1; LYRM4; LYRM7; LYRM9; LYST; LYVE1; LYZ; LYZL1; LYZL2; LYZL6; LZTFL1; LZTR1; LZTS1; M6PR; MAATS1; MAB21L1; MAB21L2; MAB21L3; MACC1; MACROD1; MACROD2; MAD1L1; MAD2L1BP; MAD2L1; MAD2L2; MADCAM1; MADD; MAEA; MAEL; MAF1; MAFA; MAFB; MAFF; MAFG; MAF; MAFK; MAGEA10; MAGEA11; MAGEA12; MAGEA1; MAGEA2B; MAGEA3; MAGEA4; MAGEA6; MAGEA9; MAGEB17; MAGEB1; MAGEB2; MAGEB6; MAGEC1; MAGEC2; MAGEC3; MAGED1; MAGED2; MAGED4B; MAGED4; MAGEE1; MAGEH1; MAGEL2; MAG; MAGI1; MAGI2; MAGI3; MAGT1; MAK16; MAK; MAL; MALL; MALRD1; MALT1; MAML1; MAML2; MAML3; MAMLD1; MAN1A1; MAN1B1; MAN2A1; MAN2A2; MAN2B1; MAN2C1; MANBA; MANEA; MANF; MANSC1; MAOA; MAOB; MAP10; MAP1A; MAP1B; MAP1LC3A; MAP1LC3B2; MAP1LC3B; MAP1S; MAP2; MAP2K1; MAP2K2; MAP2K3; MAP2K4; MAP2K5; MAP2K6; MAP2K7; MAP3K10; MAP3K11; MAP3K12; MAP3K13; MAP3K14; MAP3K19; MAP3K1; MAP3K2; MAP3K3; MAP3K4; MAP3K5; MAP3K6; MAP3K7CL; MAP3K7; MAP3K8; MAP3K9; MAP4; MAP4K1; MAP4K2; MAP4K3; MAP4K4; MAP4K5; MAP6; MAP7; MAPS; MAPK10; MAPK11; MAPK12; MAPK13; MAPK14; MAPK15; MAPK1; MAPK3; MAPK6; MAPK7; MAPK8; MAPK8IP1; MAPK8IP2; MAPK8IP3; MAPK9; MAPKAP1; MAPKAPK2; MAPKAPK3; MAPKBP1; MAPRE1; MAPRE2; MAPRE3; MAPT; MARC1; MARC2; MARCH1; MARCH2; MARCH5; MARCH6; MARCH7; MARCH8; MARCKS; MARCO; MARK1; MARK2; MARK3; MARK4; MARS2; MARS; MARVELD1; MARVELD2; MARVELD3; MAST; MASTL; MASP1; MAST2; MAST4; MASTL; MAT1A; MAT2A; MAT2B; MATK; MATN2; MATN3; MATR3; MAU2; MAVS; MAX; MAZ; MB21D1; MB21D2; MBD1; MBD2; MBD3; MBD3L2; MBD4; MBD5; MBD6; MB; MBIP; MBL2; MBNL1; MBNL2; MBOAT1; MBOAT2; MBOAT4; MBP; MBTD1; MBTPS1; MBTPS2; MC1R; MC2R; MC3R; MC4R; MC5R; MCAM; MCAT; MCCC1; MCCC2; MCCD1; MCC; MCEE; MCF2; MCF2L2; MCF2L; MCFD2; MCHR1; MCHR2; MCIDAS; MCM10; MCM2; MCM3AP; MCM3; MCM4; MCM5; MCM6; MCMI; MCM8; MCM9; MCMBP; MCOLN1; MCOLN3; MCPH1; MCRS1; MCTP1; MCTP2; MCTS1; MCU; MCUR1; MDC1; MDFIC; MDFI; MDGA1; MDGA2; MDH1; MDH2; MDK; MDM1; MDM2; MDM4; ME1; ME2; ME3; MEA1; MECOM; MECP2; MED12; MED12L; MED13; MED13L; MED14; MED15; MED16; MED17; MED19; MEDT; MED22; MED23; MED24; MED25; MED28; MED29; MED30; MED4; MED6; MEDS; MEF2A; MEF2B; MEF2BNB-MEF2B; MEF2C; MEF2D; MEFV; MEGF10; MEGF11; MEGF8; MEGF9; MEI1; MEIS1; MEIS2; MELK; MEMO1; MEN1; MEOX1; MEOX2; MEP1A; MEPE; MERTK; MESDC1; MESDC2; MESP2; MEST; METAP1D; METAP1; METAP2; MET; METRN; METTL13; METTL16; METTL17; METTL18; METTL1; METTL21A; METTL21B; METTL21C; METTL24; METTL6; METTL7A; METTL9; MEX3B; MEX3C; MEX3D; MFAP3; MFAP4; MFAP5; MFGE8; MFHAS1; MFI2; MFN1; MFRP; MFSD11; MFSD12; MFSD1; MFSD6; MFSD7; MFSD8; MGA; MGAM; MGARP; MGAT1; MGAT2; MGAT3; MGAT4A; MGAT4B; MGAT4C; MGAT5B; MGAT5; MGEA5; MGLL; MGME1; MGMT; MGP; MGRN1; MGST1; MGST2; MGST3; MIA2; MIA3; MIA; MIB1; MIB2; MICA; MICAL2; MICALCL; MICB; MICU1; MICU3; MID1; MID2; MIEN1; MIER2; MIER3; MIF; MILR1; MINA; MINK1; MINPP1; MIOX; MIPEP; MIP; MIPOL1; MIR1-1HG; MIS18BP1; MITF; MIXL1; MKI67; MKKS; MKL1; MKL2; MKLN1; MKNK1; MKNK2; MKRN1; MKRN3; MKS1; MLANA; MLC1; MLEC; MLF1; MLF2; MLH1; MLH3; MLKL; MLLT10; MLLT1; MLLT3; MLLT4; MLLT6; MLN; MLNR; MLPH; MLST8; MLX; MLXIP; MLXIPL; MLYCD; MMAA; MMAB; MMADHC; MMD2; MMD; MME; MMEL1; MMP10; MMP11; MMP12; MMP13; MMP14; MMP15; MMP16; MMP17; MMP19; MMPI; MMP20; MMP21; MMP24; MMP25; MMP26; MMP28; MMP2; MMP3; MMPI; MMP8; MMP9; MMRN1; MMRN2; MMS19; MMS22L; MN1; MNAT1; MNDA; MNS1; MNT; MNX1; MOAP1; MOB1A; MOB1B; MOB2; MOB3B; MOB4; MOBP; MOCOS; MOCS1; MOCS2; MOGAT1; MOGAT2; MOGAT3; MOG; MOGS; MOK; MON1A; MON1B;

MON2; MORC3; MORF4L1; MORN1; MORN2; MORNS; MOS; MOV10L1; MPC1; MPC2; MPDU1; MPDZ; MPEG1; MPG; MPHOSPH10; MPHOSPH6; MPHOSPH8; MPHOSPH9; MPI; MPLKIP; MPO; MPP1; MPP2; MPP3; MPP5; MPP7; MPPE1; MPPED2; MPRIP; MPST; MPV17; MPV17L2; MPZ; MPZL1; MPZL2; MPZL3; MR1; MRAP2; MRAP; MRAS; MRC1; MRC2; MRE11A; MREG; MRFAP1; MRGBP; MRGPRF; MRGPRX1; MRGPRX3; MRGPRX4; MRI1; MRM1; MROH2B; MRO; MRPL10; MRPL11; MRPL13; MRPL15; MRPL17; MRPL19; MRPL1; MRPL23; MRPL28; MRPL33; MRPL36; MRPL3; MRPL40; MRPL41; MRPL44; MRPL49; MRPL52; MRPL9; MRPS11; MRPS12; MRPS16; MRPS18B; MRPS22; MRPS23; MRPS28; MRPS30; MRPS31; MRPS33; MRPS6; MRPS7; MRPS9; MRRF; MRS2; MRVI1; MS4A12; MS4A1; MS4A2; MS4A3; MS4A4A; MS4A6A; MS4A8; MSANTD3-TMEFF1; MSC; MSGN1; MSH2; MSH3; MSHS; MSH6; MSI1; MSI2; MSLN; MSMB; MSMO1; MSMP; MSN; MSR1; MSRA; MSRB2; MSRB3; MST1; MST1R; MSTN; MSTO1; MSX1; MSX2; MT1A; MT1B; MT1E; MT1F; MT1G; MT1H; MT1M; MT1X; MT2A; MT3; MT4; MTA1; MTA2; MTA3; MTAP; MTBP; MTCH1; MTCH2; MTCL1; MTCP1; MTDH; MTERF1; MTF1; MTFMT; MTFP1; MTG1; MTHFD1; MTHFD1L; MTHFD2; MTHFR; MTHFS; MTIF2; MTIF3; MTL5; MTM1; MTMR11; MTMR12; MTMR14; MTMR1; MTMR2; MTMR3; MTMR4; MTMR6; MTMR7; MTMR8; MTMR9; MTNR1A; MTNR1B; MT01; MTPAP; MTPN; MTRF1; MTR; MTRNR2L7; MTRR; MTSS1; MTTP; MTURN; MTUS1; MTUS2; MTX1; MTX2; MUC12; MUC13; MUC15; MUC17; MUC19; MUC1; MUC20; MUC21; MUC22; MUC2; MUC3A; MUC4; MUC5AC; MUC5B; MUC6; MUC7; MUCL1; MUM1; MURC; MUS81; MUSK; MUT; MUTYH; MVB12B; MVD; MVK; MVP; MX1; MX2; MXD1; MXD3; MXD4; MXI1; MXRA5; MYADM; MYBBP1A; MYB; MYBL1; MYBL2; MYBPC1; MYBPC2; MYBPC3; MYBPH; MYCBP2; MYCBPAP; MYC; MYCN; MYCT1; MYD88; MYDGF; MYEF2; MYEOV; MYF5; MYF6; MYH10; MYH11; MYH13; MYH14; MYH15; MYH1; MYH2; MYH3; MYH4; MYH6; MYH7B; MYH7; MYH8; MYH9; MYL12A; MYL12B; MYL1; MYL2; MYL3; MYL4; MYL6; MYL7; MYL9; MYLIP; MYLK2; MYLK3; MYLK; MYLPF; MYNN; MYO10; MYO15A; MYO16; MYO18B; MYO1A; MYO1B; MYO1C; MYOCD; MYO1E; MYO1F; MYO3A; MYO3B; MYO5A; MYO5B; MYO5C; MYO6; MYO7A; MYO7B; MYO9A; MYO9B; MYOCD; MYOC; MYOD1; MYOF; MYOG; MYOM1; MYOM2; MYOT; MYOZ1; MYOZ2; MYOZ3; MYPN; MYRF; MYRFL; MYRIP; MYT1; MYT1L; MYZAP; MZB1; MZF1; N4BP1; N4BP2L1; N4BP2L2; NAA10; NAA15; NAA16; NAA20; NAA25; NAA30; NAA35; NAA40; NAA50; NAA60; NAAA; NAALAD2; NAALADL1; NAALADL2; NAB1; NAB2; NABP1; NABP2; NACA; NACC1; NACC2; NADSYN1; NAE1; NAF1; NAGA; NAGK; NAGLU; NAGPA; NAGS; NAIP; NALCN; NAMPT; NANOG; NANOS1; NANOS2; NANOS3; NANS; NAP1L1; NAP1L3; NAP1L4; NAP1L5; NAPA; NAPEPLD; NAPG; NAPRT; NAPSA; NARFL; NARR; NARS; NAT10; NAT14; NAT1; NAT2; NAT6; NAT8B; NAT8; NAT8L; NAV1; NAV2; NAV3; NBAS; NBEA; NBEAL1; NBEAL2; NBN; NBPF3; NBR1; NCALD; NCEAL1; NCAM1; NCAM2; NCAPD2; NCAPD3; NCAPG2; NCAPG; NCBP2; NCEH1; NCF1; NCF2; NCF4; NCK1; NCK2; NCKAP1; NCKAP1L; NCKAP5; NCKIPSD; NCL; NCOA1; NCOA2; NCOA3; NCOA4; NCOA5; NCOA6; NCOA7; NCOR1; NCOR2; NCR1; NCR2; NCR3; NCR3LG1; NCS1; NCSTN; NDC80; NDE1; NDEL1; NDFIP1; NDFIP2; NDNF; NDN; NDP; NDRG1; NDRG2; NDRG3; NDRG4; NDST1; NDST2; NDST3; NDST4; NDUFA10; NDUFA11; NDUFA12; NDUFA13; NDUFA1; NDUFA2; NDUFA5; NDUFA6; NDUFA9; NDUFAB1; NDUFAF1; NDUFAF2; NDUFAF3; NDUFAF4; NDUFAF5; NDUFAF6; NDUFB10; NDUFB11; NDUFB2; NDUFB3; NDUFB4; NDUFB5; NDUFB6; NDUFB8; NDUFB9; NDUFC2; NDUFS1; NDUFS2; NDUFS3; NDUFS4; NDUFS6; NDUFS7; NDUFS8; NDUFV1; NDUFV2; NDUFV3; NEB; NEBL; NECAB1; NECAB3; NECAP1; NEDD1; NEDD4; NEDD4L; NEDD8; NEDD9; NEFH; NEFM; NEIL1; NEIL2; NEIL3; NEK10; NEK11; NEK1; NEK2; NEK3; NEK4; NEK6; NEK7; NEK8; NEK9; NELFA; NELFB; NELFCD; NELFE; NELL1; NELL2; NEMF; NE01; NES; NETT; NET01; NETO2; NEU1; NEU3; NEURL1; NEURL2; NEUROD1; NEUROD2; NEUROD4; NEUROD6; NEUROG1; NEUROG2; NEUROG3; NF1; NF2; NFAM1; NFASC; NFAT5; NFATC1; NFATC2; NFATC3; NFATC4; NFE2; NFE2L1; NFE2L2; NFE2L3; NFIA; NFIB; NFIC; NFIL3; NFIX; NFKB1; NFKB2; NFKBIA; NFKBIB; NFKBIE; NFKBIL1; NFKBIZ; NFRKB; NFS1; NFU1; NFYA; NFYB; NFYC; NGB; NGDN; NGEF; NGF; NGFRAP1; NGFR; NGLY1; NHEJ1; NHLH1; NHLRC1; NHLRC3; NHP2; NHP2L1; NHS; NHSL1; NICN1; NID1; NID2; NIF3L1; NIM1K; NIN; NINJ1; NINJ2; NINL; NIPA1; NIPA2; NIPAL3; NIPAL4; NIPBL; NIPSNAP1; NIPSNAP3B; NISCH; NIT1; NIT2; NKAIN2; NKAIN3; NKAP; NKD1; NKD2; NKG7; NKIRAS1; NKIRAS2; NKRF; NKTR; NKX1-1; NKX1-2; NKX2-1; NKX2-2; NKX2-3; NKX2-5; NKX2-6; NKX2-8; NKX3-1; NKX6-1; NKX6-2; NLE1; NLGN1; NLGN2; NLGN3; NLGN4X; NLGN4Y; NLK; NLN; NLRC3; NLRC4; NLRC5; NLRP10; NLRP11; NLRP12; NLRP13; NLRP14; NLRP1; NLRP2; NLRP3; NLRP4; NLRP5; NLRP6; NLRP7; NLRP8; NLRP9; NMB; NMBR; NME1; NME1-NME2; NME2; NME3; NME4; NME5; NME6; NME7; NME8; NME9; NMI; NMNAT1; NMNAT2; NMNAT3; NMS; NMT1; NMT2; NMU; NMUR1; NMUR2; NNAT; NNMT; NNT; NOA1; NOB1; NOBOX; NOC3L; NOD1; NOD2; NODAL; NOG; NOL11; NOL3; NOL4; NOL6; NOL8; NOLC1; NOMI; NOMO1; NONO; NOP10; NOP14; NOP16; NOP2; NOP56; NOP9; NOS1AP; NOS1; NOS2; NOS3; NOSIP; NOSTRIN; NOTCH1; NOTCH2; NOTCH3; NOTCH4; NOTUM; NOVA1; NOVA2; NOV; NOX1; NOX3; NOX4; NOX5; NOXA1; NOXO1; NPAP1; NPAS2; NPAS3; NPAS4; NPAT; NPB; NPBWR1; NPC1; NPC1L1; NPC2; NPDC1; NPEPL1; NPEPPS; NPFF; NPFFR2; NPHP1; NPHP3; NPHP4; NPHS1; NPHS2; NPL; NPLOC4; NPM1; NPM2; NPNT; NPPC; NPR1; NPR2; NPR3; NPRL2; NPRL3; NPS; NPSR1; NPTN; NPTX1; NPTX2; NPTXR; NPVF; NPW; NPY1R; NPY2R; NPY5R; NPY; NQO1; NQO2; NROB1; NR101; NR102; NR1H2; NR1H3; NR1H4; NR1I2; NR1I3; NR2C1; NR2C2; NR2E1; NR2E3; NR2F1; NR2F2; NR2F6; NR3C1; NR3C2; NR4A1; NR4A2; NR4A3; NR5A1; NR5A2; NR6A1; NRAP; NRARP; NRBP1; NRBP2; NRCAM; NRD1; NRDE2; NREP; NRF1; NRG1; NRG2; NRG3; NRG4; NRGN; NRIP1; NRIP2; NRK; NRL; NRM; NRN1; NRP1; NRP2; NRSN1; NRSN2; NRTN; NRXN1; NRXN2; NRXN3; NSA2; NSD1; NSDHL; NSF; NSFL1C; NSG1; NSMAF; NSMCE2; NSMF; NSRP1; NSUN2; NSUN3; NSUN5; NSUN7; NT5C1B; NT5C1B-RDH14; NT5C2; NT5C3A; NT5C; NT5DC1; NT5DC3; NT5E; NT5M; NTAN1; NTF3; NTF4; NTHL1; NTM; NTN1; NTN4;

NTNG1; NTNG2; NTPCR; NTRK1; NTRK2; NTRK3; NTS; NTSR1; NTSR2; NUAK1; NUAK2; NUB1; NUBP1; NUBP2; NUBPL; NUCB1; NUCB2; NUCKS1; NUDCD1; NUDCD3; NUDC; NUDT10; NUDT11; NUDT15; NUDT19; NUDT1; NUDT21; NUDT2; NUDT3; NUDT6; NUDT7; NUF2; NUFIP1; NUFIP2; NUGGC; NUMA1; NUMB; NUMBL; NUP153; NUP155; NUP205; NUP210; NUP214; NUP35; NUP37; NUP43; NUP50; NUP62; NUP85; NUP88; NUP93; NUP98; NUPL2; NUPR1; NUS1; NUSAP1; NUTF2; NUTM1; NUTM2A; NUTM2B; NVL; NWD1; NXF1; NXF2B; NXF3; NXF5; NXN; NXNL1; NXNL2; NXPE1; NXPE2; NXPE4; NXPH1; NXPH2; NXT1; NXT2; NYAP2; NYX; OARD1; OAS1; OAS2; OAS3; OASL; OAT; OAZ1; OAZ2; OBFC1; OBP2A; OBSCN; OBSL1; OC90; OCA2; OCIAD1; OCIAD2; OCLM; OCLN; OCM2; OCM; OCRL; ODAM; ODC1; ODF1; ODF3B; ODF4; OFCC1; OFD1; OGDH; OGDHL; OGFOD1; OGFR; OGG1; OGN; OGT; OIP5; OIT3; OLA1; OLFM1; OLFM2; OLFM4; OLFML2B; OLIG1; OLIG2; OLIG3; OLR1; OMD; OMG; OMP; ONECUT1; ONECUT2; OPA1; OPA3; OPCML; OPHN1; OPN1LW; OPN1MW2; OPN1SW; OPN3; OPN4; OPN5; OPRK1; OPRL1; OPRM1; OPTC; OPTN; OR10A2; OR10A4; OR10C1; OR10J1; OR10J3; OR10J5; OR10K1; OR10K2; OR10R2; OR10T2; OR10X1; OR10Z1; OR11A1; OR12D2; OR12D3; OR13C3; OR13C4; OR13F1; OR13G1; OR13J1; OR14J1; OR1A1; OR1C1; OR1D2; OR1E1; OR1E2; OR1J2; OR1K1; OR1L8; OR1M1; OR1N1; OR1N2; OR2A25; OR2AG1; OR2AK2; OR2AT4; OR2B2; OR2B3; OR2B6; OR2C1; OR2F2; OR2G2; OR2G3; OR2H2; OR2J2; OR2J3; OR2L2; OR2M3; OR2M4; OR2M7; OR2S2; OR2T10; OR2T12; OR2T1; OR2T2; OR2T33; OR2T4; OR2T5; OR2W1; OR2Y1; OR2Z1; OR3A1; OR4A15; OR4C12; OR4C13; OR4C6; OR4D10; OR4K13; OR4P4; OR4S2; OR51A2; OR51A7; OR51E1; OR51E2; OR51F2; OR51V1; OR52B2; OR52B4; OR52D1; OR52E6; OR5211; OR5212; OR52K1; OR52K2; OR52M1; OR5D18; OR5H2; OR5H6; OR5K1; OR5K2; OR5V1; OR6B1; OR6B2; OR6C1; OR6F1; OR6K2; OR6K3; OR6K6; OR6N1; OR6N2; OR6X1; OR6Y1; OR7C1; OR7D2; OR7E24; OR8S1; OR9K2; OR9Q2; ORAI1; ORAI3; ORAOV1; ORC2; ORC3; ORC4; ORC5; ORC6; ORM1; ORM2; ORMDL3; OS9; OSBP2; OSBP; OSBPL10; OSBPL11; OSBPL1A; OSBPL2; OSBPL3; OSBPL5; OSBPL6; OSBPL8; OSBPL9; OSCAR; OSER1; OSGEP; OSGIN1; OSM; OSMR; OSR1; OSR2; OSTF1; OSTM1; OTC; OTOA; OTOF; OTOG; OTOGL; OTOL1; OTOP1; OTOR; OTP; OTUB1; OTUD1; OTUD4; OTUD7A; OTUD7B; OTULIN; OTX1; OTX2; OVCA2; OVOL1; OVOL2; OXA1L; OXCT1; OXER1; OXGR1; OXR1; OXSR1; OXT; OXTR; P2RX1; P2RX2; P2RX3; P2RX4; P2RX5; P2RX6; P2RX7; P2RY11; P2RY12; P2RY13; P2RY14; P2RY1; P2RY2; P2RY4; P2RY6; P2RY8; P3H2; P3H3; P3H4; P4HA1; P4HA2; P4HB; P4HTM; PA2G4; PABPC1; PABPC3; PABPC4L; PABPN1; PACRG; PACS1; PACS2; PACSIN1; PACSIN2; PADI4; PAEP; PAF1; PAFAH1B1; PAFAH1B2; PAFAH2; PAG1; PAGE1; PAGE4; PAGE5; PAGR1; PAH; PAICS; PAIP1; PAIP2; PAK1; PAK1IP1; PAK2; PAK3; PAK4; PAK6; PAK7; PALB2; PALD1; PALLD; PALM2-AKAP2; PAM16; PAM; PAMR1; PAN2; PAN3; PANK1; PANK2; PANX1; PANX2; PAOX; PAPD7; PAPL; PAPOLA; PAPOLG; PAPPA2; PAPPA; PAPSS1; PAPSS2; PAQR3; PAQR5; PAQR7; PARD3B; PARD3; PARD6A; PARD6B; PARG; PARK2; PARL; PARM1; PARN; PARP12; PARP14; PARP15; PARP1; PARP2; PARP3; PARP4; PARP6; PARP9; PARPBP; PARS2; PARVA; PARVB; PARVG; PASD1; PASK; PATE1; PATZ1; PAWR; PAX1; PAX2; PAX3; PAX4; PAX5; PAX6; PAX8; PAX9; PAXIP1; PBK; PBLD; PBOV1; PBRM1; PBX1; PBX2; PBX3; PBX4; PCBD1; PCBD2; PCBP1; PCBP2; PCBP3; PCBP4; PCCA; PCCB; PCDH10; PCDH11X; PCDH11Y; PCDH15; PCDH17; PCDH18; PCDH19; PCDH1; PCDH20; PCDH7; PCDH8; PCDH9; PCDHA1; PCDHA4; PCDHA6; PCDHB1; PCDHB2; PCDHB3; PCDHB8; PCDHGA11; PCDHGA3; PCDHGB4; PCDHGB6; PCDHGC3; PCED1B; PCF11; PCGF1; PCGF2; PCGF3; PCGF6; PC; PCID2; PCK1; PCK2; PCLO; PCM1; PCMT1; PCMTD1; PCNA; PCNT; PCNXL2; PCNXL4; PCOLCE2; PCOLCE; PCP2; PCP4; PCSK1; PCSK1N; PCSK2; PCSK4; PCSK5; PCSK6; PCSK7; PCTP; PCYT1A; PCYT1B; PDAP1; PDCD10; PDCD1; PDCD1LG2; PDCD2; PDCD4; PDCD5; PDCD6; PDCD6IP; PDCD7; PDC; PDCL2; PDCL3; PDE10A; PDE11A; PDE12; PDE1A; PDE1B; PDE1C; PDE2A; PDE3A; PDE3B; PDE4A; PDE4D; PDE5A; PDE6A; PDE6B; PDE6C; PDE6D; PDE6G; PDE6H; PDE7A; PDE7B; PDE8A; PDE8B; PDE9A; PDF; PDGFA; PDGFB; PDGFC; PDGFD; PDGFRA; PDGFRB; PDGFRL; PDHA1; PDHB; PDHX; PDIA2; PDIA3; PDIA4; PDIA5; PDIA6; PDK1; PDK2; PDK3; PDK4; PDLIM1; PDLIM2; PDLIM3; PDLIM4; PDLIM5; PDLIM7; PDP1; PDP2; PDPK1; PDPR; PDRG1; PDS5A; PDS5B; PDSS1; PDSS2; PDX1; PDXDC1; PDXK; PDXP; PDYN; PDZD2; PDZD4; PDZD7; PDZD8; PDZK1; PDZRN3; PDZRN4; PEA15; PEAK1; PEARL; PEBP1; PEBP4; PECAM1; PECR; PEG10; PEG3; PELI1; PELI2; PELP1; PEMT; PENK; PEPD; PER1; PER2; PER3; PERM1; PERP; PES1; PET100; PET117; PEX11A; PEX12; PEX13; PEX14; PEX16; PEX19; PEX1; PEX26; PEX2; PEX3; PEX5; PEX5L; PEX6; PEX7; PF4; PF4V1; PFDN4; PFDN5; PFDN6; PFKFB1; PFKFB2; PFKFB3; PFKFB4; PFKL; PFKM; PFKP; PFN1; PFN2; PGA3; PGA4; PGA5; PGAM1; PGAM2; PGAM4; PGAP1; PGAP2; PGAP3; PGBD1; PGBD5; PGC; PGD; PGF; PGGT1B; PGK1; PGK2; PGLS; PGLYRP1; PGLYRP2; PGLYRP3; PGLYRP4; PGM3; PGPEP1; PGP; PGR; PGRMC1; PGRMC2; PHACTR1; PHACTR2; PHACTR3; PHB2; PHB; PHC1; PHC2; PHC3; PHEX; PHF10; PHF11; PHF12; PHF19; PHF1; PHF20; PHF21A; PHF23; PHF2; PHF3; PHF5A; PHF6; PHF8; PHGDH; PHIP; PHKA1; PHKA2; PHKB; PHKG1; PHKG2; PHLDA1; PHLDA2; PHLDA3; PHLDB1; PHLPP1; PHLPP2; PHOX2A; PHOX2B; PHPT1; PHRF1; PHTF1; PHTF2; PHYH; PHYHIP; PHYKPL; PI15; PI16; PI3; PI4K2A; PI4K2B; PI4KA; PI4KB; PIAS1; PIAS2; PIAS4; PIBF1; PICALM; PICK1; PID1; PIDD1; PIEZO1; PIEZO2; PIF1; PIFO; PIGA; PIGF; PIGG; PIGL; PIGM; PIGN; PIGO; PIGP; PIGQ; PIGR; PIGT; PIGU; PIGW; PIGY; PIH101; PIK3AP1; PIK3C2A; PIK3C2B; PIK3C2G; PIK3C3; PIK3CA; PIK3CB; PIK3CD; PIK3CG; PIK3IP1; PIK3R1; PIK3R2; PIK3R3; PIK3R4; PIK3R5; PIKFYVE; PILRA; PIM1; PIM2; PIM3; PIN1; PIN4; PINX1; PIP4K2A; PIP4K2B; PIP4K2C; PIPSK1A; PIPSK1B; PIPSK1C; PIPSKL1; PIP; PIPDX; PIR; PISD; PITPNA; PITPNM1; PITPNM3; PITRM1; PITX1; PITX2; PITX3; PIWIL1; PIWIL2; PIWIL3; PIWIL4; PJA1; PJA2; PKD1; PKD1L1; PKD1L2; PKD1L3; PKD2; PKD2L1; PKDCC; PKDREJ; PKHD1; PKIA; PKIB; PKLR; PKM; PKMYT1; PKN1; PKN2; PKN3; PKNOX1; PKNOX2; PKP1; PKP2; PKP3; PKP4; PLAZA; PLA2G10; PLA2G12A; PLA2G12B; PLA2G15; PLA2G16; PLA2G1B; PLA2G3; PLA2G4A; PLA2G4B; PLA2G4C; PLA2G4D; PLA2G5; PLA2G6; PLA2G7; PLA2R1; PLAA; PLAC1; PLAC8; PLAG1; PLAGL1; PLAGL2; PLAT; PLAU; PLAUR; PLB1; PLBD1; PLCB1;

PLCB2; PLCB3; PLCB4; PLCD1; PLCD3; PLCD4; PLCE1; PLCG1; PLCG2; PLCH1; PLCL1; PLCL2; PLCXD2; PLCXD3; PLCZ1; PLD1; PLD2; PLD3; PLD4; PLD5; PLEC; PLEK2; PLEKHA1; PLEKHA2; PLEKHAS; PLEKHA6; PLEKHA7; PLEKHB1; PLEKHD1; PLEKHF1; PLEKHF2; PLEKHG1; PLEKHG2; PLEKHG3; PLEKHG4; PLEKHG6; PLEKHH2; PLEKHM1; PLEKHO1; PLEKHG2; PLEK; PLG; PLGLB2; PLIN1; PLIN2; PLIN3; PLIN4; PLIN5; PLK1; PLK2; PLK4; PLK5; PLLP; PLN; PLOD2; PLP1; PLP2; PLRG1; PLS1; PLS3; PLSCR1; PLSCR3; PLSCR4; PLSCR5; PLTP; PLVAP; PLXDC1; PLXDC2; PLXNA1; PLXNA2; PLXNA3; PLXNA4; PLXNB1; PLXNB3; PLXNC1; PLXND1; PM20D1; PMAIP1; PMCH; PMEL; PMEPA1; PMF1-BGLAP; PMF1; PML; PMM1; PMM2; PMP22; PMPCA; PMPCB; PMS1; PMS2; PMVK; PNCK; PNKD; PNKP; PNLDC1; PNLIP; PNLIPRP2; PNMA1; PNMA2; PNMT; PNN; PNO1; PNOC; PNP; PNPLA1; PNPLA2; PNPLA3; PNPLA4; PNPLA5; PNPLA6; PNPLA8; PNPO; PNPT1; PNRC1; POC1A; POC1B; P005; PODXL; POF1B; POFUT1; POFUT2; POGK; POGLUT1; POLA1; POLA2; POLB; POLD1; POLD2; POLD3; POLD4; POLDIP3; POLE2; POLE3; POLE4; POLE; POLG2; POLG; POLH; POLI; POLK; POLL; POLM; POLN; POLQ; POLR1A; POLR1B; POLR1C; POLR1D; POLR2A; POLR2B; POLR2C; POLR2D; POLR2E; POLR2F; POLR2G; POLR2H; POLR2J; POLR2K; POLR2M; POLR3A; POLR3B; POLR3E; POLR3K; POLRMT; POM121; POMC; POMGNT1; POMGNT2; POMK; POMP; POMT1; POMT2; POMZP3; PON1; PON2; PON3; POP1; POP4; POPDC3; PORCN; POR; POSTN; POT1; POTED; POTEF; POTEG; POTEH; POTEM; POU1F1; POU2AF1; POU2F1; POU2F2; POU2F3; POU3F2; POU3F3; POU3F4; POU4F1; POU4F2; POU4F3; POU5F1B; POU5F1; POU6F1; POU6F2; PPA1; PPA2; PPAP2A; PPAP2C; PPAPDC1B; PPAPDC2; PPAPDC3; PPARA; PPARD; PPARGC1A; PPARGC1B; PPARG; PPAT; PPBP; PPCDC; PPEF1; PPEF2; PPFIA1; PPFIA2; PPFIA4; PPFIBP1; PPFIBP2; PPIA; PPIB; PPIC; PPID; PPIF; PPIG; PPIL1; PPIL2; PPIL3; PPIP5K1; PPL; PPM1A; PPM1B; PPM1D; PPM1E; PPM1F; PPM1G; PPM1H; PPM1K; PPM1L; PPM1M; PPME1; PPDX; PPP1CA; PPP1CC; PPP1R10; PPP1R11; PPP1R12A; PPP1R12B; PPP1R12C; PPP1R13B; PPP1R13L; PPP1R14A; PPP1R14B; PPP1R14C; PPP1R15A; PPP1R15B; PPP1R17; PPP1R18; PPP1R1A; PPP1R1B; PPP1R2; PPP1R3A; PPP1R3B; PPP1R3C; PPP1R42; PPP1R7; PPP1R9A; PPP2CA; PPP2CB; PPP2R1A; PPP2R1B; PPP2R2A; PPP2R2B; PPP2R2C; PPP2R3A; PPP2R3B; PPP2R4; PPP2R5A; PPP2R5B; PPP2R5C; PPP2R5D; PPP2R5E; PPP3CA; PPP3CB; PPP3CC; PPP3R1; PPP3R2; PPP4C; PPP4R1; PPP5C; PPP6C; PPP6R2; PPP6R3; PPRC1; PPT2; PPY; PQBP1; PQLC3; PRAC1; PRAC2; PRADC1; PRAF2; PRAM1; PRAME; PRAP1; PRB1; PRB2; PRB3; PRB4; PRC1; PRCC; PRCD; PRCP; PRDM10; PRDM11; PRDM13; PRDM14; PRDM1; PRDM4; PRDM5; PRDM6; PRDM7; PRDM8; PRDM9; PRDX2; PRDX3; PRDX4; PRDX5; PRDX6; PREB; PRELP; PREP; PREPL; PREX1; PREX2; PRF1; PRG2; PRG4; PRH1; PRH2; PRICKLE1; PRICKLE2; PRICKLE4; PRIM1; PRIMAL; PRIMPOL; PRKAA1; PRKAB1; PRKACA; PRKACB; PRKACG; PRKAG1; PRKAG2; PRKAG3; PRKAR1A; PRKAR1B; PRKAR2A; PRKAR2B; PRKCA; PRKCB; PRKCDBP; PRKCD; PRKCE; PRKCG; PRKCH; PRKCI; PRKCQ; PRKCSH; PRKCZ; PRKD1; PRKD3; PRKDC; PRKG1; PRKG2; PRKRA; PRKRIR; PRKX; PRLH; PRL; PRLHR; PRLR; PRM1; PRM2; PRM3; PRMT1; PRMT2; PRMT3; PRMT5; PRMT8; PRND; PRNP; PROC; PROCR; PRODH; PROK2; PROKR1; PROKR2; PROL1; PROM1; PROM2; PROP1; PROS1; PROSER1; PROX1; PROZ; PRPF19; PRPF31; PRPF38B; PRPF3; PRPF40A; PRPF4B; PRPF4; PRPF6; PRPF8; PRPH2; PRPH; PRPS1; PRPS1L1; PRPS2; PRPSAP1; PRPSAP2; PRR11; PRR13; PRR15; PRR16; PRR34; PRR3; PRR5; PRR9; PRRC1; PRRC2A; PRRC2C; PRRG4; PRRT1; PRRT2; PRRX1; PRRX2; PRSS12; PRSS16; PRSS1; PRSS21; PRSS22; PRSS23; PRSS27; PRSS2; PRSS33; PRSS35; PRSS3; PRSS50; PRSS53; PRSS55; PRSS57; PRSS58; PRSS8; PRTFDC1; PRTG; PRTN3; PRUNE2; PRUNE; PRX; PRY; PSAP; PSAT1; PSCA; PSD3; PSD4; PSD; PSEN1; PSEN2; PSENEN; PSG1; PSG2; PSG5; PSG6; PSG8; PSG9; PSIP1; PSKH1; PSMA1; PSMA2; PSMA3; PSMA4; PSMA6; PSMA7; PSMB10; PSMB1; PSMB4; PSMB5; PSMB6; PSMB7; PSMB8; PSMB9; PSMC1; PSMC2; PSMC3; PSMC3IP; PSMC4; PSMC5; PSMC6; PSMD10; PSMD12; PSMD13; PSMD14; PSMD1; PSMD2; PSMD3; PSMD4; PSMD6; PSMD7; PSMD8; PSMD9; PSME1; PSME2; PSME3; PSME4; PSMF1; PSMG1; PSMG2; PSMG3; PSORS1C1; PSORS1C2; PSPC1; PSPH; PSPN; PSTPIP1; PSTPIP2; PTBP1; PTBP2; PTCD1; PTCH1; PTCHD1; PTCHD4; PTCRA; PTDSS1; PTEN; PTER; PTF1A; PTGDR2; PTGDR; PTGDS; PTGER1; PTGER2; PTGER3; PTGER4; PTGES2; PTGES3; PTGES; PTGIR; PTGIS; PTGR1; PTGS1; PTGS2; PTH1R; PTH2; PTH2R; PTH; PTHLH; PTK2B; PTK2; PTK6; PTK7; PTMA; PTMS; PTN; PTOV1; PTP4A1; PTP4A3; PTPMT1; PTPN11; PTPN12; PTPN13; PTPN14; PTPN18; PTPN1; PTPN21; PTPN22; PTPN23; PTPN2; PTPN3; PTPN4; PTPN5; PTPN6; PTPN7; PTPN9; PTPRA; PTPRB; PTPRCAP; PTPRD; PTPRE; PTPRG; PTPRH; PTPRJ; PTPRK; PTPRM; PTPRN2; PTPRN; PTPRO; PTPRQ; PTPRR; PTPRS; PTPRT; PTPRZ1; PTRF; PTRH1; PTRH2; PTRHD1; PTS; PTTG1; PTTG1IP; PTTG2; PTX3; PUF60; PUM2; PURA; PURB; PUS10; PUS1; PVALB; PVR; PVRL1; PVRL2; PVRL3; PVRL4; PWP2; PWWP2B; PXDN; PXDNL; PXK; PXMP2; PXN; PXT1; PYCARD; PYCR1; PYDC1; PYDC2; PYGB; PYGL; PYGM; PYG01; PYGO2; PYHIN1; PYROXD1; PYY; PZP; QARS; QDPR; QKI; QPCT; QPCTL; QPRT; QRFPR; QRFPR; QRSL1; QSOX1; QSOX2; QTRT1; R3HCC1; R3HCC1L; R3HDM1; R3HDML; RAB11A; RAB11B; RAB11FIP1; RAB11FIP2; RAB11FIP3; RAB11FIP4; RAB11FIP5; RAB12; RAB14; RAB15; RAB18; RAB1A; RAB1B; RAB20; RAB21; RAB22A; RAB23; RAB24; RAB25; RAB27A; RAB27B; RAB28; RAB29; RAB2A; RAB31; RAB32; RAB33B; RAB34; RAB35; RAB36; RAB37; RAB38; RAB39A; RAB39B; RAB3A; RAB3D; RAB3GAP1; RAB3GAP2; RAB3IL1; RAB3IP; RAB40AL; RAB40B; RAB40C; RAB4A; RAB4B; RAB5A; RAB5B; RAB5C; RAB6A; RAB6B; RAB6C; RAB7A; RAB8A; RAB8B; RAB9A; RABAC1; RABEP1; RABEP2; RABEPK; RABGAP1L; RABGEF1; RABIF; RABL6; RAC1; RAC2; RAC3; RACGAP1; RAD17; RAD18; RAD1; RAD21; RAD21L1; RAD23A; RAD23B; RAD50; RAD51AP1; RAD51B; RAD51C; RAD51D; RAD51; RAD52; RAD54B; RAD9A; RAD9B; RAE1; RAET1E; RAET1L; RAFT; RAG1; RAG2; RAI14; RAI1; RAI2; RALA; RALB; RALBP1; RALGAPA1; RALGAPA2; RALGAPB; RALGDS; RALGPS1; RALY; RALYL; RAMP1; RAMP2; RAMP3; RANBP10; RANBP17; RANBP1; RANBP2; RANBP3; RANBP3L; RANBP6; RANBP9; RANGAP1; RANGRF; RAN; RAP1B; RAP1GAP2; RAP1GDS1; RAP2A; RAP2B; RAPGEF1; RAPGEF2; RAPGEF3; RAPGEF4;

RAPGEF5; RAPH1; RAPSN; RARA; RARB; RARG; RARRES1; RARRES2; RARRES3; RARS2; RARS; RASA1; RASA2; RASAL1; RASAL2; RASD1; RASD2; RASEF; RASGEF1A; RASGEF1C; RASGRF1; RASGRF2; RASGRP1; RASGRP2; RASGRP3; RASGRP4; RASIP1; RASL10A; RASL10B; RASL11A; RASL11B; RASL12; RASSF1; RASSF2; RASSF3; RASSF4; RASSF5; RASSF6; RASSF7; RASSF8; RAX2; RAX; RB1CC1; RB1; RBAK; RBBP5; RBBP6; RBBP7; RBBP8; RBBP9; RBCK1; RBFOX1; RBFOX2; RBFOX3; RBL1; RBL2; RBM10; RBM12; RBM14; RBM14-RBM4; RBM15; RBM17; RBM20; RBM25; RBM26; RBM27; RBM28; RBM38; RBM39; RBM3; RBM45; RBM46; RBM47; RBM4; RBM5; RBM6; RBM7; RBMS1; RBMS2; RBMS3; RBMX2; RBMX; RBMXL2; RBMY1A1; RBP1; RBP2; RBP3; RBP4; RBPJ; RBPMS2; RBSN; RBX1; RC3H1; RCAN1; RCAN2; RCBTB1; RCBTB2; RCHY1; RCL1; RCN1; RCN2; RCOR1; RCSD1; RCVRN; RD3; RDH10; RDH11; RDH12; RDH14; RDH16; RDH5; RDH8; RDM1; RDX; REC8; RECK; RECQL5; RECQL; REEP1; REEP2; REEP3; REEP5; REEP6; REG1A; REG1B; REG3A; RELA; RELB; REL; RELN; REM1; RENBP; REN; REPS1; REPS2; RERG; RERGL; REST; RET; RETN; RETNLB; RETSAT; REV1; REV3L; REX1; REXO2; REXO4; RFC1; RFC2; RFC3; RFC4; RFC5; RFFL; RFK; RFPL1; RFT1; RFTN1; RFTN2; RFWD2; RFWD3; RFX1; RFX2; RFX3; RFX4; RFX5; RFX6; RFX8; RFXANK; RFXAP; RGCC; RGL1; RGL2; RGL4; RGMA; RGMB; RGN; RGPD2; RGR; RGS10; RGS11; RGS12; RGS13; RGS14; RGS16; RGS17; RGS18; RGS19; RGS1; RGS20; RGS21; RGS22; RGS2; RGS3; RGS4; RGS5; RGS6; RGS7BP; RGS7; RGS8; RGS9BP; RGS9; RGSL1; RHAG; RHBDD2; RHBDD3; RHBDF1; RHBDF2; RHBDL1; RHBDL2; RHCE; RHCG; RHEB; RHEBL1; RHNO1; RHOB; RHOBTB1; RHOBTB2; RHOBTB3; RHOD; RHOF; RHOG; RHOH; RHO; RHOJ; RHOQ; RHOT1; RHOU; RHOV; RHOXF1; RHOXF2; RHPN1; RHPN2; RIBC2; RIC1; RIC3; RICTOR; RIFT; RILP; RILPL1; RIMBP2; RIMBP3C; RIMS1; RIMS2; RIMS4; RINI1; RIN2; RIN3; RING1; RINT1; RIOK1; RIOK2; RIOK3; RIPK1; RIPK2; RIPK3; RIPK4; RIPPLY2; RIT1; RITZ; RITA1; RLBP1; RLF; RLIM; RLN1; RLN2; RLN3; RMDN1; RMDN2; RMDN3; RMI1; RMI2; RMND1; RNASE11; RNASE12; RNASE13; RNASE1; RNASE2; RNASE3; RNASE4; RNASE6; RNASE7; RNASE8; RNASE9; RNASEH1; RNASEH2A; RNASEH2B; RNASEH2C; RNASEK; RNASEL; RNASET2; RND1; RND3; RNF103-CHMP3; RNF103; RNF111; RNF112; RNF114; RNF123; RNF125; RNF128; RNF130; RNF135; RNF138; RNF139; RNF144A; RNF144B; RNF146; RNF149; RNF14; RNF150; RNF152; RNF157; RNF167; RNF168; RNF170; RNF180; RNF182; RNF19A; RNF207; RNF20; RNF213; RNF214; RNF216; RNF24; RNF2; RNF31; RNF34; RNF39; RNF40; RNF41; RNF43; RNF44; RNF4; RNF5; RNF6; RNF7; RNF8; RNGTT; RNH1; RNLS; RNMT; RNPEP; RNPEPL1; RNPS1; ROBOT; ROBO2; ROBO3; ROBO4; ROCK1; ROCK2; ROGDI; ROM1; ROPN1B; ROPN1; ROPN1L; ROR1; ROR2; RORA; RORB; RORC; ROS1; RP1; RP1L1; RP2; RP9; RPA1; RPA2; RPA3; RPA4; RPAIN; RPAP1; RPE; RPGR; RPGRIP1; RPGRIP1L; RPH3A; RPH3AL; RPIA; RPL10A; RPL10; RPL10L; RPL12; RPL13; RPL14; RPL15; RPL17-C18orf32; RPL17; RPL18; RPL19; RPL21; RPL23A; RPL23; RPL24; RPL27A; RPL29; RPL30; RPL31; RPL34; RPL35; RPL36A; RPL36AL; RPL37A; RPL38; RPL39; RPL39L; RPL3; RPL41; RPL4; RPL6; RPL7A; RPL7; RPLP0; RPLP1; RPN1; RPN2; RPP14; RPP21; RPP25; RPP38; RPP40; RPRD1A; RPRD1B; RPRD2; RPRM; RPS10; RPS14; RPS15A; RPS16; RPS18; RPS19BP1; RPS20; RPS24; RPS27A; RPS27; RPS27L; RPS29; RPS2; RPS3A; RPS3; RPS4X; RPS4Y1; RPS6KA2; RPS6KA3; RPS6KA4; RPS6KA5; RPS6KA6; RPS6KB1; RPS6KB2; RPS9; RPSA; RPTOR; RQCD1; RRAD; RRAGA; RRAS2; RRAS; RRBP1; RREB1; RRH; RRM1; RRM2B; RRM2; RRN3; RRNAD1; RRP1B; RRP1; RRP9; RRS1; RS1; RSAD2; RSF1; RSL101; RSL24D1; RSPH1; RSPH4A; RSPH9; RSPO2; RSPO3; RSPO4; RSRC1; RSRC2; RSRP1; RSU1; RTCB; RTEL1; RTKN2; RTKN; RTL1; RTN1; RTN2; RTN3; RTN4; RTN4IP1; RTN4R; RTP3; RTP4; RTTN; RUFY1; RUFY3; RUNDC3B; RUNX1; RUNX1T1; RUNX2; RUNX3; RUVBL1; RUVBL2; RXFP1; RXFP2; RXFP3; RXRA; RXRB; RXRG; RYBP; RYK; RYR1; RYR2; RYR3; S100A10; S100A11; S100A12; S100A13; S100A14; S100A16; S100A1; S100A2; S100A3; S100A4; S100A5; S100A6; S100A7A; S100A7; S100A8; S100A9; S100B; S100P; S100Z; S1PR2; S1PR3; S1PR4; S1PR5; SAA1; SAA2; SAA4; SAAL1; SAC3D1; SACM1L; SACS; SAE1; SAFB2; SAFB; SAGE1; SAG; SALL1; SALL2; SALL3; SALL4; SAMD14; SAMD1; SAMD4A; SAMD5; SAMD9; SAMD9L; SAMHD1; SAMM50; SAMSN1; SAP30BP; SAP30L; SAPCD1; SAPCD2; SAR1A; SAR1B; SARDH; SARM1; SARNP; SARS2; SART1; SART3; SASH1; SASH3; SAT1; SAT2; SATB1; SATB2; SATL1; SAV1; SBDS; SBF1; SBF2; SBNO1; SBNO2; SBSN; SC50; SCAF11; SCAF1; SCAF4; SCAF8; SCAI; SCAMP2; SCAMP5; SCAPER; SCAP; SCARA3; SCARA5; SCARB1; SCARB2; SCARF2; SCCPDH; SCD5; SCD; SCFD1; SCFD2; SCG2; SCG3; SCG5; SCGB1A1; SCGB1D1; SCGB1D2; SCGB2A1; SCGB2A2; SCGB2B2; SCGB3A1; SCGB3A2; SCGN; SCHIP1; SCIN; SCLT1; SCLY; SCML2; SCML4; SCN10A; SCN11A; SCN1A; SCN1B; SCN2A; SCN2B; SCN3A; SCN3B; SCN4A; SCN4B; SCN5A; SCN7A; SCN8A; SCN9A; SCNM1; SCNN1A; SCNN1B; SCNN1D; SCNN1G; SCO1; SCO2; SCP2D1; SCPEP1; SCRIB; SCRN1; SCT; SCTR; SCUBE1; SCUBE2; SCUBE3; SCYL1; SCYL3; SDC1; SDC2; SDC3; SDC4; SDCBP2; SDCBP; SDCCAG3; SDCCAG8; SDF2; SDF2L1; SDF4; SDHAF1; SDHAF2; SDHAF4; SDHA; SDHC; SDHD; SDK1; SDK2; SDPR; SDR42E1; SDR9C7; SDS; SEC11A; SEC11C; SEC13; SEC14L1; SEC14L2; SEC14L3; SEC16B; SEC23A; SEC23B; SEC23IP; SEC24A; SEC24B; SEC24C; SEC31A; SEC61A1; SEC61G; SEC62; SEC63; SECISBP2; SECISBP2L; SECTM1; SEL1L; SELE; SELENBP1; SELL; SELP; SELPLG; SEMA3A; SEMA3B; SEMA3C; SEMA3D; SEMA3E; SEMA3F; SEMA3G; SEMA4A; SEMA4B; SEMA4D; SEMA4F; SEMA4G; SEMA5A; SEMA5B; SEMA6A; SEMA6B; SEMA6D; SEMA7A; SEMG1; SEMG2; SENP1; SENP2; SENP3; SENP5; SENP6; SENP8; SEPHS1; SEPSECS; SERAC1; SERF1A; SERGEF; SERINC1; SERINC3; SERINC5; SERP1; SERP2; SERPINA10; SERPINA11; SERPINA12; SERPINA1; SERPINA3; SERPINA4; SERPINA5; SERPINA6; SERPINA7; SERPINA9; SERPINB10; SERPINB13; SERPINB1; SERPINB2; SERPINB3; SERPINB4; SERPINB5; SERPINB6; SERPINB7; SERPINB8; SERPINB9; SERPINC1; SERPIND1; SERPINE1; SERPINE2; SERPINE3; SERPINF1; SERPINF2; SERPING1; SERPINH1; SERPINI1; SERPINI2; SERTAD1; SERTAD2; SESN1; SESN3; SETBP1; SETD1A; SETD1B; SETD2; SETD5; SETD7; SETD8; SETDB1; SET; SETMAR; SETX; SEZ6; SEZ6L2; SEZ6L; SF1; SF3A1; SF3B1; SF3B2; SF3B6; SFI1; SFMBT1; SFMBT2; SFR1; SFRP1; SFRP2; SFRP4;

SFRP5; SFSWAP; SFT2D2; SFT2D3; SFTA2; SFTA3; SFTPA1; SFTPA2; SFTPB; SFTPC; SFTPD; SFXN1; SFXN2; SFXN4; SGCA; SGCB; SGCD; SGCE; SGCG; SGCZ; SGIP1; SGK1; SGK223; SGK2; SGK3; SGMS1; SGMS2; SGOL1; SGPL1; SGPP1; SGPP2; SGSH; SGSM2; SGSM3; SGTA; SH2B1; SH2B2; SH2B3; SH2D1A; SH2D2A; SH2D3A; SH2D3C; SH2D4A; SH2D4B; SH3BGR; SH3BGRL2; SH3BGRL; SH3BP1; SH3BP2; SH3BP4; SH3BP5; SH3D19; SH3GL1; SH3GL2; SH3GL3; SH3KBP1; SH3PXD2A; SH3PXD2B; SH3RF1; SH3RF3; SH3TC2; SH3YL1; SHANK1; SHANK2; SHANK3; SHARPIN; SHBG; SHB; SHC1; SHC2; SHC3; SHC4; SHCBP1; SHF; SHFM1; SHH; SHISA2; SHISA3; SHISA6; SHISA9; SHMT1; SHMT2; SHOC2; SHOX2; SHOX; SHPK; SHPRH; SHQ1; SHROOM2; SHROOM3; SHROOM4; SIAE; SIAH1; SIAH2; SIDT1; SIGIRR; SIGLEC11; SIGLEC14; SIGLEC1; SIGLEC5; SIGLEC7; SIGLEC8; SIGLEC9; SIGMAR1; SI; SIK1; SIK2; SIK3; SIL1; SIM1; SIM2; SIN3A; SIN3B; SIPA1; SIPA1L2; SIPA1L3; SIRPA; SIRPB1; SIRPG; SIRT1; SIRT2; SIRT3; SIRT4; SIRT5; SIRT6; SIRT7; SIT1; SIVA1; SIX1; SIX2; SIX3; SIX4; SIX5; SIX6; SKA1; SKA2; SKAP1; SKAP2; SKIL; SKIV2L2; SKIV2L; SKOR1; SKOR2; SKP1; SKP2; SLA2; SLA; SLAIN2; SLAMF1; SLAMF6; SLAMF7; SLAMF8; SLBP; SLC10A1; SLC10A2; SLC10A6; SLC10A7; SLC11A1; SLC11A2; SLC12A1; SLC12A2; SLC12A3; SLC12A4; SLC12A5; SLC12A6; SLC12A7; SLC12A8; SLC12A9; SLC13A1; SLC13A2; SLC13A3; SLC13A5; SLC14A1; SLC14A2; SLC15A1; SLC15A2; SLC15A4; SLC16A10; SLC16A11; SLC16A12; SLC16A13; SLC16A1; SLC16A2; SLC16A3; SLC16A6; SLC16A7; SLC16A8; SLC16A9; SLC17A1; SLC17A2; SLC17A3; SLC17A4; SLC17A5; SLC17A6; SLC17A7; SLC17A8; SLC18A1; SLC18A2; SLC18A3; SLC19A1; SLC19A2; SLC19A3; SLC1A1; SLC1A2; SLC1A3; SLC1A4; SLC1A5; SLC1A6; SLC20A1; SLC20A2; SLC22A11; SLC22A12; SLC22A13; SLC22A14; SLC22A16; SLC22A17; SLC22A18AS; SLC22A18; SLC22A1; SLC22A23; SLC22A24; SLC22A2; SLC22A3; SLC22A4; SLC22A5; SLC22A6; SLC22A7; SLC22A8; SLC23A1; SLC23A2; SLC24A1; SLC24A2; SLC24A3; SLC24A4; SLC24A5; SLC25A10; SLC25A12; SLC25A13; SLC25A14; SLC25A15; SLC25A16; SLC25A18; SLC25A19; SLC25A1; SLC25A20; SLC25A21; SLC25A22; SLC25A23; SLC25A25; SLC25A27; SLC25A2; SLC25A36; SLC25A37; SLC25A38; SLC25A3; SLC25A40; SLC25A41; SLC25A42; SLC25A43; SLC25A45; SLC25A46; SLC25A47; SLC25A4; SLC25A52; SLC25A5; SLC25A6; SLC26A1; SLC26A2; SLC26A3; SLC26A4; SLC26A5; SLC26A6; SLC26A7; SLC26A8; SLC26A9; SLC27A1; SLC27A2; SLC27A3; SLC27A4; SLC27A5; SLC28A1; SLC28A2; SLC28A3; SLC29A1; SLC29A2; SLC29A3; SLC29A4; SLC2A10; SLC2A11; SLC2A12; SLC2A13; SLC2A14; SLC2A2; SLC2A3; SLC2A4RG; SLC2A5; SLC2A6; SLC2A8; SLC2A9; SLC30A10; SLC30A1; SLC30A3; SLC30A4; SLC30A5; SLC30A6; SLC30A7; SLC30A8; SLC30A9; SLC31A1; SLC31A2; SLC32A1; SLC33A1; SLC34A1; SLC34A2; SLC34A3; SLC35A1; SLC35A2; SLC35A3; SLC35A4; SLC35B2; SLC35B4; SLC35C1; SLC35D3; SLC35F1; SLC35F2; SLC35F3; SLC35F4; SLC35F6; SLC35G1; SLC35G2; SLC35G5; SLC35G6; SLC36A1; SLC36A2; SLC37A1; SLC37A2; SLC37A4; SLC38A1; SLC38A2; SLC38A4; SLC38A5; SLC38A6; SLC38A7; SLC38A8; SLC38A9; SLC39A10; SLC39A11; SLC39A12; SLC39A13; SLC39A14; SLC39A1; SLC39A2; SLC39A3; SLC39A4; SLC39A6; SLC39A7; SLC39A8; SLC39A9; SLC3A1; SLC3A2; SLC40A1; SLC41A1; SLC43A1; SLC43A2; SLC43A3; SLC44A1; SLC44A2; SLC44A4; SLC44A5; SLC45A2; SLC45A3; SLC45A4; SLC46A1; SLC46A2; SLC47A1; SLC48A1; SLC4A10; SLC4A11; SLC4A1AP; SLC4A1; SLC4A2; SLC4A3; SLC4A4; SLC4A5; SLC4A7; SLC4A9; SLC50A1; SLC51A; SLC51B; SLC52A1; SLC52A2; SLC52A3; SLC5A11; SLC5A12; SLC5A1; SLC5A2; SLC5A3; SLC5A4; SLC5A5; SLC5A6; SLC5A7; SLC5A8; SLC6A11; SLC6A12; SLC6A13; SLC6A14; SLC6A15; SLC6A18; SLC6A19; SLC6A1; SLC6A20; SLC6A2; SLC6A4; SLC6A5; SLC6A6; SLC6A7; SLC6A8; SLC6A9; SLC7A10; SLC7A11; SLC7A13; SLC7A14; SLC7A1; SLC7A2; SLC7A3; SLC7A4; SLC7A5; SLC7A6; SLC7A7; SLC7A8; SLC7A9; SLC8A1; SLC8A2; SLC8A3; SLC9A1; SLC9A2; SLC9A3; SLC9A3R1; SLC9A3R2; SLC9A4; SLC9A5; SLC9A6; SLC9A7; SLC9A8; SLC9A9; SLC9B1; SLC9B2; SLC9C1; SLC9C2; SLCO1A2; SLCO1B1; SLCO1B3; SLCO1B7; SLCO1C1; SLCO2A1; SLCO2B1; SLCO3A1; SLCO4A1; SLCO4C1; SLCO5A1; SLCO6A1; SLFN12; SLFN12L; SLFN14; SLFN5; SLIT1; SLIT2; SLIT3; SLITRK1; SLITRK2; SLITRK3; SLITRK5; SLITRK6; SLK; SLMAP; SLMO2; SLN; SLPI; SLTM; SLUT; SLURP1; SLX4; SLX4IP; SMAD1; SMAD2; SMAD3; SMAD4; SMAD5; SMAD6; SMAD7; SMAD9; SMAGP; SMAP1; SMARCA1; SMARCA2; SMARCA4; SMARCA5; SMARCAD1; SMARCAL1; SMARCB1; SMARCC1; SMARCC2; SMARCD1; SMARCD3; SMARCE1; SMC1A; SMC1B; SMC2; SMC3; SMC4; SMC5; SMC6; SMCHD1; SMCO4; SMCP; SMEK1; SMEK2; SMG1; SMG6; SMG8; SMIM15; SMIM19; SMIM20; SMIM21; SMIM23; SMIM5; SMN2; SMOC1; SMOC2; SMO; SMOX; SMPD1; SMPD2; SMPD3; SMPDL3A; SMPDL3B; SMPX; SMR3B; SMS; SMTN; SMTNL1; SMU1; SMUG1; SMURF1; SMURF2; SMYD1; SMYD2; SMYD3; SMYD4; SMYD5; SNAI1; SNAI2; SNAI3; SNAP23; SNAP25; SNAP29; SNAP47; SNAP91; SNAPC1; SNAPC4; SNAPC5; SNCA; SNCAIP; SNCB; SNCG; SND1; SNED1; SNF8; SNIP1; SNRK; SNRNP200; SNRNP27; SNRNP70; SNRPA; SNRPB; SNRPC; SNRPD1; SNRPD3; SNRPE; SNRPF; SNRPN; SNTA1; SNTB1; SNTG1; SNTG2; SNUPN; SNORF; SNW1; SNX10; SNX12; SNX14; SNX16; SNX18; SNX19; SNX1; SNX20; SNX24; SNX25; SNX29; SNX2; SNX30; SNX3; SNX5; SNX9; SOAT1; SOAT2; SOBP; SOCS1; SOCS2; SOCS3; SOCS4; SOCS5; SOCS6; SOCS7; SOD1; SOD2; SOD3; SOHLH1; SOHLH2; SON; SORBS1; SORBS2; SORBS3; SORCS1; SORCS2; SORCS3; SORD; SORL1; SOS1; SOS2; SOSTDC1; SOST; SOX10; SOX11; SOX12; SOX13; SOX14; SOX15; SOX17; SOX18; SOX1; SOX21; SOX2; SOX3; SOX4; SOX5; SOX6; SOX7; SOX8; SOX9; SP100; SP110; SP140; SP1; SP2; SP3; SP4; SP5; SP6; SP7; SP8; SPA17; SPACA1; SPACA3; SPAG11A; SPAG11B; SPAG16; SPAG1; SPAG4; SPAG5; SPAG6; SPAG7; SPAG8; SPAG9; SPAM1; SPANXA2; SPANXB1; SPANXD; SPANXN4; SPARC; SPARCL1; SPAST; SPATA13; SPATA16; SPATA17; SPATA18; SPATA19; SPATA20; SPATA21; SPATA22; SPATA25; SPATA2; SPATA5; SPATA7; SPATA8; SPATA9; SPATC1; SPC24; SPC25; SPCS3; SPDEF; SPDL1; SPDYA; SPECC1; SPECC1L; SPEF2; SPEG; SPESP1; SPG11; SPG20; SPG21; SPG7; SPHK1; SPHK2; SPHKAP; SPIT; SPIB; SPIC; SPIDR; SPIN1; SPIN2A; SPINK1; SPINK2; SPINK4; SPINK5; SPINK6; SPINK7; SPINT1; SPINT2; SPNS1; SPNS2; SPO11; SPOCK1; SPOCK2; SPOCK3; SPON1; SPON2; SPOP; SPP1; SPP2; SPPL2A; SPPL2B; SPPL2C; SPPL3; SPRED1; SPRED2; SPRED3; SPR;

SPRN; SPRR1A; SPRR1B; SPRR2A; SPRR2B; SPRR3; SPRTN; SPRY1; SPRY2; SPRY3; SPRY4; SPRYD7; SPSB3; SPSB4; SPTA1; SPTAN1; SPTB; SPTBN1; SPTBN2; SPTBN4; SPTBN5; SPTLC1; SPTLC2; SPTLC3; SPTSSB; SPTY2D1; SPZ1; SQLE; SQRDL; SQSTM1; SRA1; SRBD1; SRCAP; SRC; SRCIN1; SRD5A1; SRD5A2; SRD5A3; SREBF1; SREBF2; SREK1; SREK1IP1; SRFBP1; SRF; SRGAP1; SRGAP2; SRGAP3; SRGN; SRI; SRL; SRMS; SRP14; SRP19; SRP68; SRP72; SRP9; SRPK1; SRPK2; SRPRB; SRPR; SRPX2; SRPX; SRR; SRRM1; SRRM2; SRRM4; SRRT; SRSF10; SRSF11; SRSF12; SRSF1; SRSF2; SRSF3; SRSF4; SRSF5; SRSF6; SRSF7; SRSF9; SRXN1; SRY; SS18; SS18L1; SSB; SSBP1; SSBP2; SSFA2; SSH1; SSH2; SSMEM1; SSNA1; SSPN; SSPO; SSR1; SSR2; SSRP1; SSSCA1; SST; SSTR1; SSTR2; SSTR3; SSTR4; SSTR5; SSUH2; SSX1; SSX2B; SSX2IP; SSX4B; SSX5; ST13; ST14; ST18; ST20; ST3GAL1; ST3GAL2; ST3GAL4; ST3GAL5; ST3GAL6; ST5; ST6GAL1; ST6GAL2; ST6GALNAC1; ST6GALNAC2; ST6GALNAC4; ST6GALNAC6; ST7; ST7L; ST8SIA1; ST8SIA2; ST8SIA3; ST8SIA4; ST8SIA6; STAB1; STAB2; STAC3; STAC; STAG1; STAG2; STAG3; STAM2; STAMBP; STAMBPL1; STAM; STAP1; STAP2; STARD10; STARD13; STARD3; STARD3NL; STARD5; STARD7; STARD8; STARD9; STAR; STAT1; STAT2; STAT3; STAT4; STAT5A; STAT5B; STAT6; STATH; STAU2; STBD1; STC1; STC2; STEAP1; STEAP2; STEAP3; STEAP4; STH; STIL; STIM1; STIM2; STIP1; STK10; STK11; STK11IP; STK17A; STK17B; STK19; STK24; STK25; STK26; STK31; STK32A; STK32B; STK32C; STK33; STK35; STK38L; STK39; STK3; STK4; STMN2; STMN3; STMN4; STOM; STOML1; STOML2; STOML3; STON1-GTF2A1L; STON1; STOX1; STRA13; STRA6; STRA8; STRADA; STRADB; STRAP; STRC; STRN3; STRN4; STRN; STS; STT3A; STT3B; STUB1; STX11; STX16; STX17; STX18; STX1A; STX1B; STX2; STX3; STX4; STX5; STX6; STX8; STXBP1; STXBP2; STXBP4; STXBP5; STXBP5L; STXBP6; STYK1; STYX; SUB1; SUCLA2; SUCLG1; SUCLG2; SUCNR1; SUCO; SUDS3; SUFU; SUGCT; SUGP1; SUGT1; SULF1; SULF2; SULT1A1; SULT1A2; SULT1A4; SULT1B1; SULT1C2; SULT1E1; SULT2A1; SULT2B1; SULT4A1; SUMF1; SUMF2; SUMO1; SUMO2; SUMO3; SUMO4; SUN1; SUN2; SUN3; SUOX; SUPT20H; SUPT3H; SUPT4H1; SUPT7L; SUPV3L1; SURF1; SURF4; SUSD1; SUSD2; SUSD4; SUSD6; SUV39H1; SUV39H2; SUV420H2; SUZ12; SV2B; SV2C; SVEP1; SVIL; SVIP; SVOP; SWAP70; SWT1; SYBU; SYCE1; SYCE1L; SYCP2; SYCP2L; SYCP3; SYK; SYMPK; SYN1; SYN2; SYN3; SYNCRIP; SYNDIG1; SYNE1; SYNE2; SYNE4; SYNGAP1; SYNGR1; SYNGR2; SYNJ1; SYNJ2BP; SYNJ2; SYNM; SYNPO2; SYNPO; SYNPR; SYP; SYPL1; SYPL2; SYT11; SYT12; SYT13; SYT14; SYT1; SYT4; SYT6; SYT9; SYTL1; SYTL2; SYTL5; SYVN1; TAAR1; TAAR2; TAAR5; TAAR6; TAB1; TAB2; TAB3; TACT; TAC3; TAC4; TACC1; TACC2; TACC3; TACO1; TACR1; TACR2; TACR3; TADA1; TADA2A; TADA3; TAF15; TAF1B; TAF1C; TAF1D; TAF1; TAF2; TAF3; TAF4B; TAF4; TAF5L; TAF6; TAF7; TAF7L; TAF8; TAF9; TAGAP; TAGLN2; TAGLN; TALI; TAL2; TALDO1; TAMM41; TANC1; TANC2; TANGO2; TANK; TAOK1; TAOK2; TAOK3; TAP1; TAP2; TAPBP; TAPBPL; TARBP1; TARBP2; TARP; TARS; TARSL2; TAS2R10; TAS2R13; TAS2R14; TAS2R16; TAS2R1; TAS2R38; TAS2R50; TAS2R60; TAS2R9; TASP1; TATDN1; TAT; TAX1BP1; TAX1BP3; TAZ; TBATA; TBC1D15; TBC1D16; TBC1D1; TBC1D20; TBC1D22A; TBC1D22B; TBC1D24; TBC1D25; TBC1D2; TBC1D32; TBC1D3C; TBC1D3F; TBC1D4; TBC1D5; TBC1D7; TBC1D8; TBC1D9; TBCA; TBCC; TBCD; TBCE; TBCEL; TBK1; TBKBP1; TBL1X; TBL1XR1; TBL1Y; TBL2; TBL3; TBP; TBPL1; TBPL2; TBR1; TBRG1; TBX10; TBX18; TBX19; TBX1; TBX20; TBX21; TBX22; TBX2; TBX3; TBX4; TBX5; TBX6; TBXA2R; TBXAS1; TCAIM; TCAP; TCEA1; TCEA2; TCEA3; TCEAL1; TCEAL2; TCEAL4; TCEAL7; TCEB1; TCEB2; TCEB3C; TCERG1; TCERG1L; TCF12; TCF15; TCF19; TCF20; TCF21; TCF25; TCF3; TCF4; TCF7; TCF7L1; TCF7L2; TCFL5; TCHH; TCHP; TCIRG1; TCL1A; TCL1B; TCN1; TCN2; TCOF1; TCP10; TCP10L2; TCP11L1; TCP1; TCTA; TCTE1; TCTN1; TCTN2; TCTN3; TDGF1; TDG; TDO2; TCP1; TCP2; TDRD1; TDRD3; TDRD5; TDRD6; TDRD7; TDRD9; TDRKH; TDRP; TEAD1; TEAD2; TEAD3; TEAD4; TEC; TECPR2; TECR; TECRL; TECTA; TEF; TEFM; TEK; TEKT1; TEKT5; TELO2; TENM1; TENM2; TENM3; TENM4; TEP1; TEPP; TERF1; TERF2; TERF2IP; TERT; TESC; TES; TESPA1; TET1; TET2; TET3; TEX101; TEX11; TEX14; TEX15; TEX264; TEX29; TEX30; TEX35; TEX40; TFAM; TFAP2A; TFAP2B; TFAP2C; TFAP4; TFB1M; TFB2M; TFCP2; TFDP1; TFDP2; TFDP3; TFE3; TFEB; TFEC; TFF1; TFF2; TFF3; TFG; TF; TFIP11; TFPI2; TFPI; TFPT; TFR2; TFRC; TGFA; TGFB1; TGFB1I1; TGFB2; TGFB3; TGFBI; TGFBR1; TGFBR2; TGFBRAP1; TG; TGIF1; TGIF2-C20orf24; TGIF2; TGIF2LX; TGM1; TGM2; TGM3; TGM4; TGM5; TGM6; TGM7; TGOLN2; TGS1; THADA; THAP10; THAP11; THAP1; THAP2; THAP6; THBD; THBS1; THBS2; THBS3; THBS4; THEG; THEM4; THEM5; THEME; THEMIS2; THEMIS; THG1L; TH; THNSL1; THNSL2; THOC1; THOC2; TH005; THOC6; T; THOP1; THPO; THRA; THRB; THRSP; THSD1; THSD4; THSD7A; THYN1; TIAL; TIAF1; TIAL1; TIAM1; TIAM2; TICAM1; TICAM2; TICRR; TIFA; TIGD2; TIGIT; TIMD4; TIMELESS; TIMM10; TIMM17A; TIMM21; TIMM22; TIMM23; TIMM44; TIMM50; TIMM8A; TIMM8B; TIMMDC1; TIMP1; TIMP2; TIMP3; TIMP4; TINAG; TINF2; TIPARP; TIPIN; TIPRL; TIRAP; TJP1; TJP2; TJP3; TK1; TK2; TKT; TKTL1; TKTL2; TLDC1; TLE1; TLE2; TLE3; TLE4; TLE6; TLK1; TLK2; TLL1; TLL2; TLN1; TLN2; TLR10; TLR1; TLR2; TLR3; TLR4; TLR5; TLR6; TLR7; TLR8; TLR9; TLX1; TLX2; TLX3; TM4SF1; TM4SF20; TM4SF4; TM4SF5; TM6SF2; TM7SF2; TM9SF2; TM9SF4; TMBIM4; TMBIM6; TMC1; TMC2; TMC3; TMC5; TMC6; TMC8; TMCC1; TMCC2; TMCC3; TMCO1; TMCO4; TMCO5A; TMED10; TMED1; TMED2; TMED3; TMED4; TMED7; TMED7-TICAM2; TMED9; TMEFF1; TMEFF2; TMEM100; TMEM101; TMEM105; TMEM106B; TMEM108; TMEM114; TMEM115; TMEM117; TMEM11; TMEM126A; TMEM127; TMEM128; TMEM132A; TMEM132B; TMEM132C; TMEM132O; TMEM132E; TMEM134; TMEM135; TMEM138; TMEM150B; TMEM151A; TMEM151B; TMEM154; TMEM158; TMEM160; TMEM161B; TMEM163; TMEM165; TMEM169; TMEM170A; TMEM171; TMEM173; TMEM175; TMEM176B; TMEM178A; TMEM182; TMEM183A; TMEM184C; TMEM185A; TMEM187; TMEM189; TMEM189-UBE2V1; TMEM18; TMEM199; TMEM200A; TMEM205; TMEM207; TMEM209; TMEM213; TMEM215; TMEM216; TMEM217; TMEM219; TMEM220; TMEM229A; TMEM231; TMEM233; TMEM237; TMEM241; TMEM244; TMEM245; TMEM259; TMEM25; TMEM261; TMEM27; TMEM2; TMEM30A; TMEM30B; TMEM37; TMEM38A;

TMEM38B; TMEM39A; TMEM40; TMEM43; TMEM45A; TMEM47; TMEM50B; TMEM55A; TMEM57; TMEM5; TMEM60; TMEM62; TMEM63A; TMEM67; TMEM70; TMEM74B; TMEM79; TMEM87A; TMEM88; TMEM89; TMEM8B; TMEM95; TMEM97; TMEM98; TMF1; TMIE; TMIGD2; TMIGD3; TMLHE; TMOD1; TMOD2; TMOD3; TMOD4; TMPO; TMPRSS11A; TMPRSS11B; TMPRSS11O; TMPRSS11E; TMPRSS13; TMPRSS15; TMPRSS2; TMPRSS3; TMPRSS4; TMPRSS6; TMPRSS7; TMPRSS9; TMSB10; TMSB15B; TMSB4X; TMTC1; TMTC2; TMTC3; TMX1; TMX2; TMX3; TNC; TNFAIP1; TNFAIP2; TNFAIP3; TNFAIP6; TNFAIP8; TNFAIP8L2; TNFAIP8L3; TNF; TNFRSF10A; TNFRSF10B; TNFRSF10C; TNFRSF10D; TNFRSF11A; TNFRSF11B; TNFRSF12A; TNFRSF13B; TNFRSF13C; TNFRSF14; TNFRSF19; TNFRSF1A; TNFRSF1B; TNFRSF21; TNFRSF6B; TNFRSF8; TNFSF10; TNFSF11; TNFSF12; TNFSF12-TNFSF13; TNFSF13B; TNFSF13; TNFSF14; TNFSF15; TNFSF18; TNFSF4; TNFSF8; TNFSF9; TNIK; TNIP1; TNIP2; TNIP3; TNK1; TNK2; TNKS2; TNKS; TNMD; TNNC1; TNN; TNNI1; TNNI2; TNNI3; TNNT1; TNNT2; TNNT3; TNP1; TNP2; TNPO1; TNPO2; TNPO3; TNRC18; TNRC6A; TNRC6B; TNR; TNS1; TNS2; TNS3; TNS4; TNXB; TOB1; TOB2; TOLLIP; TOM1; TOM1L1; TOMM20; TOMM34; TOMM40; TOMM70A; TONSL; TOP1; TOP2A; TOP2B; TOP3A; TOP3B; TOPBP1; TOPORS; TOR1A; TOR1AIP1; TOR1AIP2; TOR1B; TOR2A; TOX2; TOX3; TOX4; TOX; TP53AIP1; TP53BP1; TP53BP2; TP53; TP53I11; TP53I13; TP53I3; TP53INP1; TP53INP2; TP53RK; TP53TG3C; TP63; TP73; TPBG; TPCN1; TPCN2; TPD52; TPD52L1; TPD52L2; TPGS2; TPH1; TPH2; TPI1; TPK1; TPM1; TPM2; TPM3; TPM4; TPMT; TPO; TPP1; TPP2; TPPP2; TPPP3; TPPP; TPRG1; TPR; TPRN; TPSAB1; TPSB2; TPSD1; TPSG1; TPT1; TPTE2; TPTE; TPX2; TRA2A; TRA2B; TRABD2A; TRABD; TRADD; TRAF1; TRAF2; TRAF3; TRAF3IP1; TRAF3IP2; TRAF4; TRAF5; TRAF6; TRAF7; TRAFD1; TRAK1; TRAK2; TRAM1; TRAM1L1; TRAM2; TRAP1; TRAPPC10; TRAPPC11; TRAPPC1; TRAPPC2; TRAPPC4; TRAPPC9; TRAT1; TRDMT1; TRDN; TREH; TREM1; TREM2; TREML1; TREML2; TRERF1; TREX1; TREX2; TRHDE; TRH; TRHR; TRIAP1; TRIB1; TRIB2; TRIB3; TRIM10; TRIM11; TRIM13; TRIM15; TRIM16; TRIM17; TRIM21; TRIM22; TRIM23; TRIM24; TRIM25; TRIM26; TRIM27; TRIM28; TRIM29; TRIM2; TRIM31; TRIM32; TRIM34; TRIM35; TRIM36; TRIM37; TRIM38; TRIM39; TRIM3; TRIM40; TRIM42; TRIM44; TRIM50; TRIM56; TRIM58; TRIM59; TRIMS; TRIM62; TRIM66; TRIM68; TRIM69; TRIM6-TRIM34; TRIM71; TRIM72; TRIM73; TRIM74; TRIMS; TRIMS; TRIOBP; TRIO; TRIP10; TRIP11; TRIP13; TRIP4; TRIPE; TRIQK; TRMT10A; TRMT12; TRMT1; TRMT44; TRMT5; TRMU; TRO; TROVE2; TRPA1; TRPC1; TRPC3; TRPC4AP; TRPC4; TRPC5; TRPC6; TRPC7; TRPM1; TRPM2; TRPM3; TRPM4; TRPM5; TRPM6; TRPM7; TRPM8; TRPS1; TRPV1; TRPV2; TRPV3; TRPV4; TRPV5; TRPV6; TRRAP; TSACC; TSC1; TSC22D1; TSC22D3; TSC22D4; TSC2; TSEN2; TSEN34; TSEN54; TSFM; TSG101; TSGA10; TSHR; TSHZ1; TSHZ2; TSHZ3; TSLP; TSNAX; TSN; TSPAN10; TSPAN11; TSPAN12; TSPAN13; TSPAN14; TSPAN16; TSPAN18; TSPAN31; TSPAN32; TSPAN33; TSPAN4; TSPAN6; TSPAN7; TSPAN8; TSPAN9; TSPEAR; TSPO2; TSPO; TSPY10; TSPY1; TSPY3; TSPY4; TSPYL1; TSPYL2; TSPYL4; TSPYL5; TSR1; TSSC1; TSSK1B; TSSK2; TSSK4; TSTA3; TSTD1; TST; TTBK1; TTBK2; TTC12; TTC17; TTC19; TTC1; TTC21B; TTC28; TTC29; TTC37; TTC39A; TTC39B; TTC3; TTC5; TTC6; TTC7A; TTC7B; TTC8; TTC9B; TTC9C; TTC9; TTF1; TTF2; TTI1; TTI2; TTK; TTL; TTLL10; TTLL11; TTLL12; TTLL1; TTLL3; TTLL4; TTLL5; TTLL6; TTLL7; TTLL8; TTLL9; TTPA; TTR; TTYH1; TTYH2; TUBA1A; TUBA1B; TUBA1C; TUBA30; TUBA4A; TUBAE; TUBB1; TUBB2A; TUBB2B; TUBB3; TUBB4A; TUBB4B; TUBB6; TUBB; TUBD1; TUBE1; TUBG1; TUBG2; TUBGCP2; TUBGCP3; TUBGCP4; TUBGCP5; TUBGCP6; TUB; TUFM; TUFT1; TULP1; TULP2; TULP3; TULP4; TUSC1; TUSC2; TUSC3; TUSC5; TUT1; TVP23B; TWF1; TWIST1; TWIST2; TWSG1; TXK; TXLNG; TXN2; TXNDC15; TXNDC16; TXNDC17; TXNDC5; TXN; TXNL1; TXNRD2; TXNRD3NB; TYK2; TYMP; TYMS; TYR; TYRO3; TYROBP; TYRP1; TYSND1; TYW1B; U2AF1; U2AF2; UACA; UAP1; UBA1; UBA2; UBA3; UBA7; UBAC1; UBAC2; UBAP1; UBAP2; UBASH3A; UBASH3B; UBB; UBC; UBD; UBE2A; UBE2B; UBE2C; UBE2D1; UBE2D2; UBE2D3; UBE2E1; UBE2E2; UBE2E3; UBE2G1; UBE2G2; UBE2H; UBE2I; UBE2J1; UBE2K; UBE2L3; UBE2L6; UBE2M; UBE2N; UBE2Q2; UBE2QL1; UBE2R2; UBE2S; UBE2T; UBE2U; UBE2V1; UBE2V2; UBE2Z; UBE3A; UBE3B; UBE3C; UBE4A; UBE4B; UBIAD1; UBL3; UBL4A; UBL5; UBL7; UBLCP1; UBN1; UBOX5; UBP1; UBQLN1; UBQLN2; UBQLNL; UBR1; UBR3; UBR4; UBR5; UBR7; UBTD2; UBTF; UBXN1; UBXN2A; UBXN2B; UBXN4; UCHL1; UCHL3; UCHL5; UCK1; UCK2; UCKL1; UCMA; UCN2; UCN3; UCN; UCP1; UCP2; UCP3; UEVLD; UFD1L; UFL1; UFM1; UGCG; UGDH; UGGT1; UGGT2; UGP2; UGT1A10; UGT1A1; UGT1A3; UGT1A4; UGT1A5; UGT1A6; UGT1A7; UGT1A8; UGT1A9; UGT2A1; UGT2A2; UGT2A3; UGT2B10; UGT2B11; UGT2B15; UGT2B28; UGT2B4; UGT2B7; UGT3A2; UGT8; UHMK1; UHRF1BP1; UHRF1; UHRF2; UIMC1; ULBP1; ULBP2; ULBP3; ULK1; ULK2; ULK3; ULK4; UMOD; UMODL1; UMPS; UNC119; UNC13A; UNC13B; UNC13C; UNC13D; UNC45A; UNC45B; UNC5A; UNC5B; UNC5C; UNC5D; UNC79; UNC93A; UNC93B1; UNG; UPB1; UPF1; UPF2; UPF3A; UPF3B; UPK1A; UPK1B; UPK2; UPK3A; UPP1; UPP2; UPRT; UQCC1; UQCC2; UQCRB; UQCRC1; UQCRC2; UQCRFS1; UQCRQ; URB2; URGCP; URI1; URM1; UROC1; UROD; UROS; USB1; USE1; USF1; USF2; USH1C; USH1G; USH2A; USO1; USP10; USP11; USP12; USP13; USP14; USP15; USP17L2; USP17L30; USP18; USP20; USP22; USP25; USP26; USP28; USP2; USP32; USP33; USP36; USP37; USP3; USP40; USP42; USP43; USP44; USP46; USP48; USP49; USP4; USPS; USP6; USP6NL; USP7; USP8; USP9X; USP9Y; USPL1; UST; UTF1; UTP14A; UTP14C; UTP20; UTRN; UTS2B; UTS2; UTS2R; UTY; UVRAG; UVSSA; UXS1; UXT; VAC14; VAMP1; VAMP2; VAMP4; VAMP7; VAMPS; VANGL2; VAPA; VAPB; VARS2; VARS; VASH1; VASH2; VASP; VAT1; VAT1L; VAV1; VAV2; VAV3; VAX1; VAX2; VBP1; VCAN; VCL; VCP; VCX2; VCX3A; VCX3B; VCX; VCY; VDAC1; VDAC2; VDR; VEGFA; VEGFB; VEGFC; VENTX; VEPH1; VEZT; VGF; VGLL1; VGLL2; VGLL3; VGLL4; VHL; VHLL; VIL1; VIM; VIPAS39; VIP; VIPR1; VIPR2; VIT; VKORC1; VLDLR; VMA21; VMO1; VMP1; VN1R2; VN1R4; VNN1; VNN2; VNN3; VOPP1; VPRBP; VPREB1; VPREB3; VPS11; VPS13A; VPS13B; VPS13C; VPS26A; VPS28; VPS33A; VPS33B; VPS35; VPS36; VPS37A; VPS37B; VPS37C; VPS39; VPS41; VPS4A; VPS4B; VPS51; VPS52; VPS53; VPS54; VPS72; VPS8; VRK1; VRK2; VSIG10; VSIG1; VSIG2; VSIG4; VSNL1;

VSTM1; VSX1; VSX2; VTA1; VTCN1; VTI1A; VTI1B; VTN; VWA2; VWA3A; VWA3B; VWA5A; VWA5B1; VWA7; VWA8; VWCE; VWDE; VWF; WAPAL; WARS2; WARS; WASF1; WASF3; WASH1; WAS; WASL; WBP1L; WBP2; WBSCR17; WBSCR22; WDFY2; WDFY4; WDHD1; WDPCP; WDR11; WDR12; WDR17; WDR19; WDR1; WDR20; WDR26; WDR31; WDR34; WDR35; WDR36; WDR37; WDR43; WDR45B; WDR45; WDR46; WDR48; WDR49; WDR4; WDR55; WDR5; WDR60; WDR62; WDR64; WDR66; WDR70; WDR72; WDR74; WDR76; WDR78; WDR7; WDR81; WDR83; WDR86; WDR93; WEE1; WFDC1; WFDC2; WFS1; WHSC1; WHSC1L1; WIF1; WIPF1; WIPF2; WIPF3; WIPI1; WIPI2; WISP1; WISP2; WISP3; WLS; WNK1; WNK2; WNK3; WNK4; WNT10A; WNT10B; WNT11; WNT16; WNT1; WNT2B; WNT2; WNT3A; WNT3; WNT4; WNT5A; WNT5B; WNT6; WNT7A; WNT7B; WNT8A; WNT8B; WNT9A; WNT9B; WRAP53; WRB; WRN; WRNIP1; WSB1; WSCD1; WSCD2; WT1; WTAP; WTIP; WWC1; WWC2; WWOX; WWP1; WWP2; WWTR1; XAB2; XAF1; XAGE1B; XAGE1E; XBP1; XCL1; XCL2; XCR1; XDH; XG; XIAP; XIRP1; XIRP2; XK; XKR4; XKR6; XKR9; XPA; XPC; XPNPEP1; XPNPEP2; XPNPEP3; XPO1; XPO4; XPO5; XPO7; XPR1; XRCC1; XRCC2; XRCC3; XRCC4; XRCC5; XRCC6BP1; XRCC6; XRN1; XRN2; XRRA1; XXYLT1; XYLB; XYLT1; XYLT2; YAE1D1; YAP1; YARS2; YBX2; YBX3; YDJC; YEATS4; YES1; YIF1A; YIPF1; YIPF3; YIPF5; YKT6; YLPM1; YME1L1; YPEL1; YPEL2; YPEL3; YPEL4; YPEL5; YTHDC1; YTHDC2; YWHAB; YWHAE; YWHAG; YWHAH; YWHAQ; YWHAZ; YY1AP1; YY1; ZACN; ZAK; ZAP70; ZAR1; ZAR1L; ZASP; ZBED1; ZBED4; ZBED5; ZBP1; ZBTB10; ZBTB12; ZBTB14; ZBTB16; ZBTB17; ZBTB18; ZBTB20; ZBTB21; ZBTB22; ZBTB24; ZBTB2; ZBTB32; ZBTB33; ZBTB34; ZBTB38; ZBTB41; ZBTB46; ZBTB48; ZBTB49; ZBTB4; ZBTB5; ZBTB7C; ZBTB9; ZC2HC1B; ZC3H10; ZC3H11A; ZC3H12C; ZC3H12D; ZC3H14; ZC3H15; ZC3H3; ZC3H4; ZC3H7A; ZC3H7B; ZC3HAV1; ZC3HC1; ZC4H2; ZCCHC11; ZCCHC12; ZCCHC14; ZCCHC2; ZCCHC3; ZCCHC6; ZCCHC8; ZCRB1; ZCWPW1; ZDBF2; ZDHHC11; ZDHHC12; ZDHHC13; ZDHHC14; ZDHHC15; ZDHHC17; ZDHHC1; ZDHHC2; ZDHHC7; ZDHHC8; ZDHHC9; ZEB1; ZEB2; ZFAND3; ZFAND5; ZFAND6; ZFAT; ZFC3H1; ZFHX2; ZFHX3; ZFHX4; ZFP1; ZFP30; ZFP36; ZFP36L1; ZFP36L2; ZFP37; ZFP42; ZFP57; ZFP64; ZFP82; ZFP91; ZFPM1; ZFPM2; ZFR2; ZFR; ZFX; ZFY; ZFYVE19; ZFYVE21; ZFYVE26; ZFYVE27; ZFYVE28; ZFYVE9; ZG16B; ZGLP1; ZGPAT; ZHX1; ZHX2; ZIC1; ZIC2; ZIC3; ZIC4; ZIC5; ZIK1; ZIM2; ZKSCAN1; ZKSCAN3; ZKSCAN7; ZMAT3; ZMAT4; ZMIZ1; ZMYM2; ZMYM3; ZMYM4; ZMYM5; ZMYND10; ZMYND11; ZMYND8; ZNF106; ZNF107; ZNF10; ZNF112; ZNF121; ZNF131; ZNF132; ZNF133; ZNF141; ZNF143; ZNF146; ZNF148; ZNF154; ZNF160; ZNF169; ZNF175; ZNF177; ZNF182; ZNF184; ZNF185; ZNF189; ZNF197; ZNF202; ZNF205; ZNF20; ZNF212; ZNF214; ZNF215; ZNF217; ZNF224; ZNF22; ZNF230; ZNF236; ZNF239; ZNF23; ZNF248; ZNF24; ZNF253; ZNF260; ZNF263; ZNF264; ZNF266; ZNF267; ZNF268; ZNF273; ZNF274; ZNF276; ZNF277; ZNF280B; ZNF280D; ZNF281; ZNF282; ZNF286B; ZNF296; ZNF2; ZNF300; ZNF311; ZNF318; ZNF320; ZNF322; ZNF32; ZNF330; ZNF331; ZNF334; ZNF335; ZNF343; ZNF350; ZNF354A; ZNF35; ZNF365; ZNF366; ZNF367; ZNF382; ZNF383; ZNF384; ZNF385A; ZNF385B; ZNF385D; ZNF391; ZNF395; ZNF398; ZNF407; ZNF410; ZNF415; ZNF419; ZNF41; ZNF423; ZNF430; ZNF432; ZNF433; ZNF438; ZNF443; ZNF444; ZNF44; ZNF451; ZNF45; ZNF462; ZNF469; ZNF483; ZNF490; ZNF492; ZNF496; ZNF501; ZNF507; ZNF512B; ZNF512; ZNF513; ZNF516; ZNF519; ZNF521; ZNF536; ZNF555; ZNF559; ZNF568; ZNF569; ZNF577; ZNF580; ZNF581; ZNF582; ZNF583; ZNF585B; ZNF592; ZNF596; ZNF606; ZNF607; ZNF608; ZNF615; ZNF618; ZNF627; ZNF629; ZNF639; ZNF644; ZNF645; ZNF646; ZNF652; ZNF654; ZNF664; ZNF667; ZNF668; ZNF674; ZNF676; ZNF678; ZNF683; ZNF687; ZNF689; ZNF703; ZNF704; ZNF706; ZNF711; ZNF716; ZNF717; ZNF746; ZNF74; ZNF750; ZNF763; ZNF764; ZNF765; ZNF76; ZNF774; ZNF776; ZNF778; ZNF784; ZNF79; ZNF7; ZNF800; ZNF804A; ZNF804B; ZNF80; ZNF812; ZNF813; ZNF816; ZNF81; ZNF823; ZNF827; ZNF829; ZNF831; ZNF91; ZNF92; ZNF93; ZNF98; ZNFX1; ZNHIT2; ZNHIT3; ZNRD1; ZNRF3; ZP1; ZP4; ZPBP2; ZPLD1; ZPR1; ZRANB3; ZRSR2; ZSCAN18; ZSCAN22; ZSCAN26; ZSCAN31; ZSCAN32; ZSCAN9; ZSWIM2; ZSWIM6; ZW10; ZWILCH; ZWINT; ZYX; ZZEF1; and ZZZ3; or a fragment or variant of any of these. These and other proteins are understood to be therapeutic, as they are meant to treat the subject by replacing its defective endogenous production of a functional protein in sufficient amounts. Accordingly, such therapeutic proteins are typically mammalian, in particular human proteins.

It is further preferred that the at least one coding sequence of the RNA of the present invention encodes a peptide or a protein comprising or consisting of a therapeutic protein, or a fragment or variant thereof, wherein the therapeutic protein is any one selected from the peptides or proteins listed in Table 1, whereby each peptide or protein is represented by formula "c1(Peptide or protein or gene) c2(NCBI Ref Seq ID) c3(Protein SEQ ID NO) c4(RNA SEQ ID NOs) c5(Related disease, disorder or condition)" as defined above.

In Table 1, each peptide or protein as represented by formula "c1(Peptide or protein or gene) c2(NCBI Ref Seq ID) c3(Protein SEQ ID NO) c4(RNA SEQ ID NOs) c5(Related disease, disorder or condition)" as defined above corresponds to a preferred therapeutic protein as defined herein and provides the abbreviation of the name of the peptide or protein indicated under feature c1 ("Peptide or protein") and the database accession number of that peptide or protein under feature c2 ("NCBI Ref Seq ID") in the same entry. Under feature c3 in the same entry, Table 1 provides the SEQ ID NO: (as comprised in the sequence listing herein) corresponding to the amino acid sequence of that peptide or protein. Under feature c4 in the same entry, Table 1 provides the SEQ ID NO: (as comprised in the sequence listing herein) corresponding to the nucleic acid sequence of preferred RNA's encoding that peptide or protein. Feature c5 of Table 1 provides one or more disease, disorder or condition, for the treatment or prevention of which the peptide or protein identified by features c1 to c4 in the same entry is preferably used, whereby the abbreviations as disclosed under feature c5 are to be read from the Abbreviation Dictionary for the "Related disease, disorder or condition" as shown in Table C, whereby each abbreviation is depicted with a specific "Related disease, disorder or condition" in written form as described above.

Thus, Table 1 summarizes preferred embodiments of the present invention, wherein each entry (i.e. peptide or protein of the invention as represented by the formula "c1(Peptide or protein or gene) c2(NCBI Ref Seq ID) c3(Protein SEQ ID NO) c4(RNA SEQ NOs) c5(Related disease, disorder or condition)") in Table 1 preferably corresponds to a preferred embodiment and wherein Table 1 provides the necessary information concerning the therapeutic protein, the respective database entry, the amino acid sequence of the therapeutic protein, the nucleic acid sequences of preferred RNA's encoding the therapeutic protein as well as one or more disease, disorder or condition, for the treatment or prevention of which the peptide or protein is preferably used.

More preferably, each entry (i.e. peptide or protein of the invention as represented by the formula "c1(Peptide or protein or gene) c2(NCBI Ref Seq ID) c3(Protein SEQ ID NO) c4(RNA SEQ ID NOs) c5(Related disease, disorder or condition)") in Table 1 corresponds to a preferred embodiment of the present invention, wherein feature c4 indicates a nucleic acid sequence that may be comprised (in its entirety or a fragment or variant thereof as defined herein) in the at least one coding sequence of the RNA according to the invention. That coding sequence encodes the peptide or protein identified in features c1, c2 and c3, or a fragment or variant thereof. Feature c5 indicates one or more disease, disorder or condition, for the treatment or prevention of which the peptide or protein is preferably used, whereby the abbreviations as disclosed under feature c5 are to be read from the Abbreviation Dictionary for the "Related disease, disorder or condition" as shown in Table C, whereby each abbreviation is depicted with a specific "Related disease, disorder or condition" in written form as described above.

For example, the at least one coding region of the RNA according to the invention may encode the protein "AASDH" (see Table 1, entry "c1(AASDH) c2(NP_001273597) c3(27) c4(25141, 39198, 52255, 13084, 55312) c5(ar)"), as identified by the NCBI Ref Seq ID "NP 001273597" (see c2 of that entry). The full-length amino acid sequence of AASDH as used herein is defined by SEQ ID NO: 27 (see c3 of that entry). Preferred nucleic acid sequences (SEQ ID NO: 25141, 39198, 52255, 13084 and 55312) are identified under c4 of that entry (see c4 of that entry). Hence, in a preferred embodiment, the RNA according to the invention may comprise at least one coding sequence comprising or consisting of a nucleic acid sequence as identified under c4 of that entry, such as SEQ ID NO: 25141, 39198, 52255, 13084 or 55312, or a fragment or variant of any of these sequences. Preferably, said RNA is used for treatment or prevention, preferably as described herein, for the disease specified under c5, namely for treatment or prevention of "ar" which according to the Abbreviation Dictionary for the "Related disease, disorder or condition" as shown in Table C corresponds to adenocarcinoma (see c5 of that entry).

Where reference is made herein to a "therapeutic protein according to Table 1", a "peptide or protein of Table 1" or to a "nucleic acid sequence encoding a therapeutic protein according to Table 1", it is typically referred to one of the embodiments as defined by any one of the entries in Table 1, wherein one of the nucleic acid sequences specified under c4 in that entry, or fragments or variants thereof, are preferably used for treatment or prevention of a disease, disorder or condition specified under c5 in that entry, taken into consideration formula "c1(Peptide or protein or gene) c2(NCBI Ref Seq ID) c3(Protein SEQ ID ND) c4(RNA SEQ ID NOs) c5(Related disease, disorder or condition)" and the Abbreviation Dictionary for c5 in Table C as described above.

It is thus further preferred that the at least one coding sequence of the RNA of the present invention encodes a peptide or protein comprising or consisting of a therapeutic protein, or a fragment or variant of said therapeutic protein, wherein the therapeutic protein is a peptide or protein identified in Table 1, preferably under feature c1, c2 or c3 in Table 1. More preferably, the at least one coding sequence of the RNA according to the invention comprises or consists any one of the nucleic acid sequences provided in Table 1, or a fragment or variant of any one of these sequences, preferably as defined herein.

According to a preferred embodiment, the present invention concerns an RNA comprising at least one coding sequence encoding a peptide or protein comprising or consisting of a therapeutic protein, or a fragment or variant of said therapeutic protein, wherein the therapeutic protein preferably comprises or consists of any one of the amino acid sequences defined in feature c3 of Table 1, or a fragment or variant of any one of these sequences. In other words, the at least one coding sequence preferably encodes a peptide or protein comprising or consisting of a therapeutic protein, wherein the therapeutic protein comprises or consists of an amino acid sequence selected from the group consisting of amino acid sequences according to any one of SEQ ID NO: 1 to 13057, or a fragment or variant of any one of said amino acid sequences.

The at least one coding sequence of the RNA according to the invention preferably comprises or consists of a nucleic acid sequence encoding a peptide or protein comprising or consisting of a full-length therapeutic protein or a full-length variant of a therapeutic protein as defined herein. The term "full-length therapeutic protein" or "full-length variant of a therapeutic protein" as used herein typically refers to a peptide or protein that substantially comprises the entire amino acid sequence of the reference protein, such as the naturally occurring therapeutic protein. As used herein, the term "full-length therapeutic protein" preferably relates to the full-length sequence of a peptide or protein specified in Table 1. More preferably, the term "full-length therapeutic protein" refers to an amino acid sequence as defined by any one of the SEQ ID NO:'s listed under feature c3 of Table 1 or to an amino acid sequence provided in the NCBI database under the Ref Seq ID specified under feature c2 of Table 1.

Alternatively, the at least one coding sequence of the RNA according to the invention may also comprise a nucleic acid sequence encoding a peptide or protein comprising or consisting of a fragment of a therapeutic protein or a fragment of a variant of a therapeutic protein as defined herein.

In the context of the present invention, a "fragment" of a therapeutic protein or of a variant thereof may comprise a sequence of a therapeutic protein or of a variant thereof as defined above, which is, with regard to its amino acid sequence (or its encoded nucleic acid sequence), N-terminally, C-terminally and/or intrasequentially truncated compared to the reference amino acid sequence, such as the amino acid sequence of the naturally occurring protein or a variant thereof (or its encoded nucleic acid sequence) or a peptide or protein as specified in Table 1 or a variant thereof. Such truncation may occur either on the amino acid level or on the nucleic acid level, respectively. A sequence identity with respect to such a fragment as defined herein therefore preferably refers to the entire therapeutic protein or a variant thereof as defined herein or to the entire (coding) nucleic acid sequence of such an a therapeutic protein or of a variant thereof.

According to a preferred embodiment of the invention, the RNA comprises at least one coding sequence encoding a peptide or protein comprising or consisting of a variant of a therapeutic protein as defined herein, or a fragment of a variant of a therapeutic protein.

In certain embodiments of the present invention, a "variant" of a therapeutic protein or a fragment thereof as defined herein may be encoded by the RNA comprising at least one coding sequence as defined herein, wherein the amino acid sequence encoded by the at least one coding sequence differs in at least one amino acid residue from the reference amino acid sequence, such as a naturally occurring amino acid sequence or an amino acid sequence as indicated in Table 1. In this context, the "change" in at least one amino acid residue may consist, for example, in a mutation of an amino acid residue to another amino acid, a deletion or an insertion. More preferably, the term "variant" as used in the context of the amino acid sequence encoded by the at least one coding sequence of the RNA according to the invention comprises any homolog, isoform or transcript variant of a therapeutic protein or a fragment thereof as defined herein, wherein the homolog, isoform or transcript variant is preferably characterized by a degree of identity or homology, respectively, as defined herein.

Preferably, a variant of a therapeutic protein or a fragment thereof may be encoded by the RNA comprising at least one coding sequence as defined herein, wherein at least one amino acid residue of the amino acid sequence encoded by the at least one coding sequence is substituted. Substitutions, wherein amino acids, which originate from the same class, are exchanged for one another, are called conservative substitutions. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)). In a preferred embodiment, a variant of a therapeutic protein or a fragment thereof may be encoded by the RNA according to the invention, wherein at least one amino acid residue of the amino acid sequence encoded by the at least one coding sequence comprises at least one conservative substitution compared to a reference sequence, such as the respective naturally occurring sequence or a sequence indicated in Table 1. These amino acid sequences as well as their encoding nucleic acid sequences in particular are comprised by the term "variant" as defined herein.

Insertions, deletions and/or non-conservative substitutions are also possible, in particular, at those sequence positions, which preferably do not cause a substantial modification of the three-dimensional structure. Modifications to a three-dimensional structure by insertion(s) or deletion(s) can easily be determined e.g. using CD spectra (circular dichroism spectra) (Limy, 1985, Absorption, Circular Dichroism and ORD of Polypeptides, in: Modern Physical Methods in Biochemistry, Neuberger et al. (ed.), Elsevier, Amsterdam).

In order to determine the percentage, to which two sequences (nucleic acid sequences, e.g. RNA or mRNA sequences as defined herein, or amino acid sequences, preferably the amino acid sequence encoded by the RNA according to the invention) are identical, the sequences can be aligned in order to be subsequently compared to one another. For this purpose, e.g. gaps can be inserted into the sequence of the first sequence and the component at the corresponding position of the second sequence can be compared. If a position in the first sequence is occupied by the same component as is the case at a corresponding position in the second sequence, the two sequences are identical at this position. The percentage, to which two sequences are identical, is a function of the number of identical positions divided by the total number of positions. The percentage, to which two sequences are identical, can be determined using a mathematical algorithm. A preferred, but not limiting, example of a mathematical algorithm, which can be used is the algorithm of Karlin et al. (1993), PNAS USA, 90:5873-5877 or Altschul et al. (1997), Nucleic Acids Res., 25:3389-3402. Such an algorithm is integrated, for example, in the BLAST program. Sequences, which are identical to the sequences of the present invention to a certain extent, can be identified by this program.

A fragment of a therapeutic protein or a variant thereof encoded by the at least one coding sequence of the RNA according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a reference amino acid sequence, preferably with the amino acid sequence of the respective naturally occurring full-length therapeutic protein or a variant thereof, more preferably with the amino acid sequence of a peptide or protein specified in Table 1 or a variant thereof.

More preferably, a fragment of a therapeutic protein or a variant thereof encoded by the at least one coding sequence of the RNA according to the invention may typically comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of a protein selected from the peptides or proteins indicated in Table 1 or a variant thereof. Even more preferably, a fragment of a therapeutic protein or a variant thereof encoded by the at least one coding sequence of the RNA according to the invention may typically comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences defined in feature c3 of Table 1, or a fragment or variant of any one of these sequences.

Most preferably, a fragment of a therapeutic protein or a variant thereof encoded by the at least one coding sequence of the RNA according to the invention typically comprises or consists of an amino acid sequence having a sequence identity of at least 80% with any one of the amino acid sequences defined in feature c3 of Table 1, or a fragment or variant of any one of these sequences.

Preferably, the therapeutic protein encoded by the at least one coding sequence of the RNA is a therapeutic protein as defined herein, which is encoded by a nucleic acid sequence comprising or consisting of any one of the nucleic acid sequences encoding a peptide or protein as defined in features c1, c2 or c3 of every peptide or protein entry of Table 1, or a fragment or variant of any one of these sequences. More preferably, the therapeutic protein is encoded by a naturally occurring nucleic acid sequence comprising or consisting of any one of the nucleic acid sequences encoding a peptide or protein as defined in features c1, c2 or c3 of every peptide or protein entry of Table 1, or a fragment or variant of any one of these sequences. Even more preferably, the therapeutic protein is encoded by a nucleic acid sequence comprising or consisting of any one of the nucleic acid sequences encoding a peptide or protein as defined in features c1, c2 or c3 of every peptide or protein entry of Table 1, or a fragment or variant of any one of these sequences, wherein the nucleic acid sequence encoding a peptide or protein as defined in feature c1, c2 or c3 of every peptide or protein entry of Table 1 is preferably a modified nucleic acid sequence, more preferably as defined herein, which differs in at least one nucleotide residue from a corresponding naturally occurring nucleic acid sequence.

Preferably, the therapeutic protein encoded by the at least one coding sequence of the RNA is a therapeutic protein as defined herein, which is encoded by a nucleic acid sequence comprising or consisting of any one of the nucleic acid sequences defined in feature c4 of Table 1, or a fragment or variant of any one of these sequences. In other words, the therapeutic protein encoded by the at least one coding sequence of the RNA is preferably a therapeutic protein as defined herein, which is preferably encoded by a nucleic acid sequence comprising or consisting of a nucleic acid sequence selected from the group consisting of nucleic acid sequences according to any one of SEQ ID NO: 13058 to 78342, or a fragment or variant of any of these sequence.

In a preferred embodiment, the present invention thus provides an RNA comprising at least one coding sequence, wherein the coding sequence comprises or consists any one of the nucleic acid sequences defined in feature c4 of Table 1, or a fragment or variant of any one of these sequences.

In certain embodiments, the RNA according to the invention, preferably the at least one coding sequence of the RNA according to the invention, may comprise or consist of a fragment of a nucleic acid sequence encoding a therapeutic protein or a fragment or variant thereof as defined herein. Preferably, the at least one coding sequence of the RNA according to the invention comprises or consists of a fragment, preferably as defined herein, of any one of the nucleic acid sequences defined in feature c4 of Table 1, or a fragment or variant of any one of these sequences.

In this context, a "fragment of a nucleic acid sequence" is preferably a nucleic acid sequence encoding a fragment of a therapeutic protein or of a variant thereof as described herein. More preferably, the expression "fragment of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a respective full-length nucleic acid sequence.

In another preferred embodiment, the RNA according to the invention, preferably the at least one coding sequence of the RNA according to the invention, may comprise or consist of a variant of a nucleic acid sequence as defined herein, preferably of a nucleic acid sequence encoding a therapeutic protein or a fragment thereof as defined herein.

The expression "variant of a nucleic acid sequence" as used herein in the context of a nucleic acid sequence encoding a therapeutic protein or a fragment thereof, typically refers to a nucleic acid sequence, which differs by at least one nucleic acid residue from the respective reference nucleic acid sequence, preferably from the respective naturally occurring nucleic acid sequence encoding a therapeutic protein or a fragment thereof, more preferably from a corresponding nucleic acid sequence specified in Table 1. More preferably, the expression "variant of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

Preferably, the RNA according to the invention, more preferably the at least one coding sequence of the RNA according to the invention, encodes a variant of a therapeutic protein or a fragment thereof, preferably as defined herein.

In a preferred embodiment, the RNA according to the invention, more preferably the at least one coding sequence of the RNA according to the invention, comprises or consists of a variant of a nucleic acid sequence encoding a therapeutic protein or a fragment thereof as defined herein, wherein the variant of the nucleic acid sequence encodes an amino acid sequence comprising at least one conservative substitution of an amino acid residue.

In another embodiment, the RNA according to the invention, more preferably the at least one coding sequence of the RNA according to the invention, comprises or consists of a variant of a nucleic acid sequence encoding a therapeutic protein or a fragment thereof as defined herein, wherein the nucleic acid sequence of the variant differs a reference nucleic acid sequence, preferably from the respective naturally occurring nucleic acid sequence in at least one nucleic acid residue, more preferably without resulting—due to the degenerated genetic code—in an alteration of the encoded amino acid sequence, i.e. the amino acid sequence encoded by the variant or at least part thereof may preferably not differ from the naturally occurring amino acid sequence in one or more mutation(s) within the above meaning.

Furthermore, a "variant" of a nucleic acid sequence encoding a therapeutic protein or a fragment or variant thereof as defined herein, may also comprise DNA sequences, which correspond to RNA sequences as defined herein and may also comprise further RNA sequences, which correspond to DNA sequences as defined herein. Those skilled in the art are familiar with the translation of an RNA sequence into a DNA sequence (or vice versa) or with the creation of the complementary strand sequence (i.e. by substitution of U residues with T residues and/or by constructing the complementary strand with respect to a given sequence).

According to a preferred embodiment, the at least one coding sequence of the RNA according to the invention comprises or consists of a nucleic acid sequence having a sequence identity of at least 5%, 10%, 20%, 30%, 40%, 50%, 60%, 70%, BR, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a reference nucleic acid sequence, preferably with a nucleic acid sequence encoding a naturally occurring full-length therapeutic protein as defined herein, or a variant thereof.

In a further preferred embodiment, the at least one coding sequence of the RNA according to the invention comprises or consists of a nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences defined in feature c4 of Table 1, or a fragment or variant thereof. According to a particularly preferred embodiment, the at least one coding sequence of the RNA according to the invention comprises or consists of a nucleic acid sequence having a sequence identity of at least 80% with any one of the nucleic acid sequences defined in feature c4 of Table 1, or a fragment or variant of any one of these sequences.

In a further preferred embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, BR, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences defined in feature c4 of Table 1, or a fragment or variant of any one of these sequences. In other words, the at least one coding sequence of the RNA according to the invention preferably comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of nucleic acid sequences according to any one of SEQ ID NO: 13058 to 78342, or a fragment or variant of any one of said nucleic acid sequences. According to a particularly preferred embodiment, the at least one coding sequence of the RNA according to the invention comprises or consists of a nucleic acid sequence having a sequence identity of at least 80% with any one of the nucleic acid sequences defined in feature c4 of Table 1, or a fragment or variant of any one of these sequences.

According to certain embodiments of the present invention, the RNA is mono-, bi-, or multicistronic, preferably as defined herein. The coding sequences in a bi- or multicistronic RNA preferably encode distinct therapeutic protein as defined herein or a fragment or variant thereof. Preferably, the coding sequences encoding two or more peptides or proteins may be separated in the bi- or multicistronic RNA by at least one IRES (internal ribosomal entry site) sequence, as defined below. Thus, the term "encoding two or more therapeutic proteins" may mean, without being limited thereto, that the bi- or even multicistronic RNA, may encode e.g. at least two, three, four, five, six or more (preferably different) peptides or proteins of the therapeutic proteins or their fragments or variants within the definitions provided herein. More preferably, without being limited thereto, the bi- or even multicistronic mRNA, may encode, for example, at least two, three, four, five, six or more (preferably different) therapeutic proteins as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several therapeutic proteins, which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

According to a further embodiment the at least one coding sequence of the RNA according to the invention may encode at least two, three, four, five, six, seven, eight and more therapeutic proteins (or fragments or variants thereof) as defined herein linked with or without an amino acid linker sequence, wherein said linker sequence can comprise rigid linkers, flexible linkers, cleavable linkers (e.g., self-cleaving peptides) or a combination thereof. Therein, the therapeutic proteins (or fragments or variants thereof) may be identical or different or a combination thereof.

Preferably, the at least one coding sequence of the RNA according to the invention comprises at least two, three, four, five, six, seven, eight or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences disclosed in feature c4 of Table 1 herein, or a fragment or variant of any one of said nucleic acid sequences.

Preferably, the RNA comprising at least one coding sequence as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

The RNA according to the invention may further be single stranded or double stranded. When provided as a double stranded RNA, the RNA according to the invention preferably comprises a sense and a corresponding antisense strand.

In a preferred embodiment, the RNA comprising at least one coding sequence as defined herein is an mRNA, a viral RNA or a replicon RNA.

According to a further embodiment, the RNA, preferably an mRNA, according to the invention is a modified RNA, preferably a modified RNA as described herein. In this context, a modification as defined herein preferably leads to a stabilization of the RNA according to the invention. More preferably, the invention thus provides a stabilized RNA comprising at least one coding sequence as defined herein.

According to one embodiment, the RNA of the present invention may thus be provided as a "stabilized mRNA", that is to say as an RNA that is essentially resistant to in vivo degradation (e.g. by an exo- or endo-nuclease). Such stabilization can be effected, for example, by a modified phosphate backbone of the RNA of the present invention. A backbone modification in connection with the present invention is a modification, in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the RNA as defined herein.

Chemical Modifications:

The term "RNA modification" as used herein may refer to chemical modifications comprising backbone modifications as well as sugar modifications or base modifications.

In this context, a modified RNA as defined herein may contain nucleotide analogues/modifications, e.g. backbone modifications, sugar modifications or base modifications. A backbone modification in connection with the present invention is a modification, in which phosphates of the backbone of the nucleotides contained in an RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues, which are applicable for transcription and/or translation.

Sugar Modifications:

The modified nucleosides and nucleotides, which may be incorporated into a modified RNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (–OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified RNA can include nucleotides containing, for instance, arabinose as the sugar.

Backbone Modifications:

The phosphate backbone may further be modified in the modified nucleosides and nucleotides, which may be incorporated into a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified RNA as described herein can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-5-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2-deoxycytidine-5'-triphosphate, 5-Bromo-2-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2-deoxyuridine-5'-triphosphate, 5-methylcytidine-5'-triphosphate, 5-methyluridine-5'-triphosphate, 5-Propynyl-2-deoxycytidine-5'-triphosphate, 5-Propynyl-2-deoxyuridine-5'-triphosphate, 5-azacytidine-5'-triphosphate, 6-azauridine-5'-triphosphate, 5-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5"-triphosphate, 7-deazaguanosine-5"-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyluridine, 1-carboxymethyl-pseudouridine, 5-propynyluridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,5-diaminopurine, 7-deaza-8-aza-2,5-diaminopurine, 1-methyladenosine, N6-methyladenosine, N6-isopentenyladenosine, N6-(cis-hydroxyisopentenyl)adenosine, 2-methylthio-N5-(cis-hydroxyisopentenyl) adenosine, N6-glycinylcarbamoyladenosine, N6-threonylcarbamoyladenosine, 2-methylthio-N6-threonyl carbamoyladenosine, 1I5,115-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 5-thio-guanosine, 5-thio-7-deaza-guanosine, 5-thio-7-deaza-8-aza-guanosine, 7-methyl-guanosine, 5-thio-7-methyl-guanosine, 7-methyl-inosine, 5-methoxy-guanosine, 1-methylguanosine, N2-methylguanosine, N2,N2-dimethylguanosine, 8-oxo-guanosine, 7-methyl-8-oxo-guanosine, 1-methyl-5-thio-guanosine, N2-methyl-5-thio-guanosine, and N2,N2-dimethyl-5-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified RNA may comprise nucleoside modifications selected from 5-aza-cytidine, 2-thio-cytidine, α-thio-cytidine, Pseudo-iso-cytidine, 5-aminoallyl-uridine, 5-iodo-uridine, N1-methyl-pseudouridine, 5,5-dihydrouridine, α-thio-uridine, 4-thio-uridine, 5-aza-uridine, 5-hydroxy-uridine, deoxy-thymidine, 5-methyl-uridine, Pyrrolo-cytidine, inosine, α-thio-guanosine, 5-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Lipid Modification:

According to a further embodiment, a modified RNA as defined herein can contain a lipid modification. Such a lipid-modified RNA typically comprises an RNA as defined herein. Such a lipid-modified RNA as defined herein typically further comprises at least one linker covalently linked with that RNA, and at least one lipid covalently linked with the respective linker. Alternatively, the lipid-modified RNA comprises at least one RNA as defined herein and at least one (bifunctional) lipid covalently linked (without a linker) with that RNA. According to a third alternative, the lipid-modified RNA comprises an RNA molecule as defined herein, at least one linker covalently linked with that RNA, and at least one lipid covalently linked with the respective linker, and also at least one (bifunctional) lipid covalently linked (without a linker) with that RNA. In this context, it is particularly preferred that the lipid modification is present at the terminal ends of a linear RNA sequence.

G/C Content Modification:

According to another embodiment, the RNA of the present invention, preferably an mRNA, may be modified, and thus stabilized, by modifying the guanosine/cytosine (G/C) content of the RNA, preferably of the at least one coding sequence of the RNA of the present invention.

In a particularly preferred embodiment of the present invention, the G/C content of the coding sequence (coding region) of the RNA of the present invention is modified, particularly increased, compared to the G/C content of the coding region of the respective wild type RNA, i.e. the unmodified RNA. The amino acid sequence encoded by the RNA is preferably not modified as compared to the amino acid sequence encoded by the respective wild type RNA. This modification of the RNA of the present invention is based on the fact that the sequence of any RNA region to be translated is important for efficient translation of that RNA. Thus, the composition of the RNA and the sequence of various nucleotides are important. In particular, sequences having an increased G (guanosine)/C (cytosine) content are more stable than sequences having an increased A (adenosine)/U (uracil) content. According to the invention, the codons of the RNA are therefore varied compared to the respective wild type RNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the RNA, there are various possibilities for modification of the RNA sequence, compared to its wild type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CH or CEG; the codons for Arg can be modified from GCU or EGA or AGA or AGG to CGC or EGG; the codons for Ala can be modified from GEU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUE; the codons for Leu can be modified from UUA, UUG, CUU or CUA to CUC or CUG; the codons for Ser can be modified from GCU or UCA or AGU to UCC, UCG or AGE; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUG; the codons for Thr can be modified from ACU or ACA to ACC or AEG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or USA. In the case of the codons for Met (AUG) and Trp (UGG), on the other hand, there is no possibility of sequence modification. The substitutions listed above can be used either individually or in all possible combinations to increase the G/C content of the at least one mRNA of the composition of the present invention compared to its particular wild type mRNA (i.e. the original sequence). Thus, for example, all codons for Thr occurring in the wild type sequence can be modified to ACC (or ACG). Preferably, however, for example, combinations of the above substitution possibilities are used:

substitution of all codons coding for Thr in the original sequence (wild type mRNA) to ACC (or AEG) and
substitution of all codons originally coding for Ser to UCC (or UCG or AGE); substitution of all codons coding for Ile in the original sequence to AUC and
substitution of all codons originally coding for Lys to AAG and
substitution of all codons originally coding for Tyr to UAC; substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Arg to CGc (or EGG); substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Gly to GGC (or GGG) and
substitution of all codons originally coding for Asn to AAC; substitution of all codons coding for Val in the original sequence to GUC (or GUG) and
substitution of all codons originally coding for Phe to UUC and
substitution of all codons originally coding for Cys to UGC and
substitution of all codons originally coding for Leu to CUG (or CUE) and
substitution of all codons originally coding for Gln to CAG and
substitution of all codons originally coding for Pro to CCC (or CCG); etc.

Preferably, the G/C content of the coding region of the RNA of the present invention is increased by at least 7%, more preferably by at least 15%, particularly preferably by at least 20%, compared to the G/C content of the coding region of the wild type RNA, which codes for a therapeutic protein as defined herein or a fragment or variant thereof. According to a specific embodiment at least 5%, 10%, 20%, 30%, 40%, 50%, 80%, more preferably at least 70%, even more preferably at least BO % and most preferably at least 90%, 95% or even 100% of the substitutable codons in the region coding for a therapeutic protein as defined herein or a fragment or variant thereof or the whole sequence of the wild type RNA sequence are substituted, thereby increasing the GC/content of said sequence. In this context, it is particularly preferable to increase the G/C content of the RNA of the present invention, preferably of the at least one coding region of the RNA according to the invention, to the maximum (i.e. 100% of the substitutable codons) as compared to the wild type sequence. According to the invention, a further preferred modification of the RNA of the present invention is based on the finding that the translation efficiency is also determined by a different frequency in the occurrence of tRNAs in cells. Thus, if so-called "rare codons" are present in the RNA of the present invention to an increased extent, the corresponding modified RNA sequence is translated to a significantly poorer degree than in the case where codons coding for relatively "frequent" tRNAs are present. According to the invention, in the modified RNA of the present invention, the region which codes for a therapeutic protein as defined herein or a fragment or variant thereof is modified compared to the corresponding region of the wild type RNA such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequences of the RNA of the present invention is modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(8): BBD-BBB. The codons, which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified RNA of the present invention, with the "frequent" codons without modifying the amino acid sequence of the protein encoded by the coding region of the RNA. This preferred embodiment allows provision of a particularly efficiently translated and stabilized (modified) RNA of the present invention. The determination of a modified RNA of the present invention as described above (increased G/C content; exchange of tRNAs) can be carried out using the computer program explained in WO 02/098443 the disclosure content of which is included in its full scope in the present invention. Using this computer program, the nucleotide sequence of any desired RNA can be modified with the aid of the genetic code or the degenerative nature thereof such that a maximum G/C content results, in combination with the use of codons which code for tRNAs occurring as frequently as possible in the cell, the amino acid sequence coded by the modified RNA preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the RNA of the present invention is increased compared to the A/U content in the environment of the ribosome binding site of its respective wild type mRNA. This modification (an increased A/U content around the ribosome binding site) increases the efficiency of ribosome binding to the RNA. An effective binding of the ribosomes to the ribosome binding site (Kozak sequence: SEQ ID NO: 801; the AUG forms the start codon) in turn has the effect of an efficient translation of the RNA. According to a further embodiment of the present invention, the RNA of the present invention may be modified with respect to potentially destabilizing sequence elements. Particularly, the coding region and/or the 5' and/or 3' untranslated region of this RNA may be modified compared to the respective wild type RNA such that it contains no destabilizing sequence elements, the encoded amino acid sequence of the modified RNA preferably not being modified compared to its respective wild type RNA. It is known that, for example in sequences of eukaryotic RNAs, destabilizing sequence elements (DSE) occur, to which signal proteins bind and regulate enzymatic degradation of RNA in vivo. For further stabilization of the modified RNA, optionally in the region which encodes a therapeutic protein as defined herein or a fragment or variant thereof, one or more such modifications compared to the corresponding region of the wild type RNA can therefore be carried out, so that no or substantially no destabilizing sequence elements are contained there. According to the invention, DSE present in the untranslated regions (3'- and/or 5'-UTR) can also be eliminated from the RNA of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The RNA of the present invention is therefore preferably modified compared to the respective wild type RNA such that the RNA of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed in the RNA of the present invention.

According to a preferred embodiment, the present invention provides an RNA as defined herein comprising at least one coding sequence, wherein the coding sequence comprises or consists of any one of the (modified) nucleic acid sequences defined in feature c4 of Table 1, or of a fragment or variant of any one of these sequences. In other words, the at least one coding sequence preferably comprises or consists of a nucleic acid sequence selected from the group consisting of nucleic acid sequences according to any one of SEQ ID NO: 13058 to 78342, or a fragment or variant of any one of these nucleic acid sequences.

In a further preferred embodiment, the at least one coding sequence of the RNA according to the invention comprises or consists of a nucleic acid sequence identical to or having a sequence identity of at least 5%, 10%, 20%, 30%, 40%, 50%, 60%, 70%, 80%, 85%, 86%, 87%, BR, 89%, 90%, 91%, 92%, 93%, 94%, 95%, 98%, 97%, 98%, or 99%, preferably of at least 70%, more preferably of at least 80%, even more preferably at least 85%, even more preferably of at least 90% and most preferably of at least 95% or even 97%, with any one of the (modified) nucleic acid sequences defined in feature c4 of Table 1, or of a fragment or variant of any one of these sequences.

According to a particularly preferred embodiment, the at least one coding sequence of the RNA according to the invention comprises or consists of a nucleic acid sequence having a sequence identity of at least 80% with any one of the (modified) nucleic acid sequences defined in feature c4 of Table 1, or of a fragment or variant of any one of these sequences.

GC-Optimized Sequences:

In a preferred embodiment, the present invention provides an RNA comprising at least one coding sequence, wherein the coding sequence comprises or consists of a nucleic acid sequence selected from the group consisting of nucleic acid sequences according to any one of SEQ ID NO: 28115 to 39171 or SEQ ID NO: 85288 to 78342, or a fragment or variant of any one of these nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, BR, 89%, 90%, 91%, 92%, 93%, 94%, 95%, 98%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of nucleic acid sequences according to any one of SEQ ID NO: 28115 to 39171 or SEQ ID NO: 85288 to 78342, or a fragment or variant of any one of these nucleic acid sequences.

Sequences Adapted to Human Codon Usage:

According to the invention, a further preferred modification of the RNA of the present invention is based on the finding that codons encoding the same amino acid typically occur at different frequencies. According to the invention, in the modified RNA of the present invention, the coding sequence (coding region) as defined herein is preferably modified compared to the corresponding region of the respective wild type RNA such that the frequency of the codons encoding the same amino acid corresponds to the naturally occurring frequency of that codon according to the human codon usage as e.g. shown in Table B.

For example, in the case of the amino acid alanine (Ala) present in an amino acid sequence encoded by the at least one coding sequence of the RNA according to the invention, the wild type coding sequence is preferably adapted in a way that the codon "GCC" is used with a frequency of 0.40, the codon "GST" is used with a frequency of 0.28, the codon "GCA" is used with a frequency of 0.22 and the codon "GCG" is used with a frequency of 0.10 etc. (see Table B).

TABLE B

| Human codon usage table | | | | | | | |
|---|---|---|---|---|---|---|---|
| Amino acid | codon | fraction | /1000 | Amino acid | codon | fraction | /1000 |
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | AGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |

TABLE B-continued

Human codon usage table

| Amino acid | codon | fraction | /1000 | Amino acid | codon | fraction | /1000 |
|---|---|---|---|---|---|---|---|
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TAA | 0.22 | 1.0 |

*most frequent codon

In a preferred embodiment, the present invention provides an RNA comprising at least one coding sequence, wherein the coding sequence comprises a nucleic acid sequence selected from the group consisting of nucleic acid sequences according to any one of SEQ ID NO: 52229 to 65285, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, BR, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of nucleic acid sequences according to any one of SEQ ID NO: 52229 to 65285, or a fragment or variant of any one of said nucleic acid sequences.

Codon-Optimized Sequences:

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table B, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the RNA of the present invention comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

In a preferred embodiment, the present invention provides an RNA comprising at least one coding sequence, wherein the coding sequence comprises a nucleic acid sequence selected from the group consisting of nucleic acid sequences according to any one of SEQ ID NO: 13058 to 26114, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, BR, 85%, 86%, 87%, BR, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of nucleic acid sequences according to any one of SEQ ID NO: 13058 to 26114, or a fragment or variant of any one of said nucleic acid sequences.

C-Optimized Sequences:

According to another embodiment, the RNA of the composition of the present invention may be modified by modifying, preferably increasing, the cytosine (C) content of the RNA, preferably of the coding region of the sRNA. In a particularly preferred embodiment of the present invention, the C content of the coding region of the RNA of the present invention is modified, preferably increased, compared to the C content of the coding region of the respective wild type RNA, i.e. the unmodified RNA. The amino acid sequence encoded by the at least one coding sequence of the RNA of the present invention is preferably not modified as compared to the amino acid sequence encoded by the respective wild type mRNA.

In a preferred embodiment of the present invention, the modified RNA is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target RNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified mRNA sequence. According to a preferred embodiment, the RNA of the present invention, preferably the at least one coding sequence of the RNA of the present invention comprises or consists of a C-maximized RNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or
the codon UGU that codes for Cys may be exchanged by the codon UGC encoding the same amino acid, and/or
the codon GAU which codes for Asp may be exchanged by the codon GAC encoding the same amino acid, and/or
the codon that UUU that codes for Phe may be exchanged for the codon UUC encoding the same amino acid, and/or
any of the codons GGG, GGA, GGU that code Gly may be exchanged by the codon GGC encoding the same amino acid, and/or
the codon CAU that codes for His may be exchanged by the codon CAC encoding the same amino acid, and/or
any of the codons AUA, An that code for Ile may be exchanged by the codon AUC, and/or
any of the codons UUG, UUA, CUG, CUA, CUU coding for Leu may be exchanged by the codon CUC encoding the same amino acid, and/or
the codon AAU that codes for Asn may be exchanged by the codon AAC encoding the same amino acid, and/or
any of the codons CCG, CCA, CCU coding for Pro may be exchanged by the codon CCC encoding the same amino acid, and/or
any of the codons AGG, AGA, EGG, EGA, CGU coding for Arg may be exchanged by the codon CGC encoding the same amino acid, and/or
any of the codons AGU, AGE, UCG, UCA, UCU coding for Ser may be exchanged by the codon UCC encoding the same amino acid, and/or
any of the codons ACG, ACA, ACU coding for Thr may be exchanged by the codon ACC encoding the same amino acid, and/or
any of the codons GUG, GUA, GUU coding for Val may be exchanged by the codon GUC encoding the same amino acid, and/or
the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the RNA according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized RNA of the invention, at least 50% of the C-optimizable wild type codons for any given amino acid are replaced by C-optimized codons, e.g. any modified C-enriched RNA preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or
the relatively rare codon AAA coding for Lys may be exchanged by the relative frequent codon AAG coding for the same amino acid, and/or
the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (USA).

The single substitutions listed above may be used individually as well as in all possible combinations in order to optimize the cytosine-content of the modified RNA compared to the wild type mRNA sequence.

Accordingly, the at least one coding sequence as defined herein may be changed compared to the coding region of the respective wild type RNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

In a preferred embodiment, the present invention provides an RNA comprising at least one coding sequence, wherein the coding sequence comprises a nucleic acid sequence selected from the group consisting of nucleic acid sequences according to any one of SEQ ID NO: 39172 to 52228, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, BR, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of nucleic acid sequences according to any one of SEQ ID NO: 39172 to 52228, or a fragment or variant of any one of said nucleic acid sequences.

According to a particularly preferred embodiment, the invention provides an RNA, preferably an mRNA, comprising at least one coding sequence as defined herein, wherein the G/C content of the at least one coding sequence of the RNA is increased compared to the G/C content of the corresponding coding sequence of the corresponding wild type RNA, and/or
wherein the C content of the at least one coding sequence of the RNA is increased compared to the C content of the corresponding coding sequence of the corresponding wild type RNA, and/or
wherein the codons in the at least one coding sequence of the RNA are adapted to human codon usage, wherein the codon adaptation index (CAI) is preferably increased or maximised in the at least one coding sequence of the RNA, and wherein the amino acid sequence encoded by the RNA is preferably not being modified compared to the amino acid sequence encoded by the corresponding wild type RNA.

According to another preferred embodiment of the invention, a modified RNA as defined herein, can be modified by the addition of a so-called "5' cap" structure, which preferably stabilizes the RNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a modified RNA of the present invention may comprise a m7GpppN as 5'-cap, but additionally the modified RNA typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), AREA (anti-reverse cap analogue, modified AREA (e.g. phosphothioate modified AREA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

In a preferred embodiment, the RNA according to the invention comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding sequence of the RNA of the invention. Even if 5'- or 3'-UTR elements derived from naturally occurring genes are preferred, also synthetically engineered UTR elements may be used in the context of the present invention.

The term "3'-UTR element" typically refers to a nucleic acid sequence, which comprises or consists of a nucleic acid sequence that is derived from a 3'-UTR or from a variant of a 3'-UTR. A 3'-UTR element in the sense of the present invention may represent the 3'-UTR of an RNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence which fulfils the function of a 3'-UTR.

According to a preferred embodiment, the RNA, preferably an mRNA, according to the invention comprises a 5'-cap structure and/or at least one 3'-untranslated region element (3'-UTR element), preferably as defined herein. More preferably, the RNA further comprises a 5'-UTR element as defined herein.

According to a further preferred embodiment, the RNA of the present invention may contain a poly-A tail on the 3' terminus of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the RNA of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art.

Alternatively, the RNA as described herein optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

According to a further preferred embodiment, the RNA of the present invention may contain a poly(C) tail on the 3' terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

In a further preferred embodiment, the RNA according to the invention further comprises at least one 3'-UTR element. Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the RNA of the present invention comprises a 3'-UTR element, which may be derivable from a gene that relates to an mRNA with an enhanced half-life (that provides a stable mRNA), for example a 3'-UTR element as defined and described below. Preferably, the 3'-UTR element is a nucleic acid sequence derived from a 3'-UTR of a gene, which preferably encodes a stable mRNA, or from a homolog, a fragment or a variant of said gene In a particularly preferred embodiment, the 3'-UTR element comprises or consists of a nucleic acid sequence, which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NO: 1369-1390 of the patent application WO 2013/143700, whose disclosure is incorporated herein by reference, or from a homolog, a fragment or a variant thereof. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NO: 78355 or the corresponding RNA sequence SEQ ID NO:7835G.

```
Human albumin 3'-UTR SEQ ID NO: 78355:
CATCACATTTAAAAGCATCTCAGCCTACCATGAGAATAAGAGAAAGAAAA

TGAAGATCAAAAGCTTATTCATCTGTTTTTCTTTTTCGTTGGTGTAAAGC

CAACACCCTGTCTAAAAAACATAAATTTCTTTAATCATTTTGCCTCTTTT

CTCTGTGCTTCAATTAATAAAAAATGGAAAGAATCT
(corresponding to SEQ ID NO:1369 of the patent
application WO 2013/143700).
```

In this context it is particularly preferred that the RNA according to the invention comprises a 3'-UTR element comprising a corresponding RNA sequence derived from the nucleic acids according to SEQ ID NO: 1369-1390 of the patent application WD 2013/143700 or a fragment, homolog or variant thereof.

Most preferably the 3'-UTR element comprises the nucleic acid sequence derived from a fragment of the human albumin gene according to SEQ ID NO: 78357 or 78359:

```
albumin7 3'-UTR
CATCACATTTAAAAGCATCTCAGCCTACCATGAGAATAAGAGAAAGAAA

ATGAAGATCAATAGCTTATTCATCTCTTTTTCTTTTTCGTTGGTGTAAA

GCCAACACCCTGTCTAAAAAACATAAATTTCTTTAATCATTTTGCCTCT

TTTCTCTGTGCTTCAATTAATAAAAAATGGAAAGAACCT (SEQ ID
NO: 78357 corresponding to SEQ ID NO: 1376
of the patent application WO 2013/143700)
```

In this context, it is particularly preferred that the 3'-UTR element of the RNA according to the present invention comprises or consists of a corresponding RNA sequence of the nucleic acid sequence according to SEQ ID NO: 78357 or 78359 as shown in SEQ ID NO: 78358 or 78360.

In another particularly preferred embodiment, the 3'-UTR element comprises or consists of a nucleic acid sequence which is derived from a 3'-UTR of an α-globin gene, preferably a vertebrate α- or β-globin gene, more preferably a mammalian α- or β-globin gene, most preferably a human α- or β-globin gene according to SEQ ID NO: 78347, 78349 or 78351 or the corresponding RNA sequences SEQ ID NO: 78348, 78350 or 78352:

```
3'-UTR of Homo sapiens hemoglobin, alpha 1
(HBA1)
GCTGGAGCCTCGGTGGCCATGCTTCTTGCCCCTTGGGCCTCCCCCCAGC

CCCTCCTCCCCTTCCTGCACCCGTACCCCCGTGGTCTTTGAATAAAGTC

TGAGTGGGCGGC (SEQ ID NO: 78347 corresponding to
SEQ ID NO: 1370 of the patent application
WO 2013/143700)

3'-UTR of Homo sapiens hemoglobin, alpha 2
(HBA2)
GCTGGAGCCTCGGTAGCCGTTCCTCCTGCCCCGCTGGGCCTCCCAACGGG

CCCTCCTCCCCTCCTTGCACCGGCCCTTCCTGGTCTTTGAATAAAGTCT

GAGTGGGCAG (SEQ ID NO: 78349 corresponding to
SEQ ID NNO: 1371 of the patent application
WO 2013/143700)

3'-UTR of Homo sapiens hemoglobin, beta (HBB)
GCTCGCTTTCTTGCTGTCCAATTTCTATTAAAGGTTCCTTTGTTCCCTA

AGTCCAACTACTAAACTGGGGGATATTATGAAGGGCCTTGAGCATCTGG

ATTCTGCCTAATAAAAAACATTTATTTTCATTGC (SEQ ID NO:
78351 corresponding to SEQ ID NO: 1372 of the
patent application WO 2013/143700)
```

For example, the 3'-UTR element may comprise or consist of the center, α-complex-binding portion of the 3'-UTR of an α-globin gene, such as of a human α-globin gene, or a homolog, a fragment, or a variant of an α-globin gene, preferably according to SEQ ID NO: 78353:

Center, α-complex-binding portion of the 3'-UTR of an α-globin gene (also named herein as "muag") GCCCGATGGGCCTCCCAACGGGCCCTCCTCCCCTCCTTGCACCG (SEQ ID NO: 78353 corresponding to SEQ ID NO: 1393 of the patent application WO 2013/143700).

In this context it is particularly preferred that the 3'-UTR element of the RNA according to the invention comprises or consists of a corresponding RNA sequence of the nucleic acid sequence according to SEQ ID NO: 78353 as shown in SEQ ID NO: 78354, or a homolog, a fragment or variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(1) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(1) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(1) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

In a particularly preferred embodiment, the at least one mRNA of the inventive composition comprises at least one 5'-untranslated region element (5'-UTR element). Preferably, the at least one 5'-UTR element comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP motif or a 5' TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the at least one mRNA of the inventive composition is provided by the coding region.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO 2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO 2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO 2013/143700" refers to sequences of other species than Homo sapiens, which are homologous to the sequences according to SEQ ID NOs: 1-1363, SEQ ID NO: 1395, SEQ ID NO: 1421 and SEQ ID NO: 1422 of the patent application WO 2013/143700.

In a preferred embodiment, the 5'-UTR element of the RNA according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO 2013/143700, from the homologs of SEQ ID NOs: 1-1363, SEQ ID NO: 1395, SEQ ID NO: 1421 and SEQ ID NO: 1422 of the patent application WO 2013/143700 from a variant thereof, or a corresponding RNA sequence. It is particularly preferred that the 5'-UTR element is derived from a nucleic acid sequence extending from the nucleotide position immediately 3' to the 5'TOP to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO 2013/143700, from the homologs of SEQ ID NOs: 1-1363, SEQ ID NO: 1395, SEQ ID NO: 1421 and SEQ ID NO: 1422 of the patent application WO 2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO 2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'-end of the sequences) corresponds to the 5'-UTR of said sequences.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO 2013/143700, a corresponding RNA sequence, a homolog thereof, or a variant thereof as described herein, preferably lacking the 5'TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5' TOP of said gene.

Accordingly, in a particularly preferred embodiment, the 5'-UTR element comprises or consists of a nucleic acid sequence, which has an identity of at least about 40%, preferably of at least about 50%, preferably of at least about 80%, preferably of at least about 70%, more preferably of at least about 80%, more preferably of at least about 90%, even more preferably of at least about 95%, even more preferably of at least about 99% to the nucleic acid sequence according to SEQ ID NO: 78343 or 78344 (5'-UTR of human ribosomal protein Large 32 lacking the 5' terminal oligopyrimidine tract: GGCGCTGCCTACGGAGGTGGCAGC-CATCTCCTTCTCGGCATC; corresponding to SEQ ID NO: 1388 of the patent application WD 2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 80%, preferably of at least about 70%, more preferably of at least about 80%, more preferably of at least about 90%, even more preferably of at least about 95%, even more preferably of at least about 99% to the nucleic acid sequence according to SEQ ID NO: 78343 or more preferably to a corresponding RNA sequence (SEQ ID NO: 78344), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the RNA according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS18, RPS17, RPS18, RPS19, RPS20, RPS21, RPS23, RPS24, RPS25, RPS28, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL28, RPL27, RPL27A, RPL28, RPL29, RPL30, RPL31, RPL32, RPL34, RPL35, RPL35A, RPL38, RPL3BA, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3E1P, EIF4A2, PABPC1, HNRNPA1, TPT1, TUBB1, UBA52, NPM1, ATP5G2, GNB2L1, NME2, HERB, or from a homolog or variant thereof, wherein preferably the 5'-UTR element does not comprise a TOP motif or the 5' TOP of said genes, and wherein optionally the 5'-UTR element starts at its 5'-end with a nucleotide located at position 1, 2, 3, 4, 5, 6, 7, 8, 9 or 10 downstream of the 5'terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, FI, transporting, mitochondrial F1 complex alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COMM, or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP syn-thase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5' TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO 2013/143700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO 2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 78345 or 78346 (5'-UTR of ATP5A1 lacking the 5' terminal oligopyrimidine tract: GCGGCTCGGCCAT-TTTGTCCCAGTCAGTCCG-GAGGCTGCGGCTGCAGAAGTACCGCCTGCG-GAGTAACTGCAAAG; corresponding to SEQ ID NO: 1414 of the patent application WO 2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 2435 or more preferably to a corresponding RNA sequence (SEQ ID NO: 243G), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'-UTR element and the at least one 3'-UTR element act synergistically to increase protein production from the at least one mRNA of the inventive composition as described above.

In a particularly preferred embodiment, the RNA according to the invention comprises a histone stem-loop sequence/structure. Such histone stem-loop sequences are preferably selected from histone stem-loop sequences as disclosed in WO 2012/019780, the disclosure of which is incorporated herewith by reference.

A histone stem-loop sequence, suitable to be used within the present invention, is preferably selected from at least one of the following formulae (I) or (II):

Formula (I) (Stem-Loop Sequence without Stem Bordering Elements):

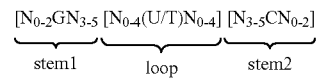

Formula (II) (Stem-Loop Sequence with Stem Bordering Elements):

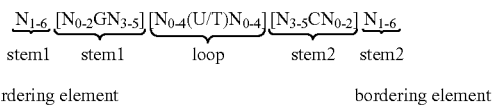

wherein:

stem1 or stem2 bordering elements $N_{1-6}$ is a consecutive sequence of 1 to 6, preferably of 2 to 5, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1[$N_{0-2}GN_{3-5}$] is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence [$N_{0-4}(U/T)N_{0-4}$] is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 [$N_{3-5}CN_{0-2}$] is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;
wherein
stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment, the RNA according to the invention may comprise at least one histone stem-loop sequence according to at least one of the following specific formulae (Ia) or (IIa):
Formula (Ia) (Stem-Loop Sequence without Stem Bordering Elements):

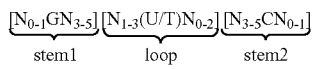

Formula (IIa) (Stem-Loop Sequence with Stem Bordering Elements):

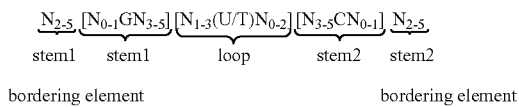

wherein: N, C, G, T and U are as defined above.

According to a further more particularly preferred embodiment, the RNA according to the invention may comprise at least one histone stem-loop sequence according to at least one of the following specific formulae (Ib) or (IIb):
Formula (Ib) (Stem-Loop Sequence without Stem Bordering Elements):

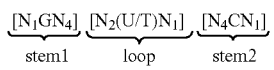

Formula (IIb) (Stem-Loop Sequence with Stem Bordering Elements):

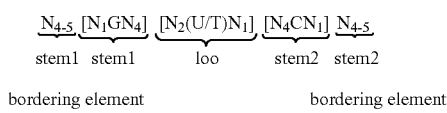

wherein: N, C, G, T and U are as defined above.

A particularly preferred histone stem-loop sequence is the sequence CAAAGGCTCTTTTCAGAGCCACCA (according to SEQ ID NO: 78351) or more preferably the corresponding RNA sequence CAAAGGCUCUUUUCAGAGCCACCA (according to SEQ ID NO: 78352).

According to another particularly preferred embodiment, the RNA according to the invention may additionally or alternatively encode a secretory signal peptide. Such signal peptides are sequences, which typically exhibit a length of about 15 to 30 amino acids and are preferably located at the N-terminus of the encoded peptide, without being limited thereto. Signal peptides as defined herein preferably allow the transport of the therapeutic protein as encoded by the at least one mRNA of the composition into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulines as defined herein, signal sequences of the invariant chain of immunoglobulines or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment. Most preferably, signal sequences of MHC class I molecule HLA-A*0201 may be used according to the present invention. For example, a signal peptide derived from HLA-A is preferably used in order to promote secretion of the encoded therapeutic protein as defined herein or a fragment or variant thereof. More preferably, an HLA-A signal peptide is fused to an encoded therapeutic protein as defined herein or to a fragment or variant thereof.

Any of the above modifications may be applied to the RNA of the present invention, and further to any RNA as used in the context of the present invention and may be, if suitable or necessary, be combined with each other in any combination, provided, these combinations of modifications do not interfere with each other in the respective at least one mRNA. A person skilled in the art will be able to take his choice accordingly.

The RNA, preferably an mRNA, according to the invention, which comprises at least one coding sequence as defined herein, may preferably comprise a 5'-UTR and/or a 3'-UTR preferably containing at least one histone stem-loop. Where, in addition to the therapeutic protein as defined herein or a fragment or variant thereof, a further peptide or protein is encoded by the at least one coding sequence of the RNA according to the invention, the encoded peptide or protein is preferably no histone protein, no reporter protein and/or no marker or selection protein, as defined herein. The 3'-UTR of the RNA according to the invention preferably comprises also a poly(A) and/or a poly(C) sequence as defined herein. The single elements of the 3'-UTR may occur therein in any order from 5' to 3' along the sequence of the RNA of the present invention. In addition, further elements as described herein, may also be contained, such as a stabilizing sequence as defined herein (e.g. derived from the UTR of a globin gene), IRES sequences, etc. Each of the elements may also be repeated in the RNA according to the invention at least once (particularly in di- or multicistronic constructs), preferably twice or more. As an example, the single elements may be present in the RNA according to the invention in the following order:

5'-coding region-histone stem-loop poly(A)/(C) sequence-3'; or

5'-coding region-poly(A)/(C) sequence histone stem-loop-3'; or

5'-coding region-histone stem-loop polyadenylation signal-3'; or

5'-coding region-polyadenylation signal histone stem-loop-3'; or

5'-coding region-histone stem-loop histone stem-loop poly (A)/(C) sequence-3'; or 5'-coding region-histone stem-loop histone stem-loop polyadenylation signal-3'; or 5'-coding region-stabilizing sequence poly(A)/(C) sequence histone stem-loop-3'; or 5'-coding region-stabilizing sequence poly(A)/(C) sequence poly(A)/(C) sequence histone stem-loop-3'; etc.

According to a further embodiment, the RNA, preferably an mRNA, of the present invention preferably comprises at least one of the following structural elements: a 5'- and/or 3'-untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

According to some embodiments, it is particularly preferred that if, in addition to an therapeutic protein as defined herein or a fragment or variant thereof, a further peptide or protein is encoded by the at least one coding sequence as defined herein—the encoded peptide or protein is preferably no histone protein, no reporter protein (e.g. Luciferase, GFP, EGFP, Galactosidase, particularly EGFP) and/or no marker or selection protein (e.g. alpha-Globin, Galactokinase and Xanthine:Guanine phosphoribosyl transferase (GPT)). In a preferred embodiment, the RNA according to the invention does not comprise a reporter gene or a marker gene. Preferably, the RNA according to the invention does not encode, for instance, luciferase; green fluorescent protein (GFP) and its variants (such as eGFP, RFP or BFP); α-globin; hypoxanthine-guanine phosphoribosyltransferase (HGPRT); β-galactosidase; galactokinase; alkaline phosphatase; secreted embryonic alkaline phosphatase (SEAP)) or a resistance gene (such as a resistance gene against neomycin, puromycin, hygromycin and zeocin). In a preferred embodiment, the RNA according to the invention does not encode luciferase. In another embodiment, the RNA according to the invention does not encode GFP or a variant thereof.

According to a preferred embodiment, the RNA according to the present invention comprises, preferably in 5' to 3' direction, the following elements:
a) a 5'-CAP structure, preferably m7GpppN,
b) at least one coding sequence comprising or consisting of any one of the nucleic acid sequences selected from the group consisting of nucleic acid sequences according to any one of SEQ ID NO: 13058 to 78342, or a fragment or variant thereof,
c) a poly(A) tail, preferably consisting of 10 to 200, 10 to 100, 40 to 80 or 50 to 70 adenosine nucleotides,
d) a poly(C) tail, preferably consisting of 10 to 200, 10 to 100, 20 to 70, 20 to 60 or 10 to 40 cytosine nucleotides, and
e) a histone stem-loop, preferably comprising the RNA sequence according to SEQ ID NO: 78352.

More preferably, the RNA according to the invention comprises, preferably in 5' to 3' direction, the following elements:
a) a 5'-CAP structure, preferably m7GpppN,
b) at least one coding sequence comprising or consisting of any one of the nucleic acid sequences selected from the group consisting of nucleic acid sequences according to any one of SEQ ID NO: 13058 to 78342, or a fragment or variant thereof,
c) a 3'-UTR element comprising a nucleic acid sequence, which is derived from an α-globin gene, preferably comprising the corresponding RNA sequence of the nucleic acid sequence according to SEQ ID NO: 78353, or a homolog, a fragment or a variant thereof,
d) a poly(A) tail, preferably consisting of 10 to 200, 10 to 100, 40 to 80 or 50 to 70 adenosine nucleotides,
e) a poly(C) tail, preferably consisting of 10 to 200, 10 to 100, 20 to 70, 20 to 60 or 10 to 40 cytosine nucleotides, and
f) a histone stem-loop, preferably comprising the RNA sequence according to SEQ ID NO: 78352.

In a further embodiment, the RNA according to the invention comprises, preferably in 5' to 3' direction, the following elements:
a) a 5'-CAP structure, preferably m7GpppN,
b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 78343, or a homolog, a fragment or a variant thereof,
c) at least one coding sequence comprising or consisting of any one of the nucleic acid sequences selected from the group consisting of nucleic acid sequences according to any one of SEQ ID NO: 13058 to 78342, or a fragment or variant thereof,
d) a 3'-UTR element comprising a nucleic acid sequence, which is preferably derived from an α-globin gene, preferably comprising the corresponding RNA sequence of the nucleic acid sequence according to SEQ ID NO: 78353, or a homolog, a fragment or a variant thereof; and/or
a 3'-UTR element comprising a nucleic acid sequence, which is derived from an albumin gene, preferably comprising the corresponding RNA sequence of the nucleic acid sequence according to SEQ ID NO: 78357, or a homolog, a fragment or a variant thereof,
e) a poly(A) tail, preferably consisting of 10 to 200, 10 to 100, 40 to 80 or 50 to 70 adenosine nucleotides,
f) a poly(C) tail, preferably consisting of 10 to 200, 10 to 100, 20 to 70, 20 to 60 or 10 to 40 cytosine nucleotides, and
g) a histone stem-loop, preferably comprising the RNA sequence according to SEQ ID NO: 78362.

The RNA according to the present invention may be prepared using any method known in the art, including synthetic methods such as e.g. solid phase RNA synthesis, as well as in vitro methods, such as RNA in vitro transcription reactions.

In a further aspect, the present invention concerns a composition comprising the RNA comprising at least one coding sequence as defined herein and a pharmaceutically acceptable carrier. The composition according to the invention is preferably provided as a pharmaceutical composition.

According to a preferred embodiment, the (pharmaceutical) composition according to the invention comprises the RNA of the present invention, wherein the at least one coding sequence of the RNA encodes a peptide or protein comprising or consisting of any one of the therapeutic proteins defined herein, preferably a peptide or protein as specified in Table 1, more preferably as defined feature c1 or feature c2 of Table 1, or a fragment or variant of any one of these proteins.

Preferably, the (pharmaceutical) composition according to the invention comprises the RNA of the present invention, wherein the at least one coding sequence of the RNA comprises or consists of a nucleic acid sequence encoding a therapeutic protein, or a fragment or variant of a therapeutic protein, wherein the therapeutic protein preferably comprises or consists of any one of the amino acid sequences defined in Table 1 herein, preferably in feature c3 of Table 1, or a fragment or variant of any one of these sequences.

Preferably, the (pharmaceutical) composition according to the invention comprises the RNA of the present invention, wherein the at least one coding sequence of the RNA comprises or consists of a nucleic acid sequence encoding a therapeutic protein, or a fragment or variant of a therapeutic protein, wherein the therapeutic protein preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences defined in feature c3 of Table 1, or a fragment or variant of any one of these sequences.

More preferably, the (pharmaceutical) composition according to the invention comprises the RNA of the present invention, wherein the at least one coding sequence of the RNA comprises or consists of a nucleic acid sequence encoding a therapeutic protein, or a fragment or variant of a therapeutic protein, wherein the therapeutic protein preferably comprises or consists of an amino acid sequence having a sequence identity of at least 80% with any one of the amino acid sequences defined in feature c3 of Table 1, or a fragment or variant of any one of these sequences.

In preferred embodiments, the (pharmaceutical) composition according to the invention comprises the RNA of the present invention, wherein the at least one coding sequence of the RNA comprises or consists of any one of the nucleic acid sequences defined in feature c4 of Tablet or a fragment or variant of any one of these sequences.

According to another embodiment, the (pharmaceutical) composition according to the invention comprises the RNA of the present invention, wherein the at least one coding sequence of the RNA comprises or consists of a nucleic acid sequence having a sequence identity of at least 5%, 10%, 20%, 30%, 40%, 50%, 60%, 70%, 80%, 85%, 86%, 87%, BR, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences defined in feature c4 of Table 1, or a fragment or variant of any one of these sequences.

According to a particularly preferred embodiment, the (pharmaceutical) composition according to the invention comprises the RNA of the present invention, wherein the at least one coding sequence of the RNA comprises or consists of a nucleic acid sequence having a sequence identity of at least 80% with any one of the nucleic acid sequences defined in feature c4 of Table 1, or a fragment or variant of any one of these sequences.

In the context of the present invention, the (pharmaceutical) composition may encode one or more of the therapeutic proteins defined herein, or a fragment or variant thereof.

The (pharmaceutical) composition according to the invention may thus comprise the RNA of the present invention, wherein the RNA encodes one specific therapeutic protein of the therapeutic proteins defined herein, or a fragment or a variant thereof. In that embodiment, the (pharmaceutical) composition preferably comprises the RNA according to the invention comprising the at least one coding sequence as defined herein encoding a peptide or protein comprising or consisting of the therapeutic protein, or a fragment or variant thereof.

Alternatively, the (pharmaceutical) composition of the present invention may comprise at least one RNA according to the invention, wherein the at least one RNA encodes at least two, three, four, five, six, seven, eight, nine, ten, eleven or twelve distinct therapeutic proteins as defined herein or a fragment or variant thereof. Preferably, the (pharmaceutical) composition comprises several species of the RNA according to the invention, wherein each RNA species encodes one of the therapeutic proteins or a fragment or variant thereof. In another embodiment, the RNA comprised in the (pharmaceutical) composition is a bi- or multicistronic RNA as defined herein, which encodes the at least two, three, four, five, six, seven, eight, nine, ten, eleven or twelve distinct therapeutic proteins. Mixtures between these embodiments are also envisaged, such as compositions comprising more than one RNA species, wherein at least one RNA species may be monocistronic, while at least one other RNA species may be bi- or multicistronic.

The (pharmaceutical) composition according to the present invention, preferably the at least one coding sequence of the RNA comprised therein, may thus comprise any combination of the nucleic acid sequences as defined herein.

In a preferred embodiment of the composition according to the invention, the RNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the RNA of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 5:285).

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9:1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as MAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed. (Adv Drug Deliv Rev. 2014 February; 55:110-115).

Therefore, in one embodiment the RNA of the composition according to the present invention is complexed with cationic lipids and/or neutral lipids and thereby forms liposomes, lipid nanoparticles, lipoplexes or neutral lipid-based nanoliposomes.

In a preferred embodiment, the composition according to the invention comprises the RNA according to the invention that is formulated together with a cationic or polycationic compound and/or with a polymeric carrier. Accordingly, in a further embodiment of the invention, it is preferred that the RNA as defined herein or any other nucleic acid comprised in the inventive (pharmaceutical) composition is associated with or complexed with a cationic or polycationic compound or a polymeric carrier, optionally in a weight ratio selected from a range of about 5:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the RNA as defined herein or any other nucleic acid comprised in the (pharmaceutical) composition according to the invention can also be associated with a vehicle, transfection or complexation agent for increasing the transfection efficiency and/or the expression of the RNA according to the invention or of optionally comprised further included nucleic acids.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpTB20, prolin-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, plsl, FGF, Lactoferrin, Transportan, Buforin-2, Bac715-24, SynB, SynB(I), pVEC, hCT-derived peptides, SAP, or histones. More preferably, the RNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

$$(Arg)_l;(Lys)_m;(His)_n;(Orn)_o;(Xaa)_x, \qquad \text{formula (III)}$$

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO 2009/030481 is incorporated herewith by reference.

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPE, LEAP, DOPE: Dioleyl phosphatidylethanol-amine, DOSPA, DODAB, DOIC, DMEPC, DOGS: Dioctadecylamidoglicyl-spermin, DIMRI: Dimyristo-oxypropyl dimethyl hydroxyethyl ammonium bromide, MAP: dioleoyloxy-3-(trimethyl-ammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]trimethylammonium, CLIP9: rac-[2(2,3-dihexadecyloxypropyl-oxysuccinyloxy)ethyl]- trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., block polymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the RNA as defined herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the RNA as defined herein or a further nucleic acid comprised in the composition, and thereby preferably condensing the RNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the RNA according to the invention or any further nucleic acid comprised in the (pharmaceutical) composition of the present invention contains at least one SH moiety, most preferably at least one cysteine residue or any further chemical group exhibiting an SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the RNA of the present invention or any further nucleic acid comprised in the (pharmaceutical) composition according to the invention may be formed by disulfide-crosslinked cationic (or polycationic) components. Preferably, such cationic or polycationic peptides or proteins or polymers of the polymeric carrier, which comprise or are additionally modified to comprise at least one SH moiety, are selected from, proteins, peptides and polymers as defined herein for complexation agent.

In a further particular embodiment, the polymeric carrier which may be used to complex the RNA as defined herein or any further nucleic acid comprised in the (pharmaceutical) composition according to the invention may be selected from a polymeric carrier molecule according to generic formula (IV):

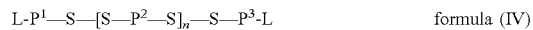

formula (IV)

wherein, $P^1$ and $P^3$ are different or identical to each other and represent a linear or branched hydrophilic polymer chain, each $P^1$ and $P^3$ exhibiting at least one —SH-moiety, capable to forma disulfide linkage upon condensation with component $P^2$, or alternatively with (AA), $(AA)_x$, or $[(AA)_x]_z$ if such components are used as a linker between $P^1$ and $P^2$ or $P^3$ and $P^2$) and/or with further components (e.g. (AA), $(AA)_x$, $[(AA)_x]_z$ or L), the linear or branched hydrophilic polymer chain selected independent from each other from polyethylene glycol (PEG), poly-#(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa; each $P^2$ exhibiting at least two —SH-moieties, capable to forma disulfide linkage upon condensation with further components $P^2$ or component(s) $P^1$ and/or $P^3$ or alternatively with further components (e.g. (AA), $(AA)_x$, or $[(AA)_x]_z$;

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^2$, or optionally of further components as defined herein (e.g. L, (AA), $(AA)_x$ $[(AA)_x]_z$, etc); The —SH-moiety may be part of the structure of these components or added by a modification as defined below;

L is an optional ligand, which may be present or not, and may be selected independent from the other from RED, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. HD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/025541 is incorporated herewith by reference. Each of hydrophilic polymers $P^1$ and $P^2$ typically exhibits at least one —SH-moiety, wherein the at least one —SH-moiety is capable to forma disulfide linkage upon reaction with component $P^2$ or with component (AA) or (AA)$_x$, if used as linker between $P^1$ and $P^2$ or $P^2$ and $P^2$ as defined below and optionally with a further component, e.g. L and/or (AA) or (AA)$_x$, e.g. if two or more —SH-moieties are contained. The following sub-formulae "$P^1$—S—S—$P^{2\prime\prime}$" and "$P^2$—S—S—$P^{2\prime\prime}$" within generic formula (IV) above (the brackets are omitted for better readability), wherein any of S, $P^1$ and $P^2$ are as defined herein, typically represent a situation, wherein one-SH-moiety of hydrophilic polymers $P^1$ and $P^2$ was condensed with one —SH-moiety of component $P^2$ of generic formula (IV) above, wherein both sulphurs of these —SH-moieties forma disulfide bond —S—S— as defined herein in formula (IV). These —SH-moieties are typically provided by each of the hydrophilic polymers $P^1$ and $P^2$, e.g. via an internal cysteine or any further (modified) amino acid or compound which carries a —SH moiety. Accordingly, the subformulae "$P^1$—S—S—$P^{2\prime\prime}$" and "$P^2$—S—S—$P^{2\prime\prime}$" may also be written as "$P^1$-Cys-Cys-$P^{2\prime\prime}$" and "$P^2$-Cys-Cys-$P^{2\prime\prime}$", if the —SH—moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to forma disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^2$ may be modified with a —SH moiety, preferably via a chemical reaction with a compound carrying a —SH moiety, such that each of the hydrophilic polymers $P^1$ and $P^2$ carries at least one such —SH moiety. Such a compound carrying a —SH moiety may be e.g. an (additional) cysteine or any further (modified) amino acid, which carries a SH moiety. Such a compound may also be any non-amino compound or moiety, which contains or allows to introduce a SH moiety into hydrophilic polymers $P^1$ and $P^3$ as defined herein. Such non-amino compounds may be attached to the hydrophilic polymers $P^1$ and $P^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one SH-moiety preferably at one terminal end, but may also contain two or even more SH-moieties, which may be used to additionally attach further components as defined herein, preferably further functional peptides or proteins e.g. a ligand, an amino acid component (AA) or (AA)$_x$, antibodies, cell penetrating peptides or enhancer peptides (e.g. TAT, KALA), etc.

Preferably, the inventive composition comprises at least one RNA as defined herein, which is complexed with one or more polycations, and at least one free RNA, wherein the at least one complexed RNA is preferably identical to the at least one free RNA. In this context, it is particularly preferred that the composition of the present invention comprises the RNA according to the invention that is complexed at least partially with a cationic or polycationic compound and/or a polymeric carrier, preferably cationic proteins or peptides. In this context, the disclosure of WO 2010/037539 and WO 2012/113513 is incorporated herewith by reference. Partially means that only a part of the RNA as defined herein is complexed in the composition according to the invention with a cationic compound and that the rest of the RNA as defined herein is (comprised in the inventive (pharmaceutical) composition) in uncomplexed form ("free"). Preferably, the molar ratio of the complexed RNA to the free RNA is selected from a molar ratio of about 0.001:1 to about 1:0.001, including a ratio of about 1:1. More preferably the ratio of complexed RNA to free RNA (in the (pharmaceutical) composition of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition is selected from a ratio of about 1:1 (w/w).

The complexed RNA in the (pharmaceutical) composition according to the present invention, is preferably prepared according to a first step by complexing the RNA according to the invention with a cationic or polycationic compound and/or with a polymeric carrier, preferably as defined herein, in a specific ratio to forma stable complex. In this context, it is highly preferable, that no free cationic or polycationic compound or polymeric carrier or only a negligibly small amount thereof remains in the component of the complexed RNA after complexing the RNA. Accordingly, the ratio of the RNA and the cationic or polycationic compound and/or the polymeric carrier in the component of the complexed RNA is typically selected in a range so that the RNA is entirely complexed and no free cationic or polycationic compound or polymeric carrier or only a negligibly small amount thereof remains in the composition.

Preferably the ratio of the RNA as defined herein to the cationic or polycationic compound and/or the polymeric carrier, preferably as defined herein, is selected from a range of about 5:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the RNA as defined herein to the cationic or polycationic compound and/or the polymeric carrier, preferably as defined herein, in the component of the complexed mRNA, may also be calculated on the basis of the nitrogen/phosphate ratio (N/P-ratio) of the entire complex. In the context of the present invention, an N/P-ratio is preferably in the range of about 0.1 to 10, preferably in a range of about 0.3 to 4 and most preferably in a range of about 0.5 to 2 or 0.7 to 2 regarding the ratio of RNA:cationic or polycationic compound and/or polymeric carrier, preferably as defined herein, in the complex, and most preferably in a range of about 0.7 to 1.5, 0.5 to 1 or 0.7 to 1, and even most preferably in a range of about 0.3 to 0.9 or 0.5 to 0.9, preferably provided that the cationic or polycationic compound in the complex is a cationic or polycationic cationic or polycationic protein or peptide and/or the polymeric carrier as defined above.

In other embodiments, the composition according to the invention comprising the RNA as defined herein may be administered naked without being associated with any further vehicle, transfection or complexation agent.

It has to be understood and recognized, that according to the present invention, the inventive composition may comprise at least one naked RNA as defined herein, preferably an mRNA, and/or at least one formulated/complexed RNA as defined herein, preferably an mRNA, wherein every formulation and/or complexation as disclosed above may be used.

In embodiments, wherein the (pharmaceutical) composition comprises more than one RNA species, these RNA species may be provided such that, for example, two, three, four, five or six separate compositions, which may contain at least one RNA species each (e.g. three distinct mRNA species), each encoding distinct therapeutic proteins as defined herein or a fragment or variant thereof as, are provided, which may or may not be combined. Also, the (pharmaceutical) composition may be a combination of at least two distinct compositions, each composition comprising at least one mRNA encoding at least one of the therapeutic proteins defined herein. Alternatively, the (pharmaceutical) composition may be provided as a combination of at least one mRNA, preferably at least two, three, four, five, six or more mRNAs, each encoding one of the therapeutic proteins defined herein. The (pharmaceutical) composition may be combined to provide one single composition prior to its use or it may be used such that more than one administration is required to administer the distinct mRNA species encoding a certain combination of the proteins as defined herein. If the (pharmaceutical) composition contains at least one mRNA molecule, typically at least two mRNA molecules, encoding of a combination of therapeutic proteins defined herein, it may e.g. be administered by one single administration (combining all mRNA species), by at least two separate administrations. Accordingly; any combination of mono-, bi- or multicistronic mRNAs encoding the at least one therapeutic protein or any combination of therapeutic proteins as defined herein (and optionally further proteins), provided as separate entities (containing one mRNA species) or as combined entity (containing more than one mRNA species), is understood as a (pharmaceutical) composition according to the present invention. According to a particularly preferred embodiment of the (pharmaceutical) composition, the at least one therapeutic protein, preferably a combination of at least two, three, four, five, six or more therapeutic proteins encoded by the (pharmaceutical) composition as a whole, is provided as an individual (monocistronic) mRNA, which is administered separately.

The (pharmaceutical) composition according to the present invention may be provided in liquid and or in dry (e.g. lyophilized) form.

The (pharmaceutical) composition typically comprises a safe and effective amount of the RNA according to the invention as defined herein, encoding a therapeutic protein as defined herein or a fragment or variant thereof or a combination of therapeutic proteins, preferably as defined herein. As used herein, "safe and effective amount" means an amount of the RNA that is sufficient to significantly induce a positive modification of a disease or disorder as defined herein. At the same time, however, a "safe and effective amount" is small enough to avoid serious side-effects, that is to say to permit a sensible relationship between advantage and risk. The determination of these limits typically lies within the scope of sensible medical judgment. In relation to the (pharmaceutical) composition of the present invention, the expression "safe and effective amount" preferably means an amount of the RNA (and thus of the encoded therapeutic protein) that is suitable for obtaining an appropriate expression level of the encoded protein(s). Such a "safe and effective amount" of the RNA of the (pharmaceutical) composition as defined herein may furthermore be selected in dependence of the type of RNA, e.g. monocistronic, bi- or even multicistronic RNA, since a bi- or even multicistronic RNA may lead to a significantly higher expression of the encoded protein(s) than the use of an equal amount of a monocistronic RNA. A "safe and effective amount" of the RNA of the (pharmaceutical) composition as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The (pharmaceutical) composition according to the invention can be used according to the invention for human and also for veterinary medical purposes.

In a preferred embodiment, the RNA of the (pharmaceutical) composition or kit of parts according to the invention is provided in lyophilized form. Preferably, the lyophilized RNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition or the kit of parts according to the invention contains at least two, three, four, five, six or more RNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) RNAs.

The (pharmaceutical) composition according to the invention may typically contain a pharmaceutically acceptable carrier. The expression "pharmaceutically acceptable carrier" as used herein preferably includes the liquid or non-liquid basis of the composition. If the composition is provided in liquid form, the carrier will be water, typically pyrogen-free water; isotonic saline or buffered (aqueous) solutions, e.g phosphate, citrate etc. buffered solutions. Particularly for injection of the (pharmaceutical) composition, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_2$, $NaHCO_2$, $Na_2SO_4$, examples of the optional potassium salts include e.g. KCl, KI, KBr, $K_2CO_2$, $KHCO_2$, $K_2SO_4$, and examples of calcium salts include e.g. $CaCl_2$, $CaI_2$, $CaBr_2$, $CaCO_2$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the composition according to the invention are capable of being mixed with the RNA according to the invention as defined herein, in such a manner that no interaction occurs, which would substantially reduce the pharmaceutical effectiveness of the (pharmaceutical) composition according to the invention under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition according to the invention is administered. The (pharmaceutical) composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the (pharmaceutical) composition according to the present invention may be administered by an intradermal, subcutaneous, or intramuscular route, preferably by injection, which may be needle-free and/or needle injection. The (pharmaceutical) composition is therefore preferably formulated in liquid or solid form. The suitable amount of the (pharmaceutical) composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the (pharmaceutical) composition is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

Further additives which may be included in the (pharmaceutical) composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

The (pharmaceutical) composition as defined herein may also be administered orally in any orally acceptable dosage form including, but not limited to, capsules, tablets, aqueous suspensions or solutions.

The (pharmaceutical) composition may also be administered topically, especially when the target of treatment includes areas or organs readily accessible by topical application, e.g. including diseases of the skin or of any other accessible epithelial tissue. Suitable topical formulations are readily prepared for each of these areas or organs. For topical applications, the (pharmaceutical) composition may be formulated in a suitable ointment, containing the RNA according to the invention suspended or dissolved in one or more carriers.

According to a preferred embodiment of this aspect of the invention, the (pharmaceutical) composition according to the invention is administered by injection. Any suitable injection technique known in the art may be employed. Preferably, the inventive composition is administered by injection, preferably by needle-less injection, for example by jet-injection.

In one embodiment, the (pharmaceutical) composition comprises at least two, three, four, five, six, seven, eight, nine, ten, eleven, twelve or more RNAs as defined herein, each of which is preferably injected separately, preferably by needle-less injection. Alternatively, the (pharmaceutical) composition comprises at least two, three, four, five, six, seven, eight, nine, ten, eleven, twelve or more RNAs, wherein the at least two, three, four, five, six, seven, eight, nine, ten, eleven, twelve or more RNAs are administered, preferably by injection as defined herein, as a mixture.

Administration of the RNA as defined herein or the (pharmaceutical) composition according to the invention may be carried out in a time staggered treatment. A time staggered treatment may be e.g. administration of the RNA or the composition prior, concurrent and/or subsequent to a conventional therapy of a disease or disorder, preferably as described herein, e.g. by administration of the RNA or the composition prior, concurrent and/or subsequent to a therapy or an administration of a therapeutic agent suitable for the treatment or prophylaxis of a disease or disorder as described herein. Such time staggered treatment may be carried out using e.g. a kit, preferably a kit of parts as defined herein.

Time staggered treatment may additionally or alternatively also comprise an administration of the RNA as defined herein or the (pharmaceutical) composition according to the invention in a form, wherein the RNA encoding a therapeutic protein as defined herein or a fragment or variant thereof, preferably forming part of the composition, is administered parallel, prior or subsequent to another RNA encoding a therapeutic protein as defined above, preferably forming part of the same inventive composition. Preferably, the administration (of all RNAs) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

The present invention furthermore provides several applications and uses of the RNA, of the (pharmaceutical) composition or the kit of parts according to the invention.

According to a further aspect, the present invention also provides a method for increasing the expression of an encoded peptide or protein comprising the steps, e.g. a) providing the RNA as defined herein or the (pharmaceutical) composition as defined herein, b) applying or administering the RNA or the composition to an expression system, e.g. to a cell-free expression system, a cell (e.g. an expression host cell or a somatic cell), a tissue or an organism. The method may be applied for laboratory, for research, for diagnostic, for commercial production of peptides or proteins and/or for therapeutic purposes. In this context, typically after preparing the RNA or the composition, it is typically applied or administered to a cell-free expression system, a cell (e.g. an expression host cell or a somatic cell), a tissue or an organism, e.g. in naked or complexed form or as a (pharmaceutical) composition as described herein, preferably via transfection or by using any of the administration modes as described herein. The method may be carried out in vitro, in vivo or ex vivo. The method may furthermore be carried out in the context of the treatment of a specific disease, preferably as defined herein.

In this context in vitro is defined herein as transfection or transduction of the RNA or the composition according to the invention into cells in culture outside of an organism; in vivo is defined herein as transfection or transduction of the RNA or the composition according to the invention into cells by application of the RNA or the composition to the whole organism or individual and ex vivo is defined herein as transfection or transduction of the RNA or the composition according to the invention into cells outside of an organism or individual and subsequent application of the transfected cells to the organism or individual.

Likewise, according to another aspect, the present invention also provides the use of the RNA or the composition according to the invention, preferably for diagnostic or therapeutic purposes, for increasing the expression of an encoded peptide or protein, particularly in gene therapy e.g. by applying or administering the RNA or the composition, e.g. to a cell-free expression system, a cell (e.g. an expression host cell or a somatic cell), a tissue or an organism. The use may be applied for laboratory, for research, for diagnostic for commercial production of peptides or proteins and/or for therapeutic purposes, preferably for gene therapy. In this context, typically after preparing the RNA or the composition according to the invention, it is typically applied or administered to a cell-free expression system, a cell (e.g. an expression host cell or a somatic cell), a tissue or an organism, preferably in naked form or complexed form, or as a (pharmaceutical) composition as described herein, preferably via transfection or by using any of the administration modes as described herein. The use may be carried out in vitro, in vivo or ex vivo. The use may furthermore be carried out in the context of the treatment or prevention of a specific disease, preferably as defined herein. More preferably, the use is carried out in gene therapy in a disease, disorder or condition amenable to treatment by (increasing the) expression of the peptide or protein that is encoded by the at least one coding sequence of the RNA according to the invention. Even more preferably, the use is carried out in gene therapy in a disease, disorder or condition indicated in Table 1, i.e. indicated under feature c5, preferably for the encoded peptide or protein.

In the context of the present invention, the expression "disease, disorder or condition amenable to treatment by (increasing the) expression of the peptide or protein that is encoded by the at least one coding sequence of the RNA" typically refers to any disease, disorder or condition, which may be positively influenced (e.g. cured, ameliorated or prevented) by expressing a therapeutic protein as defined herein (or increasing the expression thereof), e.g. by administration of the RNA according to the invention.

As used herein, the expression "a disease, disorder or condition indicated in Table 1" typically relates to any diseases, disorder or condition specified in feature c5 of Table 1. Preferably, a certain therapeutic protein as defined herein, preferably a therapeutic protein selected from the peptides or proteins specified in Table 1 is used in connection with a disease, disorder or condition as indicated in feature c5 of the respective entry in Table 1.

In yet another aspect the present invention also relates to an inventive expression system comprising the RNA according to the invention or an expression vector or plasmid comprising a corresponding nucleic acid sequence according to the first aspect of the present invention. In this context the expression system may be a cell-free expression system (e.g. an in vitro transcription/translation system), a cellular expression system (e.g. mammalian cells like CHO cells, insect cells, yeast cells, bacterial cells like E. coli) or organisms used for expression of peptides or proteins (e.g. plants or animals like cows).

According to one specific aspect, the present invention is directed to the first medical use of the RNA according to the invention or of the (pharmaceutical) composition comprising the RNA according to the invention or a plurality of inventive RNAs as defined herein as a medicament, particularly in gene therapy, preferably for the treatment or prevention of diseases as defined herein.

According to another aspect, the present invention is directed to the second medical use of the RNA according to the invention or of the (pharmaceutical) composition comprising the RNA according to the invention or a plurality of inventive RNAs as defined herein, for the treatment or prevention of diseases as defined herein, preferably to the use of the RNA as defined herein, of the (pharmaceutical) composition as defined herein, of a pharmaceutical composition comprising same or of kits comprising same for the preparation of a medicament for the prophylaxis, treatment and/or amelioration of diseases as defined herein. Preferably, the pharmaceutical composition is used on or to be administered to a patient in need thereof for this purpose.

According to a further aspect, the RNA according to the invention is used in the manufacture of a medicament, wherein the medicament is preferably for treatment or prophylaxis of a disease or disorder as defined herein.

According to a preferred embodiment, a disease or disorder in the context of the present invention is a disease, disorder or condition amenable to treatment by (increasing the) expression of the peptide or protein encoded by the at least one coding sequence.

Preferably, diseases as mentioned herein are preferably selected from infectious diseases, neoplasms (e.g. cancer or tumour diseases), diseases of the blood and blood-forming organs, endocrine, nutritional and metabolic diseases, diseases of the nervous system, diseases of the circulatory system, diseases of the respiratory system, diseases of the digestive system, diseases of the skin and subcutaneous tissue, diseases of the musculoskeletal system and connective tissue, and diseases of the genitourinary system.

In this context particularly preferred are inherited diseases selected from: Ip36 deletion syndrome; 18p deletion syndrome; 21-hydroxylase deficiency; 45,X (Turner syndrome); 47,XX,+21 (Down syndrome); 47,XXX (triple X syndrome); 47,XXY (Klinefelter syndrome); 47,XY,+21 (Down syndrome); 47,XYY syndrome; 5-ALA dehydratase-deficient porphyria (ALA dehydratase deficiency); 5-aminolaevulinic dehydratase deficiency porphyria (ALA dehydratase deficiency); 5p deletion syndrome (Cri du chat) 5p-syndrome (Cri du chat); A-T (ataxia-telangiectasia); AAT (alpha-1 antitrypsin deficiency); Absence of vas deferens (congenital bilateral absence of vas deferens); Absent vase (congenital bilateral absence of vas deferens); aceruloplasminemia; ACG2 (achondrogenesis type II); AH (achondroplasia); Achondrogenesis type II; achondroplasia; Acid beteglucosidase deficiency (Geuther disease type 1); Acrocephalosyndactyly (Apert) (Apert syndrome); acrocephalosyndactyly, type V (Pfeiffer syndrome); Acrocephaly (Apert syndrome); Acute cerebral Gaucher's disease (Geuther disease type 2); acute intermittent porphyria; ACY2 deficiency (Canavan disease); AD (Alzheimer's disease); Adelaide-type craniosynostosis (Muenke syndrome); Adenomatous Polyposis Coli (familial adenomatous polyposis); Adenomatous Polyposis of the Colon (familial adenomatous polyposis); ADP (ALA dehydratase deficiency); adenylosuccinate lyase deficiency; Adrenal gland disorders (21-hydroxylase deficiency); Adrenogenital syndrome (21-hydroxylase deficiency); Adrenoleukodystrophy; AIP (acute intermittent porphyria); AIS (androgen insensitivity syndrome); AKU (alkaptonuria); ALA dehydratase porphyria (ALA dehydratase deficiency); ALA-D porphyria (ALA dehydratase deficiency); ALA dehydratase deficiency; Alcaptonuria (alkaptonuria); Alexander disease; alkaptonuria; Alkaptonuric ochronosis (alkaptonuria); alpha-1 antitrypsin deficiency; alpha-1 proteinase inhibitor (alpha-1 antitrypsin deficiency); alpha-1 related emphysema (alpha-1 antitrypsin deficiency); Alpha-galactosidase A deficiency (Fabry disease); ALS (amyotrophic lateral sclerosis); Alstrom syndrome; ALX (Alexander disease); Alzheimer disease; Amelogenesis Imperfecta; Amino levulinic acid dehydratase deficiency (ALA dehydratase deficiency); Aminoacylase 2 deficiency (Canavan disease); amyotrophic lateral sclerosis; Anderson-Fabry disease (Fabry disease); androgen insensitivity syndrome; Anemia; Anemia, hereditary sideroblastic (X-linked sideroblastic anemia); Anemia, sex-linked hypochromic sideroblastic (X-linked sideroblastic anemia); Anemia, splenic, familial (Geuther disease); Angelman syndrome; Angiokeratoma Corporis Diffusum (Fabry's disease); Angiokeratoma diffuse (Fabry's disease); Angiomatosis retinae (von Hippel-Lindau disease); ANHI (X-linked sideroblastic anemia); APC resistance, Leiden type (factor V Leiden thrombophilia); Apert syndrome; AR deficiency (androgen insensitivity syndrome); AR-CMT2 ee (Charcot-Mare-Tooth disease, type 2); Arachnodactyly (Marfan syndrome); ARNSHL (Nonsyndromic deafness #autosomal recessive); Arthro-ophthalmopathy, hereditary progressive (Stickler syndrome #COL2A1); Arthrochalasis multiplex congenita (Ehlers-Danlos syndrome #arthrochalasia type); AS (Angelman syndrome); Asp deficiency (Canavan disease); Aspa deficiency (Canavan disease); Aspartoacylase deficiency (Canavan disease); ataxia-telangiectasia; Autism-Dementia-Ataxia-Loss of Purposeful Hand Use syndrome (Rett syndrome); autosomal dominant juvenile ALS (amyotrophic lateral sclerosis, type 4); Autosomal dominant opitz G/BBB syndrome (22q11.2 deletion syndrome); autosomal recessive form of juvenile ALS type 3 (Amyotrophic lateral sclerosis #type 2); Autosomal recessive nonsyndromic hearing loss (Nonsyndromic deafness #autosomal recessive); Autosomal Recessive Sensorineural Hearing Impairment and Goiter (Pendred syndrome); AxD (Alexander disease); Ayerza syndrome (primary pulmonary hypertension); B variant of the Hexosaminidase GM2 gangliosidosis (Sandhoff disease); BANF (neurofibromatosis 2); Beare-Stevenson cubs gyrate syndrome; Benign paroxysmal peritonitis (Mediterranean fever, familial); Benjamin syndrome; beta thalassemia; BH4 Deficiency (tetrahydrobiopterin deficiency); Bilateral Acoustic Neurofibromatosis (neurofibromatosis 2); biotinidase deficiency; bladder cancer; Bleeding disorders (factor V Leiden thrombophilia); Bloch-Sulzberger syndrome (incontinentia pigmenti); Bloom syndrome; Bone diseases; Bone marrow diseases (X-linked sideroblastic anemia); Bonnevie-Ullrich syndrome (Turner syndrome); Bourneville disease (tuberous sclerosis); Bourneville phakomatosis (tuberous sclerosis); Brain diseases (prion disease); breast cancer; Birt-Hogg-Dube syndrome; Brittle bone disease (osteogenesis imperfecta); Broad Thumb-Hallux syndrome (Rubinstein-Taybi syndrome); Bronze Diabetes (hemochromatosis); Bronzed cirrhosis (hemochromatosis); Bulbospinal muscular atrophy, X-linked (Kennedy disease); Burger-Grutz syndrome (lipoprotein lipase deficiency, familial); CADASIL; CGD Chronic Granulomatous Disorder; Camptomelic dysplasia; Canavan disease; Cancer; Cancer Family syndrome (hereditary nonpolyposis colorectal cancer); Cancer of breast (breast cancer); Cancer of the bladder (bladder cancer); Carboxylase Deficiency, Multiple, Late-Onset (biotinidase deficiency); Cardiomyopathy (Noonan syndrome); Cat cry syndrome (Cri du chat); CAVD (congenital bilateral absence of vas deferens); Caylor cardiofacial syndrome (22q11.2 deletion syndrome); CBAVD (congenital bilateral absence of vas deferens); Celiac Disease; CEP (congenital erythropoietic porphyria); Ceramide trihexosidase deficiency (Fabry disease); Cerebelloretinal Angiomatosis, familial (von Hippel-Lindau disease); Cerebral arteriopathy with subcortical infarcts and leukoencephalopathy (CADASIL); Cerebral autosomal dominant ateriopathy with subcortical infarcts and leukoencephalopathy (CADASIL); Cerebral sclerosis (tuberous sclerosis); Cerebroatrophic Hyperammonemia (Rett syndrome); Cerebroside Lipidosis syndrome (Gaucher disease); CF (cystic fibrosis); CH (congenital hypothyroidism); Cheroot disease (amyotrophic lateral sclerosis); Charcot-Marie-Tooth disease; Chondrodystrophia (achondroplasia); Chondrodystrophy syndrome (achondroplasia); Chondrodystrophy with sensorineural deafness (otospondylomegaepiphyseal dysplasia); Chondrogenesis imperfecta (achondrogenesis, type II); Choreoathetosis self-mutilation hyperuricemia syndrome (Lesch-Nyhan syndrome); Classic Galactosemia (galactosemia); Classical Ehlers-Danlos syndrome (Ehlers-Danlos syndrome #classical type); Classical Phenylketonuria (phenylketonuria); Cleft lip and plate (Stickler syndrome); Cloverleaf skull with thanatophoric dwarfism (Thanatophoric dysplasia #type 2); CLS (Coffin-Lowry syndrome); CMT (Charcot-Marie-Tooth disease); Cockayne syndrome; Coffin-Lowry syndrome; collagenopathy, types II and XI; Colon Cancer, familial Nonpolyposis (hereditary nonpolyposis colorectal cancer); Colon cancer, familial (familial adenomatous polyposis); Colorectal Cancer; Complete HPRT deficiency (Lesch-Nyhan syndrome); Complete hypoxanthine-guanine phosphoribosy transferase deficiency (Lesch-Nyhan syndrome); Compression neuropathy (hereditary neuropathy with liability to pressure palsies); Congenital adrenal hyperplasia (21-hydroxylase deficiency); congenital bilateral absence of vas deferens (Congenital absence of the vas deferens); Congenital erythropoietic porphyria; Congenital heart disease; Congenital hypomyelination (Charcot-Marie-Tooth disease #Type I/Charcot-Marie-Tooth disease #Type 4); Congenital hypothyroidism; Congenital methemoglobinemia (Methemoglobinemia #Congenital methaemoglobinaemia); Congenital osteosclerosis (achondroplasia); Congenital sideroblastic anaemia (X-linked sideroblastic anemia); Connective tissue disease; Conotruncal anomaly face syndrome (22q11.2 deletion syndrome); Cooley's Anemia (beta thalassemia); Copper storage disease (Wilson disease); Copper transport disease (Menkes disease); Coproporphyria, hereditary (hereditary coproporphyria); Coproporphyrinogen oxidase deficiency (hereditary coproporphyria); Cowden syndrome; CPO deficiency (hereditary coproporphyria); CPRO deficiency (hereditary coproporphyria); CPX deficiency (hereditary coproporphyria); Craniofacial dysarthrosis (Crouzon syndrome); Craniofacial Dysostosis (Crouzon syndrome); Cretinism (congenital hypothyroidism); Creutzfeldt-Jakob disease (prion disease); Cri du chat (Crohn's disease, fibrostenosing); Crouzon syndrome; Crouzon syndrome with acanthosis nigricans (Crouzonodermoskeletal syndrome); Crouzonodermoskeletal syndrome; CS (Cockayne syndrome) (Cowden syndrome); Curschmann-Batten-Steinert syndrome (myotonic dystrophy); cutis gyrata syndrome of Beare-Stevenson (Beare-Stevenson cubs gyrata syndrome); Disorder Mutation Chromosome; D-glycerite dehydrogenase deficiency (hyperoxaluria, primary); Dappled metaphysis syndrome (spondyloepimetaphyseal dysplasia, Strudwick type); DAT—Dementia Alzheimer's type (Alzheimer disease); Genetic hypercalciuria (Dent's disease); DBMD (muscular dystrophy, Duchenne and Becker types); Deafness with goiter (Pendred syndrome); Deafness-retinitis pigmentosa syndrome (Usher syndrome); Deficiency disease, Phenylalanine Hydroxylase (phenylketonuria); Degenerative nerve diseases; de Grouchy syndrome 1 (De Grouchy Syndrome); Dejerine-Sottas syndrome (Charcot-Marie-Tooth disease); Delta-aminolevulinate dehydratase deficiency porphyria (ALA dehydratase deficiency); Dementia (CADASIL); demyelinogenic leukodystrophy (Alexander disease); Dermatosparactic type of Ehlers-Danlos syndrome (Ehlers-Danlos syndrome #dermatosparaxis type); Dermatosparaxis (Ehlers-Danlos syndrome #dermatosparaxis type); developmental disabilities; dHMN (Amyotrophic lateral sclerosis #type 4); DHMN-V (distal spinal muscular atrophy, type V); DHTR deficiency (androgen insensitivity syndrome); Diffuse Globoid Body Sclerosis (Krabbe disease); DiGeorge syndrome; Dihydrotestosterone receptor deficiency (androgen insensitivity syndrome); distal spinal muscular atrophy, type V; DMI (Myotonic dystrophy #type1); DM2 (Myotonic dystrophy #type2); Down syndrome; DSMAV (distal spinal muscular atrophy, type V); DSN (Charcot-Marie-Tooth disease #type 4); DSS (Charcot-Marie-Tooth disease, type 4); Duchenne/Becker muscular dystrophy (muscular dystrophy, Duchenne and Becker types); Dwarf, achondroplastic (achondroplasia); Dwarf, thanatophoric (thanatophoric dysplasia); Dwarfism; Dwarfism-retinal atrophy-deafness syndrome (Cockayne syndrome); dysmyelinogenic leukodystrophy (Alexander disease); Dystrophia myotonica (myotonic dystrophy); dystrophia retinae pigmentosa-dysostosis syndrome (Usher syndrome); Early-Onset familial alzheimer disease (ED-FAD) (Alzheimer disease); EDS (Ehlers-Danlos syndrome); Ehlers-Danlos syndrome; Ekman-Lobstein disease (osteogenesis imperfecta); Entrapment neuropathy (hereditary neuropathy with liability to pressure palsies); Epiloia (tuberous sclerosis); EPP (erythropoietic protoporphyria); Erythroblastic anemia (beta thalassemia); Erythrohepatic protoporphyria (erythropoietic protoporphyria); Erythroid 5-aminolevulinate synthetase deficiency (X-linked sideroblastic anemia); Erythropoietic porphyria (congenital erythropoietic porphyria); Erythropoietic protoporphyria; Erythropoietic uroporphyrin (congenital erythropoietic porphyria); Eye cancer (retinoblastoma FA—Friedreich ataxia); Fabry disease; Facial injuries and disorders; Factor V Leiden thrombophilia; FALS (amyotrophic lateral sclerosis); familial acoustic neuroma (neurofibromatosis type II); familial adenomatous polyposis; familial Alzheimer disease (FAD) (Alzheimer disease); familial amyotrophic lateral sclerosis (amyotrophic lateral sclerosis); familial dysautonomia; familial fat-induced hypertriglyceridemia (lipoprotein lipase deficiency, familial); familial hemochromatosis (hemochromatosis); familial LPL deficiency (lipoprotein lipase deficiency, familial); familial nonpolyposis colon cancer (hereditary nonpolyposis colorectal cancer); familial paroxysmal polyserositis (Mediterranean fever, familial); familial PCT (porphyria cutanea tarda); familial pressure sensitive neuropathy (hereditary neuropathy with liability to pressure palsies); familial primary pulmonary hypertension (FPPH) (primary pulmonary hypertension); Familial Turner syndrome (Noonan syndrome); familial vascular leukoencephalopathy (CADASIL); FAP (familial adenomatous polyposis); FD (familial dysautonomia); Female pseudo-Turner syndrome (Noonan syndrome); Ferrochelatase deficiency (erythropoietic protoporphyria); ferroportin disease (Haemochromatosis #type 4); Fever (Mediterranean fever, familial); FG syndrome; FGFR3-associated coronal synostosis (Muenke syndrome); Fibrinoid degeneration of astrocytes (Alexander disease); Fibrocystic disease of the pancreas (cystic fibrosis); FMF (Mediterranean fever, familial); Foiling disease (phenylketonuria); fra(X) syndrome (fragile X syndrome); fragile X syndrome; Fragilitas ossium (osteogenesis imperfecta); FRAM syndrome (fragile X syndrome); FRDA (Friedreich's ataxia); Friedreich ataxia (Friedreich's ataxia); Friedreich's ataxia; FXS (fragile X syndrome); GBPD deficiency; Galactokinase deficiency disease (galactosemia); Galactose-1-phosphate uridyl-transferase deficiency disease (galactosemia); galactosemia; Galactosylceramidase deficiency disease (Krabbe disease); Galactosylceramide lipidosis (Krabbe disease); galactosylcerebrosidase deficiency (Krabbe disease); galactosylsphingosine lipidosis (Krabbe disease); GALL deficiency (Krabbe disease); GALT deficiency (galactosemia); Gaucher disease; Gaucher-like disease (pseudo-Gaucher disease); GBA deficiency (Gaucher disease type 1); GD (Gaucher's disease); Genetic brain disorders; genetic emphysema (alpha-1 antitrypsin deficiency); genetic hemochromatosis (hemochromatosis); Giant cell hepatitis, neonatal (Neonatal hemochromatosis); GLA deficiency (Fabry disease); Glioblastoma, retinal (retinoblastoma); Glioma, retinal (retinoblastoma); globoid cell leukodystrophy (GCL, GLD) (Krabbe disease); globoid cell leukoencephalopathy (Krabbe disease); Glucocerebrosidase deficiency (Gaucher disease); Glucocerebrosidosis (Gaucher disease); Glucosyl cerebroside lipidosis (Gaucher disease); Glucosylceramidase deficiency (Gaucher disease); Glucosylceramide beta-glucosidase deficiency (Gaucher disease); Glucosylceramide lipidosis (Gaucher disease); Glyceric aciduria (hyperoxaluria, primary); Glycine encephalopathy (Nonketotic hyperglycinemia); Glycolic aciduria (hyperoxaluria, primary); GM2 gangliosidosis, type 1 (Tay-Sachs disease); Goiter-deafness syndrome (Pendred syndrome); Graefe-Usher syndrome (Usher syndrome); Gronblad-Strandberg syndrome (pseudoxanthoma elasticum); Guenther porphyria (congenital erythropoietic porphyria); Gunther disease (congenital erythropoietic porphyria); Haemochromatosis (hemochromatosis); Hallgren syndrome (Usher syndrome); Harlequin Ichthyosis; Hb S disease (sickle cell anemia); HCH (hypochondroplasia); HCP (hereditary coproporphyria); Head and brain malformations; Hearing disorders and deafness; Hearing problems in children; HEF2A (hemochromatosis #type 2); HEF2B (hemochromatosis #type 2); Hematoporphyria (porphyria); Home synthetase deficiency (erythropoietic protoporphyria); Hemochromatoses (hemochromatosis); hemochromatosis; hemoglobin M disease (methemoglobinemia #beta-globin type); Hemoglobin S disease (sickle cell anemia); hemophilia; HEP (hepatoerythropoietic porphyria); hepatic AGT deficiency (hyperoxaluria, primary); hepatoerythropoietic porphyria; Hepatolenticular degeneration syndrome (Wilson disease); Hereditary arthro-ophthalmopathy (Stickler syndrome); Hereditary coproporphyria; Hereditary dystopic lipidosis (Fabry disease); Hereditary hemochromatosis (HHC) (hemochromatosis); Hereditary Inclusion Body Myopathy (skeletal muscle regeneration); Hereditary iron-loading anemia (X-linked sideroblastic anemia); Hereditary motor and sensory neuropathy (Charcot-Marie-Tooth disease); Hereditary motor neuronopathy (spinal muscular atrophy); Hereditary motor neuronopathy, type V (distal spinal muscular atrophy, type V); Hereditary Multiple Exostoses; Hereditary nonpolyposis colorectal cancer; Hereditary periodic fever syndrome (Mediterranean fever, familial); Hereditary Polyposis Coli (familial adenomatous polyposis); Hereditary pulmonary emphysema (alpha-1 antitrypsin deficiency); Hereditary resistance to activated protein C (factor V Leiden thrombophilia); Hereditary sensory and autonomic neuropathy type III (familial dysautonomia); Hereditary spastic paraplegia (infantile-onset ascending hereditary spastic paralysis); Hereditary spinal ataxia (Friedreich ataxia); Hereditary spinal sclerosis (Friedreich ataxia); Herrick's anemia (sickle cell anemia); Heterozygous DSMED (Weissenbacher-Zweymoller syndrome); Heterozygous otospondylomegaepiphyseal dysplasia (Weissenbacher-Zweymoller syndrome); HexA deficiency (Tay-Sachs disease); Hexosaminidase A deficiency (Tay-Sachs disease); Hexosaminidase alpha-subunit deficiency (variant B) (Tay-Sachs disease); HFE-associated hemochromatosis (hemochromatosis); HGPS (Progeria); Hippel-Lindau disease (von Hippel-Lindau disease); HLAH (hemochromatosis); HMN V (distal spinal muscular atrophy, type V); HMSN (Charcot-Marie-Tooth disease); HNPCC (hereditary nonpolyposis colorectal cancer); HNPP (hereditary neuropathy with liability to pressure palsies); homocystinuria; Homogentisic acid oxidase deficiency (alkaptonuria); Homogentisic aciduria (alkaptonuria); Homozygous porphyria cutanea tarda (hepatoerythropoietic porphyria); HP1 (hyperoxaluria, primary); HP2 (hyperoxaluria, primary); HPA (hyperphenylalaninemia); HPRT—Hypoxanthine-guanine phosphoribosyltransferase deficiency (Lesch-Nyhan syndrome); HSAN type III (familial dysautonomia); HSAN3 (familial dysautonomia); HSN-III (familial dysautonomia); Human dermatosparaxis (Ehlers-Danlos syndrome #dermatosparaxis type); Huntington's disease; Hutchinson-Gilford progeria syndrome (progeria); Hyperandrogenism, nonclassic type, due to 21-hydroxylase deficiency (21-hydroxylase deficiency); Hyperchylomicronemia, familial (lipoprotein lipase deficiency, familial); hyperglycinemia with ketoacidosis and leukopenia (propionic acidemia); Hyperlipoproteinemia type I (lipoprotein lipase deficiency, familial); hyperoxaluria, primary; hyperphenylalaninaemia (hyperphenylalaninemia); hyperphenylalaninemia; Hypochondrodysplasia (hypochondroplasia); hypochondrogenesis; hypochondroplasia; Hypochromic anemia (X-linked sideroblastic anemia); Hypocupremia, congenital; Menkes syndrome); hypoxanthine phosphoribosyltransferse (HPRT) deficiency (Lesch-Nyhan syndrome); IAHSP (infantile-onset ascending hereditary spastic paralysis); idiopathic hemochromatosis (hemochromatosis, type 3); Idiopathic neonatal hemochromatosis (hemochromatosis, neonatal); Idiopathic pulmonary hypertension (primary pulmonary hypertension); Immune system disorders (X-linked severe combined immunodeficiency); Incontinentia Pigmenti; Infantile cerebral Gaucher's disease (Gaucher disease type 2); Infantile Gaucher disease (Gaucher disease type 2); infantile-onset ascending hereditary spastic paralysis; Infertility; inherited emphysema (alpha-1 antitrypsin deficiency); Inherited human transmissible spongiform encephalopathies (prion disease); inherited tendency to pressure palsies (hereditary neuropathy with liability to pressure palsies); Insley-Astley syndrome (otospondylomegaepiphyseal dysplasia); Intermittent acute porphyria syndrome (acute intermittent porphyria); Intestinal polyposis-cutaneous pigmentation syndrome (Peutz-Jeghers syndrome); IP (incontinentia pigmenti); Iron storage disorder (hemochromatosis); Isodicentric 15 (idic15); Isolated deafness (nonsyndromic deafness); Jackson-Weiss syndrome; JH (Haemochromatosis #type 2); Joubert syndrome; JPLS (Juvenile Primary Lateral Sclerosis); juvenile amyotrophic lateral sclerosis (Amyotrophic lateral sclerosis #type 2); Juvenile gout, choreoathetosis, mental retardation syndrome (Lesch-Nyhan syndrome); juvenile hyperuricemia syndrome (Lesch-Nyhan syndrome); JWS (Jackson-Weiss syndrome); KD (X-linked spinal-bulbar muscle atrophy); Kennedy disease (X-linked spinal-bulbar muscle atrophy); Kennedy spinal and bulbar muscular atrophy (X-linked spinal-bulbar muscle atrophy); Kerasin histiocytosis (Gaucher disease); Kerasin lipoidosis (Gaucher disease); Kerasin thesaurismosis (Gaucher disease); ketotic glycinemia (propionic acidemia); ketotic hyperglycinemia (propionic acidemia); Kidney diseases (hyperoxaluria, primary); Klinefelter syndrome; Klinefelter's syndrome; Kniest dysplasia; Krabbe disease; Lacunar dementia (CADASIL); Langer-Saldino achondrogenesis (achondrogenesis, type II); Langer-Saldino dysplasia (achondrogenesis, type II); Late-onset Alzheimer disease (Alzheimer disease #type 2); Late-onset familial Alzheimer disease (AD2) (Alzheimer disease #type 2); late-onset Krabbe disease (LIED) (Krabbe disease); Learning Disorders (Learning disability); Lentiginosis, perioral (Peutz-Jeghers syndrome); Lesch-Nyhan syndrome; Leukodystrophies; leukodystrophy with Rosenthal fibers (Alexander disease); Leukodystrophy, spongiform (Canavan disease); LFS (Li-Fraumeni syndrome); Li-Fraumeni syndrome; Lipase D deficiency (lipoprotein lipase deficiency, familial); LIPD deficiency (lipoprotein lipase deficiency, familial); Lipidosis, cerebroside (Gaucher disease); Lipidosis, ganglioside, infantile (Tay-Sachs disease); Lipoid histiocytosis (kerasin type) (Gaucher disease); lipoprotein lipase deficiency, familial; Liver diseases (galactosemia); Lou Gehrig disease (amyotrophic lateral sclerosis); Louis-Bar syndrome (ataxia-telangiectasia); Lynch syndrome (hereditary non-polyposis colorectal cancer); Lysyl-hydroxylase deficiency (Ehlers-Danlos syndrome #1ryphoscoliosis type); Machado-Joseph disease (Spinocerebellar ataxia #type 3); Male breast cancer (breast cancer); Male genital disorders; Male Turner syndrome (Noonan syndrome); Malignant neoplasm of breast (breast cancer); malignant tumor of breast (breast cancer); Malignant tumor of urinary bladder (bladder cancer); Mammary cancer (breast cancer); Marfan syndrome IS; Marker X syndrome (fragile X syndrome); Martin-Bell syndrome (fragile X syndrome); McCune-Albright syndrome; McLeod syndrome; MEDNIK; Mediterranean Anemia (beta thalassemia); Mediterranean fever, familial; Mega-epiphyseal dwarfism (otospondylomegaepiphyseal dysplasia); Menkes syndrome (Menkes syndrome); Menkes syndrome; Mental retardation with osteocartilaginous abnormalities (Coffin-Lowry syndrome); Metabolic disorders; Metatropic dwarfism, type II (Kniest dysplasia); Metatropic dysplasia type II (Kniest dysplasia); Methemoglobinemia #beta-globin type; methylmalonic acidemia; MFS (Marfan syndrome); MHAM (Cowden syndrome); MK (Menkes syndrome); Micro syndrome; Microcephaly; MMA (methylmalonic acidemia); MNK (Menkes syndrome); Monosomy Ip36 syndrome (Ip36 deletion syndrome); monosomy X (Turner syndrome); Motor neuron disease, amyotrophic lateral sclerosis (amyotrophic lateral sclerosis); Movement disorders; Mowat-Wilson syndrome; Mucopolysaccharidosis (MPS I); Mucoviscidosis (cystic fibrosis); Muenke syndrome; Multi-Infarct dementia (CADASIL); Multiple carboxylase deficiency, late-onset (biotinidase deficiency); Multiple hamartoma syndrome (Cowden syndrome); Multiple neurofibromatosis (neurofibromatosis); Muscular dystrophy; Muscular dystrophy, Duchenne and Becker type; Myotonia atrophia (myotonic dystrophy); Myotonia dystrophica (myotonic dystrophy); myotonic dystrophy; Myxedema, congenital (congenital hypothyroidism); Nance-Insley syndrome (otospondylomegaepiphyseal dysplasia); Nance-Sweeney chondrodysplasia (otospondylomegaepiphyseal dysplasia); NBIAI (pantothenate kinase-associated neurodegeneration); Neill-Dingwall syndrome (Cockayne syndrome); Neuroblastoma, retinal (retinoblastoma); Neurodegeneration with brain iron accumulation type 1 (pantothenate kinase-associated neurodegeneration); Neurofibromatosis type I; Neurofibromatosis type II; Neurologic diseases; Neuromuscular disorders; neuronopathy, distal hereditary motor, type V (Distal spinal muscular atrophy #type V); neuronopathy, distal hereditary motor, with pyramidal features (Amyotrophic lateral sclerosis #type 4); NF (neurofibromatosis); Niemann-Pick (Niemann-Pick disease); Noack syndrome (Pfeiffer syndrome); Nonketotic hyperglycinemia (Glycine encephalopathy); Non-neuronopathic Gaucher disease (Gaucher disease type I); Non-phenylketonuric hyperphenylalaninemia (tetrahydrobiopterin deficiency); nonsyndromic deafness; Noonan syndrome; Norrbottnian Gaucher disease (Gaucher disease type 3); Ochronosis (alkaptonuria); Ochronotic arthritis (alkaptonuria); OI (osteogenesis imperfecta); DSMED (otospondylomegaepiphyseal dysplasia); osteogenesis imperfecta; Osteopsathyrosis (osteogenesis imperfecta); Osteosclerosis congenita (achondroplasia); Oto-spondylo-megaepiphyseal dysplasia (otospondylomegaepiphyseal dysplasia); otospondylomegaepiphyseal dysplasia; Oxalosis (hyperoxaluria, primary); Oxaluria, primary (hyperoxaluria, primary); pantothenate kinase-associated neurodegeneration; Patau Syndrome (Trisomy 13); PBGD deficiency (acute intermittent porphyria); PCC deficiency (propionic acidemia); PCT (porphyria cutanea tarda); PDM (Myotonic dystrophy #type 2); Pendred syndrome; Periodic disease (Mediterranean fever, familial); Periodic peritonitis (Mediterranean fever, familial); Periorificial lentiginosis syndrome (Peutz-Jeghers syndrome); Peripheral nerve disorders (familial dysautonomia); Peripheral neurofibromatosis (neurofibromatosis 1); Peroneal muscular atrophy (Charcot-Marie-Tooth disease); peroxisomal alanine:glymlate aminotransferase deficiency (hyperoxaluria, primary); Peutz-Jeghers syndrome; Pfeiffer syndrome; Phenylalanine hydroxylase deficiency disease (phenylketonuria); phenylketonuria; Pheochromocytoma (von Hippel-Lindau disease); Pierre Robin syndrome with fetal chondrodysplasia (Weissenbacher-Zweymoller syndrome); Pigmentary cirrhosis (hemochromatosis); PJS (Peutz-Jeghers syndrome); PKAN (pantothenate kinase-associated neurodegeneration); PKU (phenylketonuria); Plumboporphyria (ALA deficiency porphyria); PMA (Charcot-Marie-tooth disease); polyostotic fibrous dysplasia (McCune-Albright syndrome); polyposis cob (familial adenomatous polyposis); polyposis, hamartomatous intestinal (Peutz-Jeghers syndrome); polyposis, intestinal, II (Peutz-Jeghers syndrome); polyps-and-spots syndrome (Peutz-Jeghers syndrome); Porphobilinogen synthase deficiency (ALA deficiency porphyria); porphyria; porphyrin disorder (porphyria); PPH (primary pulmonary hypertension); PPR deficiency (variegate porphyria); Prader-Labhart-Willi syndrome (Prader-Willi syndrome); Prader-Willi syndrome; presenile and senile dementia (Alzheimer disease); primary hemochromatosis (hemochromatosis); primary hyperuricemia syndrome (Lesch-Nyhan syndrome); primary pulmonary hypertension; primary senile degenerative dementia (Alzheimer disease); prion disease; procollagen type EDS VII, mutant (Ehlers-Danlos syndrome #arthrochalasia type); progeria (Hutchinson Gilford Progeria Syndrome); Progeria-like syndrome (Cockayne syndrome); progeroid nanism (Cockayne syndrome); progressive chorea, chronic hereditary (Huntington) (Huntington's disease); progressive muscular atrophy (spinal muscular atrophy); progressively deforming osteogenesis imperfecta with normal sclerae (Osteogenesis imperfecta #type III); PRUMM (Myotonic dystrophy #type 2); propionic academia; propionyl-CoA carboxylase deficiency (propionic acidemia); protein C deficiency; protein S deficiency; protoporphyria (erythropoietic protoporphyria); protoporphyrinogen oxidase deficiency (variegate porphyria); proximal myotonic dystrophy (Myotonic dystrophy #type 2); proximal myotonic myopathy (Myotonic dystrophy #type 2); pseudo-Gaucher disease; pseudo-Ullrich-Turner syndrome (Noonan syndrome); pseudoxanthoma elasticum; psychosine lipidosis (Krabbe disease); pulmonary arterial hypertension (primary pulmonary hypertension); pulmonary hypertension (primary pulmonary hypertension); PWS (Prader-Willi syndrome); PXE—pseudoxanthoma elasticum (pseudoxanthoma elasticum); Rb (retinoblastoma); Recklinghausen disease, nerve (neurofibromatosis 1); Recurrent polyserositis (Mediterranean fever, familial); Retinal disorders; Retinitis pigmentosa-deafness syndrome (Usher syndrome); Retinoblastoma; Rett syndrome; RFALS type 3 (Amyotrophic lateral sclerosis #type 2); Ricker syndrome (Myotonic dystrophy #type 2); Riley-Day syndrome (familial dysautonomia); Roussy-Levy syndrome (Charcot-Marie-Tooth disease); RSTS (Rubinstein-Taybi syndrome); RTS (Rett syndrome) (Rubinstein-Taybi syndrome); RTT (Rett syndrome); Rubinstein-Taybi syndrome; Sack-Barabas syndrome (Ehlers-Danlos syndrome, vascular type); SADDAN; sarcoma family syndrome of Li and Fraumeni (Li-Fraumeni syndrome); sarcoma, breast, leukemia, and adrenal gland (SBLA) syndrome (Li-Fraumeni syndrome); SBLA syndrome (Li-Fraumeni syndrome); SBMA (X-linked spinal-bulbar muscle atrophy); SCD (sickle cell anemia); Schwannoma, acoustic, bilateral (neurofibromatosis 2); SCIDXI (X-linked severe combined immunodeficiency); sclerosis tuberose (tuberous sclerosis); SDAT (Alzheimer disease); SED congenita (spondyloepiphyseal dysplasia congenita); SED Strudwick (spondyloepimetaphyseal dysplasia, Strudwick type); SEDC (spondyloepiphyseal dysplasia congenita); SEMD, Strudwick type (spondyloepimetaphyseal dysplasia, Strudwick type); senile dementia (Alzheimer disease #type 2); severe achondroplasia with developmental delay and acanthosis nigricans (SADDAN); Shprintzen syndrome (22q11.2 deletion syndrome); sickle cell anemia; skeleton-skin-brain syndrome (SADDAN); Skin pigmentation disorders; SMA (spinal muscular atrophy); SMED, Strudwick type (spondyloepimetaphyseal dysplasia, Strudwick type); SMED, type I (spondyloepimetaphyseal dysplasia, Strudwick type); Smith Lemli Dpitz Syndrome; South-African genetic porphyria (variegate porphyria); spastic paralysis, infantile onset ascending (infantile-onset ascending hereditary spastic paralysis); Speech and communication disorders; sphingolipidosis, Tay-Sachs (Tay-Sachs disease); spinal-bulbar muscular atrophy; spinal muscular atrophy; spinal muscular atrophy, distal type V (Distal spinal muscular atrophy #type V); spinal muscular atrophy, distal, with upper limb predominance (Distal spinal muscular atrophy #type V); spinocerebellar ataxia; spondyloepimetaphyseal dysplasia, Strudwick type; spondyloepiphyseal dysplasia congenital; spondyloepiphyseal dysplasia (collagenopathy, types II and XI); spondylometeepiphyseal dysplasia congenita, Strudwick type (spondyloepimetaphyseal dysplasia, Strudwick type); spondylometaphyseal dysplasia (SMD) (spondyloepimetaphyseal dysplasia, Strudwick type); spondylometaphyseal dysplasia, Strudwick type (spondyloepimetaphyseal dysplasia, Strudwick type); spongy degeneration of central nervous system (Canavan disease); spongy degeneration of the brain (Canavan disease); spongy degeneration of white matter in infancy (Canavan disease); sporadic primary pulmonary hypertension (primary pulmonary hypertension); SSB syndrome (SADDAN); steely hair syndrome (Menkes syndrome); Steinert disease (myotonic dystrophy); Steinert myotonic dystrophy syndrome (myotonic dystrophy); Stickler syndrome; stroke (CADASIL); Strudwick syndrome (spondyloepimetaphyseal dysplasia, Strudwick type); subacute neuronopethic Gaucher disease (Gaucher disease type 3); Swedish genetic porphyria (acute intermittent porphyria); Swedish porphyria (acute intermittent porphyria); Swiss cheese cartilage dysplasia (Kniest dysplasia); Tay-Sachs disease; TD—thanatophoric dwarfism (thanatophoric dysplasia); TD with straight femurs and cloverleaf skull (thanatophoric dysplasia #Type 2); Telangiectasia, cerebello-oculocutaneous (ataxia-telangiectasia); Testicular feminization syndrome (androgen insensitivity syndrome); tetrahydrobiopterin deficiency; TFM—testicular feminization syndrome (androgen insensitivity syndrome); thalassemia intermedia (beta thalassemia); Thalassemia Major (beta thalassemia); thanatophoric dysplasia; thiamine-responsive megaloblastic anemia with diabetes mellitus and sensorineural deafness; Thrombophilia due to deficiency of cofactor for activated protein C, Leiden type (factor V Leiden thrombophilia); Thyroid disease; Tomaculous neuropathy (hereditary neuropathy with liability to pressure palsies); Total HPRT deficiency (Lesch-Nyhan syndrome); Total hypoxanthine-guanine phosphoribosyl transferase deficiency (Lesch-Nyhan syndrome); Tourette's Syndrome; Transmissible dementias (prion disease); Transmissible spongiform encephalopathies (prion disease); Treacher Collins syndrome; Trias fragilitis ossium (osteogenesis imperfecta #Type I); triple X syndrome; Triplo X syndrome (triple X syndrome); Trisomy 21 (Down syndrome); Trisomy X (triple X syndrome); Troisier-Hanot-Chauffard syndrome (hemochromatosis); TS (Turner syndrome); TSD (Tay-Sachs disease); TSEs (prion disease); tuberose sclerosis (tuberous sclerosis); tuberous sclerosis; Turner syndrome; Turner syndrome in female with X chromosome (Noonan syndrome); Turner's phenotype, karyotype normal (Noonan syndrome); Turner's syndrome (Turner syndrome); Turner-like syndrome (Noonan syndrome); Type 2 Gaucher disease (Gaucher disease type 2); Type 3 Gaucher disease (Gaucher disease type 3); UDP-galactose-4-epimerase deficiency disease (galactosemia); UDP glucose 4-epimerase deficiency disease (galactosemia); UDP glucose hexose-1-phosphate uridylyltransferase deficiency (galactosemia); Ullrich-Noonan syndrome (Noonan syndrome); Ullrich-Turner syndrome (Turner syndrome); Undifferentiated deafness (nonsyndromic deafness); UPS deficiency (acute intermittent porphyria); Urinary bladder cancer (bladder cancer); UHL) deficiency (porphyria cutanea tarda); Uroporphyrinogen decarboxylase deficiency (porphyria cutanea tarda); Uroporphyrinogen synthase deficiency (acute intermittent porphyria); URDS deficiency (congenital erythropoietic porphyria); Usher syndrome; UTP hexose-1-phosphate uridylyltransferase deficiency (galactosemia); Van Bogaert-Bertrand syndrome (Canavan disease); Van der Hoeve syndrome (osteogenesis imperfecta #Type I); variegate porphyria; Velocardiofacial syndrome (22q11.2 deletion syndrome); VHL syndrome (von Hippel-Lindau disease); Vision impairment and blindness (Alstrom syndrome); Von Bogaert-Bertrand syndrome (Canavan disease); von Hippel-Lindau disease; Von Recklenhausen-Applebaum disease (hemochromatosis); von Recklinghausen disease (neurofibromatosis 1); VP (variegate porphyria); Vrolik disease (osteogenesis imperfecta); Waardenburg syndrome; Warburg Sjo Fledelius Syndrome (Micro syndrome); WD (Wilson disease); Weissenbacher-Zweymoller syndrome; Wilson disease; Wilson's disease (Wilson disease); Wolf-Hirschhorn syndrome; Wolff Periodic disease (Mediterranean fever, familial); WZS (Weissenbacher-Zweymoller syndrome); Xeroderma Pigmentosum; X-linked mental retardation and macroorchidism (fragile X syndrome); X-linked primary hyperuricemia (Lesch-Nyhan syndrome); X-linked severe combined immunodeficiency; X-linked sideroblastic anemia; X-linked spinal-bulbar muscle atrophy (Kennedy disease); X-linked uric aciduria enzyme defect (Lesch-Nyhan syndrome); X-SCID (X-linked severe combined immunodeficiency); XLSA (X-linked sideroblastic anemia); XSCID (X-linked severe combined immunodeficiency); XXX syndrome (triple X syndrome); XXXX syndrome (48, XXXX); XXXXX syndrome (49, XXXXX); XXY syndrome (Klinefelter syndrome); XXY trisomy (Klinefelter syndrome); XYY karyotype (47,XYY syndrome); XYY syndrome (47,XYY syndrome); and YY syndrome (47,XYY syndrome).

Moreover, a disease in the context of the present invention may preferably be any disease, disorder or condition indicated in feature c5 of Table 1, preferably for the therapeutic protein encoded by the at least one coding sequence of the RNA according to the invention.

In a further preferred aspect, the RNA according to the invention or the (pharmaceutical) composition comprising the RNA according to the invention (or a plurality of inventive RNAs as defined herein) may be used for the preparation of a pharmaceutical composition, particularly for purposes as defined herein, preferably for the use in gene therapy in the treatment or prevention of diseases as defined herein.

The (pharmaceutical) composition may furthermore be used in gene therapy particularly in the treatment of a disease or a disorder, preferably as defined herein.

According to a further aspect, the present invention also provides kits, particularly kits of parts. Such kits, particularly kits of parts, typically comprise as components alone or in combination with further components as defined herein at least one inventive RNA species as defined herein, or the inventive (pharmaceutical) composition comprising the RNA according to the invention. The at least one RNA as defined herein, is optionally in combination with further components as defined herein, whereby the at least one RNA is provided separately (first part of the kit) from at least one other part of the kit comprising one or more other components. The (pharmaceutical) composition may occur in one or different parts of the kit. As an example, e.g. at least one part of the kit may comprise at least one RNA as defined herein, and at least one further part of the kit at least one other component as defined herein, e.g. at least one other part of the kit may comprise at least one (pharmaceutical) composition or a part thereof, e.g. at least one part of the kit may comprise the RNA as defined herein, at least one further part of the kit at least one other component as defined herein, at least one further part of the kit at least one component of the (pharmaceutical) composition or the (pharmaceutical) composition as a whole, and at least one further part of the kit e.g. at least one pharmaceutical carrier or vehicle, etc. In case the kit or kit of parts comprises a plurality of RNAs as described herein, one component of the kit can comprise only one, several or all RNAs comprised in the kit. In an alternative embodiment every/each RNA species may be comprised in a different/separate component of the kit such that each component forms a part of the kit. Also, more than one RNA as defined herein may be comprised in a first component as part of the kit, whereas one or more other (second, third etc.) components (providing one or more other parts of the kit) may either contain one or more than one RNA as defined herein, which may be identical or partially identical or different from the first component. The kit or kit of parts may furthermore contain technical instructions with information on the administration and dosage of the RNA according to the invention, the (pharmaceutical) composition of the invention or of any of its components or parts, e.g. if the kit is prepared as a kit of parts.

Also comprised by the present invention are methods of treating or preventing a disease or disorder, preferably as defined herein, by administering to a subject in need thereof a pharmaceutically effective amount of the RNA or the pharmaceutical composition according to the invention. Such a method typically comprises an optional first step of preparing the RNA or the composition of the present invention, and a second step, comprising administering (a pharmaceutically effective amount of) said composition to a patient/subject in need thereof. A subject in need thereof will typically be a mammal. In the context of the present invention, the mammal is preferably selected from the group comprising, without being limited thereto, e.g. goat, cattle, swine, dog, cat, donkey, monkey, ape, a rodent such as a mouse, hamster, rabbit and, particularly, human, wherein the mammal typically suffers from a disease or disorder as defined herein.

As described above, it is referenced throughout the application to Table 1.

Each protein entry in that table, i.e. beginning with the number sign # and ending with a semicolon (;) corresponds to a preferred therapeutic protein as defined herein and provides the abbreviation of the name of the peptide or protein indicated under feature c1 ("Peptide or protein") and the NCBI database accession number of that peptide or protein in that entry under feature c2 ("NCBI Ref Seq ID"). Feature c 3 of that entry provides the SEQ ID NO: (as comprised in the sequence listing herein) corresponding to the amino acid sequence of that peptide or protein. Feature c4 of that entry provides the SEQ ID NO: (as comprised in the sequence listing herein) corresponding to the nucleic acid sequence of preferred RNA's encoding that peptide or protein. Feature c5 provides one or more disease, disorder or condition, for the treatment or prevention of which the peptide or protein identified by features c1 to c4 of that entry is preferably used. Table 1 starts with entry "c1(37135 (Sep-01)) c3(1) c4(26115, 39172, 52229, 13058, 65286) c5(d, c, e, b)" and ends with entry "c1(7773) c2(XP_011539507) c3(13057) c4(39171, 52228, 65285, 26114, 78342) c5(aA)" (all in accordance with the formula and the Abbreviation Dictionary as described above; number signs (#) and semicolons were introduced for ease of readability to separate the different entries from another).

Table 1: shows characteristic features of each peptide or protein of the invention, whereby each peptide or protein is represented by the above defined formula "c1(Peptide or protein or gene) c2(NCBI Ref Seq ID) c3(Protein SEQ ID NO) c4(RNA SEQ ID NOs) c5(Related disease, disorder or condition)"—for feature c5 specific reference is made to Table C, i.e. the Abbreviation Dictionary for the feature "Related disease, disorder or condition" (corresponding to feature "c5"), whereby each Related disease, disorder or condition is depicted with a specific abbreviation and its written form as described herein (cf. detailed explanation of Table 1 and its corresponding formula above).

Formula: #c1(Peptide or protein or gene) c2(NCBI Ref Seq ID) c3(Protein SEQ ID NO) c4(RNA SEQ ID NOs) c5(Related disease, disorder or condition);

c1(Peptide or protein or gene) c2(NCBI Ref Seq ID) c3(Protein SEQ ID NO) c4(RNA SEQ ID NOs) c5(Related disease, disorder or condition); #c1(37135 (Sep-01)) c2(NP_443070) c3(1) c4(26115, 39172, 52229, 13058, 65286) c5(d, c, e, b); #c1(37500 (Sep-02)) c2(NP_001008492) c3(2) c4(26116, 39173, 52230, 13059, 65287) c5(g, m, k, h, f, j, n, i, l); #c1(37865 (Sep-03)) c2(NP_061979) c3(3) c4(26117, 39174, 52231, 13060, 65288) c5(p, o); #c1(38231 (Sep-04)) c2(NP_001185642) c3(4) c4(26118, 39175, 52232, 13061, 65289) c5(r, b, k, w, D, s, z, A, e, y, d, t, B, F, q, u, v, G, x, f, E, C); #c1(38596 (Sep-05)) c2(NP_001009939) c3(5) c4(26119, 39176, 52233, 13062, 65290) c5(L, I, t, h, v, K, J, M, G, H); #c1(38961 (Sep-06)) c2(NP_055944) c3(G) c4(26120, 39177, 52234, 131E3, 65291) c5(M, h, N, J); #c1(39326 (Sep-07)) c2(NP_001011553) c3(1) c4(26121, 39178, 52235, 13064, 65292) c5(w, P, f, D, k); #c1(40057 (Sep-09)) c2(NP_001106963) c3(8) c4(26122, 39179, 52236, 131E5, 65293) c5(A, b, X, s, LI, y, S, aa, h, f, F, M, B, n, u, R, g, 7, V, ae, J, ad, W, D, ac, ah, Y, ag, ab, T, af); #c1(40422 (Sep-10)) c2(NP_653311) c3(9) c4(26123, 39180, 52237, 13066, 65294) c5(T, b); #c1(40787 (Sep-11)) c2(NP_060713) c3(10) c4(26124, 39181, 52238, 13067, 65295) c5(h, ak, J, s, aj, ai); #c1(41153 (Sep-12)) c2(NP_001147930) c3(11) c4(26125, 39182, 52239, 13068, 65296) c5(am, al); #c1(41883 (Sep-14)) c2(NP_997249) c3(12) c4(26126, 39183, 52240, 13069, 65297) c5(w); #c1(A1BG) c2(NP_570602) c3(13) c4(26127, 39184, 52241, 13070, 65298) c5(ao, an, P, w, ar, as, aq, ap); #c1(A1CF) c2(NP_001185747) c3(14) c4(26128, 39185, 52242, 13071, 65299) c5(az, ao, ax, aw, V, X, t, aB, G, aE, W, aC, P, au, ay, aA, aD, ar, av, at, U); #c1(A2M) c2(NP_000005) c3(15) c4(26129, 39186, 52243, 13072, 65300) c5(f, b, k, aF, bo, aN, bg, A, bb, bf, al, ba, aK, aW, bi, aX, bn, bj, aQ, q, aO, aJ, bl, aV, bm, o, be, aP, aC, bc, v, bp, bd, aR, aZ, bh, x, aS, aM, aL, aH, aY, B, bk, bq, I, aU, aT, aG); #c1(A2ML1) c2(NP_653271) c3(16) c4(26130, 39187, 52244, 13073, 65301) c5(bs, br, o); #c1(A4GNT) c2(NP_057245) c3(17) c4(26131, 39188, 52245, 13074, 65302) c5(aw, b, bx, bu, ag, bt, by, bw, by); #c1(AAAS) c2(NP_001166937) c3(18) c4(26132, 39189, 52246, 13075, 65303) c5(bP, bL, cf, bA, bS, b, aF, bZ, bz, bW, bf, bD, bF, bG, y, bC, bQ, aX, bE, bX, f, q, bO, cc, cg, u, o, bU, bJ, bK, v, cd, bN, bR, P, H, ca, aM, aL, co, bm, bl, bV, bY, cb, bH, bM, aA, at, bT, ap); #c1(AACS) c2(NP_076417) c3(19) c4(26133, 39190, 52247, 13076, 65304) c5(ch, aA); #c1(AADAC) c2(NP_001077) c3(20) c4(26134, 39191, 52248, 13077, 65305) c5(cj, ck, X, h, w, cl, av, u, ci, y, n); #c1(AAGAB) c2(NP_078942) c3(21) c4(26135, 39192, 52249, 13078, 65306) c5(cu, co, cr, cn, ad, cm, cs, ct, cp, eq); #c1(AAK1) c2(NP_055726) c3(22) c4(26136, 39193, 52250, 13079, G5307) c5(cv, aF, bj); #c1(AANAT) c2(NP_001160051) c3(23) c4(26137, 39194, 52251, 13080, 65308) c5(aX, V, I, u, aY, ch, ak, cx, cz, cB, a, cy, U, cC, cw, y); #c1(AARD) c2(NP_001020528) c3(24) c4(26138, 39195, 52252, 13081, 65309) c5(cy); #c1(AARS2) c2(NP_065796) c3(25) c4(26139, 39196, 52253, 13082, 65310) c5(cD, cG, cJ, cK, cE, cH, ay, bq, cl, cF); #c1(AARS) c2(NP_001596) c3(26) c4(26140, 39197, 52254, 13083, 65311) c5(cN, cG, ac, cH, ay, cL, cl, cM); #c1(AASDH) c2(NP_001273597) c3(27) c4(26141, 39198, 52255, 13084, 65312) c5(ar); #c1(AASDHPPT) c2(NP_056238) c3(28) c4(26142, 39199, 52256, 13085, 65313) c5(P, bb, cO); #c1(AASS) c2(NP_005754) c3(29) c4(26143, 39200, 52257, 13086, 65314) c5(cR, cQ, cP); #c1(AATF) c2(NP_036270) c3(30) c4(26144, 39201, 52258, 13087, 65315) c5(cW, b, cV, cS, J, cU, cX, cT, T, cs, aA, u, y); #c1(AATK) c2(NP_001073864) c3(31) c4(26145, 39202, 52259, 13088, 65316) c5(cY, da, aX, cZ, cO); #c1(ABAT) c2(XP_011520703) c3(32) c4(26146, 39203, 52260, 13089, 65317) c5(de, dj, dg, ch, dm, cz, dk, do, dd, dn, dc, db, di, df, dh, dl); #c1(ABCA12) c2(NP_056472) c3(33) c4(26147, 39204, 52261, 13090, 65318) c5(dx, du, aX, dw, dy, u, f, dt, dz, dv, ds, o, cV, dq, dp, dr, y); #c1(ABCA13) c2(NP_689914) c3(34) c4(26148, 39205, 52262, 13091, 65319) c5(dA, aY, ak, dB, dc, cM); #c1(ABCA1) c2(NP_005493) c3(35) c4(26149, 39206, 52263, 13092, 65320) c5(ek, dx, dM, dN, dD, aN, eC, eW, en, ak, bf, eP, aK, e, O, at, dC, dv, cy, dl, fH, fu, g, fe, aC, bK, du, bp, ft, ee, fx, dL, fp, dH, eH, fM, dS, eU, fN, fc, cT, dX, i, dc, bq, aA, fl, fi, X, fE, dE, eu, dV, U, ex, fR, cM, ed, co, eK, fm, ag, eD, fF, f, N, fb, bu, dZ, B, cs, by, av, fy, bm, eS, em, V, ae, eE, cx, bd, eX, eq, fv, fJ, dO, eF, dP, aY, fS, or, fL, dY, ep, fK, ej, dR, fD, dF, ap, fn, bt, b, eR, eY, m, ey, eV, aO, d, oc, bb, eA, q, dW, es, dB, ff, ar, u, aE, o, fh, dG, fs, I, el, dT, dK, ad, G, ew, fC, et, fA, eT, eQ, eo, ef, fg, fl, I, fj, y, bL, A, eZ, fd, fr, en, ea, di, fw, eM, aW, fG, aX, dJ, h, fB, fa, eN, ob, ev, el, aV, fQ, fk, ax, ez, cV, be, J, ei, dt, dU, P, T, fD, by, fz, ac, aM, eJ, eh, eL, eB, fo, fP, fq, eg, eG); #c1(ABCA2) c2(NP_001597) c3(36) c4(26150, 39207, 52264, 13093, 65321) c5(g, m, fU, b, Y, bK, f, q, cV, fT, av, o); #c1(ABCA3) c2(NP_001080) c3(37) c4(26151, 39208, 52265, 13094, 65322) c5(fZ, fX, gb, h, fV, gf, gi, gd, ga, dy, gh, gc, aZ, gg, cl, go, fy, dp, fW, fY); #c1(ABCA5) c2(NP_758424) c3(38) c4(26152, 39209, 52266, 13095, 65323) c5(x, I, bj, i); #c1(ABCAG) c2(NP_525023) c3(39) c4(26153, 39210, 52267, 13096, 65324) c5(gj, I, i); #c1(ABCA7) c2(NP_061985) c3(40) c4(26154, 39211, 52268, 13097, 65325) c5(gk, aC, gm, gn, o, i, I, aV, gl, aW, at); #c1(ABCA9) c2(NP_525022) c3(41) c4(26155, 39212, 52269, 13098, 65326) c5(X, av, bb); #c1(ABCB11) c2(NP_003733) c3(42) c4(26156, 39213, 52270, 13099, 65327) c5(gG, gB, aw, b, X, gw, au, z, al, y, gr, gC, gq, gz, q, az, av, u, gD, em, bm, gH, gp, gv, dt, eX, gy, gF, ac, gE, gs, gt, go, ex, gA, gu, i, fN, I, bh, at, gx, bT); #c1(ABCB1) c2(NP_000918) c3(43) c4(26157, 39214, 52271, 13100, 65328) c5(gK, by, hg, aw, bx, hY, F, dD, iX, iU, eH, in, w, hM, ak, cO, hJ, bf, e, O, gD, gM, hO, it, jv, hF, b, iR, jS, t, hu, cl, dl, jk, hG, iZ, gP, jq, fH, jC, iz, n, g, ha, fe, jH, aC, bK, ft, cs, gJ, gm, bp, gY, iJ, jx, x, fx, hR, hj, dH, jE, M, hQ, bm, hx, ie, hn, iV, cT, bk, i, do, hC, aA, jl, bT, ib, bP, is, id, il, iF, X, iW, iP, jz, eu, jf, hS, fU, iG, bo, cA, bw, U, ho, io, cM, jb, co, ip, gW, jy, fi, f, N, bu, gX, B, iv, by, jD, ay, fy, hD, iT, cj, d, jB, V, ae, hf, fl, jK, jt, gv, hi, eV, bt, bg, hH, bd, hs, hw, fJ, iQ, en, if, hp, aY, ju, P, in, ho, gR, T, jP, iu, ci, ij, ap, fn, gB, am, ag, ia, jg, jL, jJ, eR, iS, jj, ic, z, hr, gZ, iA, cy, hh, jh, bb, jR, jd, hV, je, q, jV, es, jF, jm, ar, ac, hb, jG, u, o, ff, gS, fs, I, im, ir, js, ht, hy, gL, ad, G, iD, jr, iN, ct, et, gQ, iw, jM, hU, hy, ig, hX, ch, hT, he, gC, ih, ix, fg, jn, I, di, hd, de, A, iL, gU, fr, iM, jl, gN, iH, jc, hl, C, hA, iC, jw, jQ, hP, iK, iy, m, aX, hk, bj, h, H, jA, gT, cU, hN, ik, y, jO, fM, aV, aq, hm, iq, jN, ax, hW, cV, hZ, dB, J, gV, W, jo, hl, hE, fO, ji, cr, cz, hK, ed, jT, eN, jp, ii, Y, fD, hq, iY, hL, eB, fP, iE, jU, il, iB, bh, at, ja, hz, gl); #c1(ABCB4) c2(NP_000434) c3(44) c4(26158, 39215, 52272, 13101, 65329) c5(gD, ak, aw, fT, kc, ka, kg, ki, au, jX, C, z, al, kd, y, jY, gB, b, gC, kb, gq, jW, q, az, X, gu, cl, iv, ay, u, jZ, g, bm, Id, cV, p, gp, J, fQ, gv, G, ke, ac, if, ch, kh, iZ, gA, w, bk, bh, at, bT, iE); #c1(ABCB5) c2(NP_001157413) c3(45)

c4(26159, 39216, 52273, 13102, 65330) c5(aw, b, u, hS, ix, C, y, aX, t, h, q, iv, jG, bm, J, fD, G, jT, jE, eT, cT, aA, at, dF); #c1(ABCB6) c2(NP_005680) c3(46) c4(26160, 39217, 52274, 13103, 65331) c5(dx, en, aw, ku, e, O, dv, kJ, kB, km, kz, kP, g, du, fx, kl, jE, kQ, bk, i, kM, kN, X, ig, dV, en, y, co, kH, f, bu, dZ, ky, cs, ay, bm, kq, ae, kp, gv, hi, eX, cK, dy, kD, dF, kE, b, z, d, eA, q, kr, kv, kk, fv, jG, u, dr, o, dG, kF, I, kt, by, jH, hS, hT, ex, ko, kC, kK, C, iL, gE, aX, kn, fq, kO, kG, cV, dt, kl, P, T, bM, kw, ad, eJ, ks, kj, kx, kL, kA, bh, eG); #c1(ABCB7) c2(NP_001258625) c3(47) c4(26161, 39218, 52275, 13104, 65332) c5(kW, kT, kS, kU, kR, kX, kV); #c1(ABCB8) c2(NP_001269220) c3(48) c4(26162, 39219, 52276, 13105, 65333) c5(aX, b); #c1(ABCB9) c2(NP_001229942) c3(49) c4(26163, 39220, 52277, 13106, 65334) c5(fy); #c1(ABCC10) c2(NP_001185863) c3(50) c4(26164, 39221, 52278, 13107, 65335) c5(f, ip, kZ, ht, bp, P, ar, kY, fy, u, y); #c1(ABCC11) c2(NP_115972) c3(51) c4(26165, 39222, 52279, 13108, 65336) c5(Ig, aF, lk, aN, lp, le, bf, aK, y, ed, co, h, lq, h, f, jV, Ir, aC, fE, u, aE, Id, fU, I, im, lb, dT, lj, lo, lm, J, et, aM, lf, lh, M, ll, lc, iw, cT, bk, la, aA, In); #c1(ABCC12) c2(NP_150229) c3(52) c4(26166, 39223, 52280, 13109, 65337) c5(u, y); #c1(ABCC1) c2(NP_004987) c3(53) c4(26167, 39224, 52281, 13110, 65338) c5(dx jp, hg, aw, IA, if, dB, w, e, O, IB, jT, cy, t, dl, cl, kX, g, fe, aC, iv, bp, ft, x, fx, hR, jE, lu, ag, cT, Is, bk, i, bT, X, iP, jz, jf, hS, iG, a, Iw, U, y, co, ip, gW, f, bu, B, cs, ay, fy, bm, fi, V, ae, iy, iA, hw, lx, du, dy, iY, jR, ji, b, jL, d, bb, lz, kW, q, jF, ar, fM, jG, u, dr, o, da, il, ly, ad, G, iD, iw, hX, I, A, k, fr, di, ly, bw, hP, iM, jx, m, aX, h, cU, It, hN, ik, jQ, fU, cV, J, dt, P, IC, T, fO, by, ac, iE); #c1(ABCC2) c2(NP_000383) c3(54) c4(26168, 39225, 52282, 13111, 65339) c5(bp, IJ, aw, IH, b, X, kg, gE, dB, IM, hS, m, hC, C, iG, z, bw, al, U, y, gM, iP, it, IE, aX, h, gB, IF, q, e, gG, hY, hN, ar, gP, ff, IL, ay, fy, u, IG, gD, hh, jB, fU, fs, V, I, jh, aC, bK, F, kZ, gm, bp, ly, jo, co, T, ll, ID, x, IN, hR, et, ac, d, iw, jT, gs, dk, hX, ch, IK, P, by, ag, gA, gu, i, fN, I, ID, fD, bT); #c1(ABCC3) c2(NP_001137542) c3(55) c4(26169, 39226, 52283, 13112, 65340) c5(by, gB, aw, b, k, X, kg, iP, jz, IM, O, w, C, z, bw, U, fD, y, jQ, m, it, co, aX, ly, t, h, f, F, q, bu, az, fr, IQ, ar, ac, iv, fy, u, g, ax, V, IP, aC, ft, cs, J, bp, gv, W, G, T, iD, fx, ad, et, fU, dH, iw, jT, js, au, bm, cV, ag, cT, gu, i, fN, bh, bT); #c1(ABCC4) c2(NP_001098985) c3(56) c4(26170, 39227, 52284, 13113, 65341) c5(bP, bL, IU, A, aw, IY, iP, aN, w, IW, bw, U, aK, gB, co, G, IZ, t, h, B, q, bu, ar, IV, u, IT, jH, fi, fU, V, cV, kZ, J, bp, gY, IR, IX, P, x, by, et, ac, iw, jh, IS, i, I, ht, eG, bT); #c1(ABCC5) c2(NP_001018881) c3(57) c4(26171, 39228, 52285, 13114, 65342) c5(X, hS, fU, bw, y, co, jd, t, h, f, md, gX, ar, O, fv, ay, fy, u, ma, mc, G, T, x, cK, ac, mb, ag, w, bT); #c1(ABCC6) c2(NP_001072996) c3(58) c4(26172, 39229, 52286, 13115, 65343) c5(bL, id, mi, mk, di, bf, bT, aO, m, mf, gW, ml, f, eN, mg, O, ar, mm, dr, em, I, aC, J, dt, dy, me, ac, aM, at, mn, kj, iV, jZ, eX, mj, br, mh, mo, h, ap); #c1(ABCC8) c2(NP_000343) c3(59) c4(26173, 39230, 52287, 13116, 65344) c5(mu, my, eX, Ig, cT, mp, mz, aF, lk, ms, my, mq, mC, hS, mA, cO, bf, ey, aK, fw, y, ed, co, h, lq, mF, f, q, jV, Ir, mw, u, aE, o, Id, le, I, im, lb, mt, kJ, lj, J, dt, lo, mD, bb, gF, aN, et, aM, W, lh, M, gs, lp, bm, mB, lc, mE, mr, iw, mx, bk, fD, cf, aC, lm, aA, In, ap); #c1(ABCC9) c2(NP_005682) c3(B0) c4(26174, 39231, 52288, 13117, 65345) c5(ml, mN, id, di, cO, mJ, gZ, iA, cM, mH, mL, mR, mK, o, cK, mQ, hR, mO, mP, aY, mG, mM, dc, bq, dR, eG, ap); #c1(ABCD1) c2(NP_000024) c3(61) c4(26175, 39232, 52289, 13118, 65346) c5(dx, mZ, b, nf, gw, mW, mV, di, dV, gE, no, G, m, f, dZ, hZ, mT, gl, o, em, hW, bK, el, du, v, J, dt, P, mX, mY, jG, ac, nd, nb, eT, nc, mU, ex, na, mS, bO, bk); #c1(ABCD2) c2(XP_011536329)

c3(62) c4(26176, 39233, 52290, 13119, 65347) c5(nf, q, ex, v, mX, u, y); #c1(ABCD3) c2(XP_011540179) c3(63) c4(26177, 39234, 52291, 13120, 65348) c5(nf, mX, T, ex); #c1(ABCD4) c2(NP_005041) c3(64) c4(26178, 39235, 52292, 13121, 65349) c5(ni, ng, nh, mX, ex); #c1(ABCE1) c2(NP_002931) c3(65) c4(26179, 39236, 52293, 13122, 65350) c5(A, b, eu, P, fl, z, x, al, jT); #c1(ABCF1) c2(NP_001020262) c3(66) c4(26180, 39237, 52294, 13123, 65351) c5(m, bn, nl, gd, nk, iu, nj); #c1(ABCF2) c2(NP_005683) c3(67) c4(26181, 39238, 52295, 13124, 65352) c5(10, b, in, jf, cU, ar, iA); #c1(ABCG1) c2(NP_004906) c3(68) c4(26182, 39239, 52296, 13125, 65353) c5(dx, bL, A, dN, dD, iP, ns, nm, nt, nq, nr, nn, no, np, y, dv, eK, kJ, ak, N, nv, do, aW, u, o, I, du, nu, dt, aZ, bq, ac, eH, ag, B, fg, fD, ej, at, ap); #c1(ABCG2) c2(NP_001244315) c3(69) c4(26183, 39240, 52297, 13126, 65354) c5(dx, jK, B, aw, dB, aN, w, hC, cO, aK, e, O, dv, nC, nY, t, gB, nv, nZ, jn, nL, gP, nB, g, og, cB, jH, nl, nz, du, fO, gm, bp, od, x, jT, oh, of, fy, oe, nG, ag, cT, oi, dh, eT, bq, aA, bT, mZ, nF, oa, mk, ma, bw, U, ex, y, co, ip, ml, f, cs, bu, gX, iv, av, nR, bm, bk, V, ok, hf, gv, ny, cK, hw, fU, W, dy, hp, kJ, nw, nJ, oj, nN, nE, ji, ap, b, nX, jq, dk, au, jy, nS, aO, d, jh, bb, Iz, nD, nU, je, q, X, ar, ff, hb, as, jG, u, dr, o, fh, da, iP, fs, I, ht, ly, ad, G, jr, mY, nK, iw, nV, hS, hX, ch, nQ, hT, kR, fF, bL, A, C, nT, aW, aX, ob, h, F, oc, M, nM, hN, bK, nx, nA, aV, ag, nW, IG, nH, nQ, cV, J, dt, dU, P, T, II, nP, by, fM, gu, fP, bh, at, ja, gl); #c1(ABCG4) c2(NP_001135977) c3(70) c4(26184, 39241, 52298, 13127, 65355) c5(dx, dD, du, o); #c1(ABCG5) c2(NP_071881) c3(71) c4(26185, 39242, 52299, 13128, 65356) c5(dx, A, aw, ka, dD, eR, eH, au, dv, aX, gB, op, dW, az, om, ev, o, du, ol, eX, oo, ch, at, on, ap); #c1(ABCG8) c2(NP_071882) c3(72) c4(26186, 39243, 52300, 13129, 65357) c5(dx, eX, aw, h, dD, eR, eH, jc, au, ot, ey, aW, dv, or, gB, dW, az, om, ev, fh, is, IN, I, og, du, ol, ch, os, i, aft at, on, ap); #c1(ABHD12B) c2(NP_001193602) c3(73) c4(26187, 39244, 52301, 13130, 65358) c5(dA); #c1(ABHD12) c2(NP_001035937) c3(74) c4(26188, 39245, 52302, 13131, 65359) c5(nQ, v, ow, nE, ou, ov); #c1(ABHD16A) c2(NP_001170986) c3(75) c4(26189, 39246, 52303, 13132, 65360) c5(aC, m, ox, jD, lo); #c1(ABHD17B) c2(NP_001020951) c3(76) c4(26190, 39247, 52304, 13133, 65361) c5(oy); #c1(ABHD2) c2(XP_005254890) c3(77) c4(26191, 39248, 52305, 13134, 65362) c5(m, oz); #c1 (ABHD5) c2(NP_057090) c3(78) c4(26192, 39249, 52306, 13135, 65363) c5(ep, oC, dw, fN, oB, oE, dt, w, cO, oD, aA, oA, dL, oF); #c1(ABHDG) c2(NP_065727) c3(79) c4(26193, 39250, 52307, 13136, 65364) c5(aA, oG, I); ARABIC c2(NP_001012768) c3(80) c4(26194, 39251, 52308, 13137, 65365) c5(fl, aw, V, X, ol, h, jL, J, oH, T, bb, av, u, U, y); #c1(ABI2) c2(NP_001269854) c3(81) c4(26195, 39252, 52309, 13138, 65366) c5(jG, oJ, eO); #c1(ABI3BP) c2(NP_056244) c3(82) c4(26196, 39253, 52310, 13139, 65367) c5(dj, co, b, hV, oK, bp, nV, T, bq, at, es); #c1(ABI3) c2(NP_001128658) c3(83) c4(26197, 39254, 52311, 13140, 65368) c5(co, T, nV, b, cs); #c1 (ABL1) c2(NP_005148) c3(84) c4(26198, 39255, 52312, 13141, 65369) c5(pm, hg, aw, bx, w, ps, oU, O, iy, t, kX, oN, oP, fe, lb, fO, gm, bp, jT, pq, pb, oQ, ie, hX, cT, pH, pt, aA, X, jz, eu, oX, oH, pd, pK, U, y, co, eK, px, pp, pz, f, N, pf, B, iv, av, bm, V, v, pr, pi, pJ, pk, hi, pj, fG, gR, oM, iu, ci, pv, b, pg, oR, jy, oZ, pl, pL, hV, pn, ar, fM, oil jG, u, o, iI, gL, pF, pB, G, oV, pG, pe, py, p, fg, oY, fl, ph, A, pD, og, pu, bj, jQ, pA, h, M, pC, ik, n, cB, ag, pE, oS, J, po, P, II, ji, pw, pc, oW, oL, j, pl, oT); #c1(ABL2) c2(NP_001129472) c3(85) c4(26199, 39256, 52313, 13142, G5370) c5(pM, A, b, pR, e, y, d, kJ, h, f, jV, B, pN, aD, jG, pP, o, dA, J, pQ, P, T, pS, u, at, pO); #c1(ABLIM1) c2(NP_001003407) c3(86) c4(26200, 39257, 52314, 13143, 65371) c5(b, I, aC, di, IV, at, RE); #c1(ABLIM2) c2(NP_001123555) c3(87) c4(26201, 39258, 52315, 13144, 65372) c5(at, A); #c1 (ABD) c2(NP_065202) c3(88) c4(26202, 39259, 52316, 13145, 65373) c5(dx, ml, pV, lo, dD, gl, cO, bf, fx, at, it, dv, cy, b, iR, gc, e, pU, qM, gE, R, qm, aC, p, du, fO, od, go, qx, hR, kN, pq, qt, dS, fN, qN, ag, cT, bk, i, qv, bq, qD, X, pX, bw, gG, y, co, f, bu, iv, by, av, qJ, bm, pW, qw, ae, qb, qq, eX, bt, iy, qH, aA, qK, aY, qB, qO, qh, iu, ap, pT, qz, qk, qa, eV, aO, d, jh, qf, bb, Iz, eA, qF, qu, pY, aE, fh, qy, I, qL, qA, bc, cz, qj, aZ, qg, et, u, mA, bL, A, iL, qd, gN, qi, di, pu, qs, qn, qr, n, kt, dj, qC, ez, J, P, T, by, qe, aM, qp, ql, pZ, eN, oT); #c1(ABRA) c2(NP_631905) c3(89) c4(26203, 39260, 52317, 13146, 65374) c5(f, mR, aW, dA); #c1(ABR) c2(NP_001153218) c3(90) c4(26204, 39261, 52318, 13147, 65375) c5(dx, du, dv, b, bK, f, jR, qP, na, qQ, A, Q, z, bm); #c1(ABTI) c2(NP_037507) c3(91) c4(26205, 39262, 52319, 13148, 65376) c5(m, bu); #c1(ACAA1) c2(NP_001123882) c3(92) c4(26206, 39263, 52320, 13149, 65377) c5(dO, V, bE, ch, qR, ex, I, aD, U); #c1(ACAA2) c2(NP_006102) c3(93) c4(26207, 39264, 52321, 13150, 65378) c5(qR, I, ex); #c1(ACACA) c2(NP_942131) c3(94) c4(26208, 39265, 52322, 13151, 65376) c5(bP, id, aw, iL, b, bx, X, dD, iP, eH, fU, jj, qX, iG, A, y, qZ, jk, B, q, qU, ra, cM, cs, as, av, dH, u, da, ax, I, dA, qY, J, dK, ad, T, qV, gF, jG, qT, qW, rc, mP, fN, qS, m, oi, fP, fD, aA, at, eG, gf, rb); #c1(ACACB) c2(XP_011536564) c3(95) c4(26206, 39266, 52323, 13152, 65380) c5(rd, rb, I, fN, dD, eX, eH, T, iT, bf, aA, et, re, o, AM); #c1(ACAD10) c2(NP_001130010) c3(99) c4(26210, 39267, 52324, 13153, 65381) c5(ik, u, rf, I); #c1(ACAD8) c2(NP_055199) c3(97) c4(26211, 39268, 52325, 13154, 65382) c5(f, b, ig, rj, rp, bf, U, hP, rk, rh, rl, rr, gz, bu, aC, aE, o, da, bc, V, I, rg, qC, be, cz, dt, ro, jU, aM, jH, rm, rq, fP, ri, aA, rn, oT); #c1(ACAD9) c2(NP_054768) c3(98) c4(26212, 39269, 52326, 13155, 65383) c5(bF, dZ, rs, dV); #c1(ACADL) c2(NP_001599) c3(99) c4(26213, 39270, 52327, 13156, 65384) c5(f, cf); #c1(ACADSB) c2(NP_001900) c3(100) c4(26214, 39271, 52328, 13157, 65385) c5(qs, q, cz, eH, rt, di, bf, u, y, ru); #c1(ACADS) c2(NP_000008) c3(101) c4(26215, 39272, 52329, 13158, 65389) c5(ak, I, an, f, eX, rv, as, oD); #c1(ACADVL) c2(NP_000009) c3(102) c4(26216, 39273, 52330, 13159, 65387) c5(cK, jj, rw, z); #c1(ACAN) c2(NP_001129) c3(103) c4(26217, 39274, 52331, 13160, 65388) c5(dx, cC, rD, qd, rx, rT, rU, kB, rV, rH, rF, rP, dv, rl, rG, f, rR, aE, o, pZ, be, rN, aC, du, oK, cz, rB, Im, rO, rA, rW, rz, rM, rQ, rE, rK, iY, rS, rJ, rL, ry, aT, rC); #c1(ACAT1) c2(NP_000010) c3(104) c4(26218, 39275, 52332, 13161, 65389) c5(dx, sa, A, b, sd, op, eH, di, O, sb, dv, rY, ni, qR, q, se, B, sh, u, rX, o, cV, du, bd, dK, sf, T, bb, cq, sg, fD, sc, rZ); #c1(ACAT2) c2(NP_001290182) c3(105) c4(26219, 39276, 52333, 13162, 65390) c5(eH, A, jH, dD, qR, q, dB, az, au, ji, aA, at, bm); #c1(ACBD3) c2(NP_073572) c3(109) c4(26220, 39277, 52334, 13163, 65391) c5(fH, jl, si, fJ); #c1(ACBD4) c2(NP_001129176) c3(107) c4(26221, 39278, 52335, 13164, 65392) c5(oy); #c1(ACBD5) c2(NP_001035938) c3(108) c4(26222, 39279, 52336, 13165, 65393) c5(ih, nR); #c1(ACBD6) c2(NP_115736) c3(109) c4(26223, 39280, 52337, 13166, 65394) c5(oy, nU); #c1(ACCS) c2(NP_115981) c3(110) c4(26224, 39281, 52338, 13167, 65395) c5(d, id, b, sj, dB, P, at, e, rb); #c1(ACD) c2(NP_001075955) c3(111) c4(26225, 39282, 52339, 13168, 65396) c5(cT, b, dB, sl, bz, aO, aX, sm, sr, q, ss, u, sk, I, sn, P, sq, bb, st, sp, aZ, so, ap); #c1(ACE2) c2(NP_068576) c3(112) c4(26229, 39283, 52340, 13169, 65397) c5(ek, gK, ml, dN, bL, aF, gw, sv, aE, sA, z, eW, sJ, id, di, sF, dx, cO, bf, ey, sN, sx, aO, oy, sX, qs, co, b, ag, sG, f, sM, sL, mL, sO, sP, sl, sV, sR, gg, sK, dh, ae, sz, mc, sQ, I, hZ, sH, sB, sy, gL, sC, da, dv, sw, aZ, sD, cK, hR, et, sT, su, aM, du, fy, sS, ch, sW, or, fw, bT, sE, gd, sU, bq, aA, at, gf, ap); #c1(ACE) c2(NP_000780) c3(113) c4(26227, 39284, 52341, 13170, 65398) c5(ml, wS, dD, vB, sY, bu, ua, uA, cp, gM, yr, tD, dl, om, ul, vT, xl, mz, xc, vN, vG, kN, pq, tS, aL, jE, vz, tl, tO, ag, bk, fD, bq, qD, wz, us, ug, tu, vD, eu, ul, sF, vl, cM, uV, tq, uj, ak, e, vo, fy, pW, wK, vR, V, ae, nl, cd, uu, tj, J, fJ, xd, pk, uM, uJ, aY, xe, wl, vL, aG, bn, tV, vY, tB, vC, uz, tg, wM, mR, dh, wY, da, fs, iI, sX, bc, gL, ad, xk, wL, uf, wV, mA, th, uE, tZ, vd, xh, vZ, xa, gE, jw, m, cr, or, tL, ox, gA, aC, oJ, qB, ev, to, dj, tP, tn, ui, be, bd, jo, wm, lc, uG, wG, tT, hz, gl, tM, dM, vk, tC, ud, iU, sA, eH, dx, vp, eP, at, hR, hF, va, sW, jm, IV, uL, uC, oN, A, du, bp, vx, su, ts, ft, qt, dS, fc, sN, mx, bT, bP, ux, fl, wF, ye, rd, mk, pX, ix, ur, a, u, ww, co, sT, f, uB, tv, wH, vi, mc, wB, gv, vb, vm, wt, cl, ww, qH, aA, aH, tm, uX, tl, uv, wQ, wT, vq, wj, am, wn, tt, z, wJ, vn, d, bb, eA, vj, q, uY, mL, sR, ff, o, fh, tw, kF, wl, wq, aZ, uw, ct, wd, jH, vs, hy, uc, ch, ta, tb, gd, gU, tx, tR, uq, eD, al, aW, wr, wN, hN, fP, tK, ax, hW, ez, tp, sj, gV, dt, uF, T, II, tk, wC, wU, tf, ii, vU, vW, eB, iB, wg, gf, ek, eX, aw, dN, eW, wX, eD, tX, sM, um, fH, tU, ha, bK, sy, vE, ye, vM, vA, hj, oC, w, dX, vJ, tH, uP, eQ, bV, rq, cO, ws, bf, vV, uD, ml, B, by, gg, pP, tQ, rN, bj, v, fY, bn, wA, uT, iA, dO, cf, fw, vH, fW, uy, b, aF, bg, tN, tG, wZ, re, vf, vu, sz, wp, xj, vS, uQ, wx, et, hU, hT, ub, vP, uk, bW, mW, xf, vg, iC, wf, uK, qs, sG, sx, vy, tF, iZ, ik, aE, sV, wb, wo, uo, vF, W, ti, jl, aM, Y, tA, ho, gu, ap, eG, pV, bx, aN, ns, sJ, nm, nt, nq, nr, nn, no, np, wk, gn, dv, cy, qo, wv, iT, sZ, sn, tE, gl, tY, vn, lb, sH, gJ, wh, tz, gY, gs, jT, mn, dH, rill wi, we, yK, i, do, wD, gk, td, wy, IW, y, ed, we, un, vQ, cs, mm, bm, un, up, fz, sw, oK, wu, dP, er, uZ, Im, uh, vl, tr, uS, ie, vh, we, eR, id, xb, sU, xg, ey, gF, an, xi, jV, pn, ar, qe, u, wR, sQ, I, el, by, lo, vX, vw, ut, tW, tJ, uH, ih, wP, ue, dn, I, uN, bL, A, sv, di, hP, oy, c, aX, ty, h, qr, eV, ma, si, wE, uR, gj, P, j, mQ, vv, ac, sK, to, bh, uW, vt, oT); #c1(ACER2) c2(NP_001010887) c3(114) c4(26228, 39285, 52342, 13171, 65399) c5(b); #c1(ACER3) c2(NP_001287882) c3(115) c4(26229, 39286, 52343, 13172, 65400) c5(aX); #c1(ACHE) c2(NP_001269378) c3(116) c4(26230, 39287, 52344, 13173, 65401) c5(gK, aw, dB, aN, xb, hM, aK, O, kT, oN, xA, xy, xC, bK, qB, bp, x, xx, xO, xG, xr, dh, bk, bq, X, xB, xK, dV, cA, xw, y, xR, f, dZ, ky, xl, av, fy, xE, ae, xD, v, xF, gv, xo, qO, xm, xz, bb, se, ff, u, nj, o, I, xs, xq, kS, xv, xL, oh, xN, xp, ih, xP, kK, g, A, xu, k, xQ, jR, bj, m, aX, h, xi, n, nl, xt, xH, xn, dj, fU, hW, cV, J, xS, eJ, xM, fP, iB, bh, aT, at); #c1(ACIN1) c2(NP_001158286) c3(117) c4(26231, 39288, 52345, 13174, 65402) c5(ji, ar, js, pp, cV); #c1(ACKR1) c2(NP_001116423) c3(118) c4(26232, 39289, 52346, 13175, G5403) c5(lo, cG, nf, mk, ix, sU, xZ, y, qZ, xT, cy, sL, hN, O, yb, aV, u, qM, da, xW, ae, iw, bK, ht, P, aZ, ye, et, xV, pk, qt, Y, qv, dY, xU, gd, xY, ye, fP, xX, fl, bq); #c1(ACKR2) c2(NP_001287) c3(119) c4(26233, 39290, 52347, 13176, G5404) c5(dx, jl, A, b, X, jz, ig, Iv, al, yi, y, jQ, yg, dv, aX, t, B, yh, vQ, eE, aD, av, u, ye, yd, m, aC, jL, du, J, P, cy, yj, mk, G, fG, cT, rl, gj, bh, yf, at, eG, ic); #c1(ACKR3) c2(XP_005246155) c3(120) c4(26234, 39291, 52348, 13177, G5405) c5(dx, f, aw, yz, w, cQ, O, dv, cy, yl, cl, og, aC, nW, du, bp, dB, fx, jv, jE, fy, ym, yw, yE, cT, i, qD, ib, se, yu, hS, yD, yn, U, y, yt, yr, co, pp, ak, ys, B, cs, av, yB, bm, V, yF, jC, aA, P, t, T, yq, b, jd, q, yp, X, fv, ff, u, aE, I, el, ad, G, uw, et, yG, yC, hT, yy, yA, yo, A, fr, di, yv, m, aX, iI, F, yx, oE, cB, cV, J, W, jo, yk, fO, ft, gu); #c1(ACKR4) c2(NP_848540) c3(121) c4(26235, 39292, 52349, 13178, 65406) c5(fG, aX, mk, nF, yh, jz, yH, eE, hS, P, yj, gj, nB, yf, yi, u, ye, y, jQ); #c1(ACLY) c2(NP_001290203) c3(122) c4(26236, 39293, 52350, 13179, 65407) c5(co, V, b, fN, f, q, bp, T, ji, U, fy, aA); #c1(ACMSD) c2(NP_612199) c3(123) c4(26237, 39294, 52351, 13180, 65408) c5(y1, bK, bj, q, hS, bm); #c1(ACO1) c2(NP_002188) c3(124) c4(26238, 39295, 52352, 13181, 65409) c5(yd, yK, A, aX, V, b, yL, yn, yN, ic, yM, cO, bq, U, at, eq, pR, o); #c1(ACO2) c2(NP_001089) c3(125) c4(26239, 39296, 52353, 13182, 65410) c5(yP, q); #c1(ACDT13) c2(NP_001153566) c3(126) c4(26240, 39297, 52354, 13183, 65411) c5(bf, u, yQ, aM); #c1(ACDT1) c2(NP_001032238) c3(127) c4(26241, 39298, 52355, 13184, 65412) c5(ch, re, bm, P, iT); #c1(ACDT2) c2(NP_006812) c3(128) c4(26242, 39299, 52356, 13185, 65413) c5(ch, at, I); #c1(ACOT9) c2(NP_001028755) c3(129) c4(26243, 39300, 52357, 13186, 65414) c5(fN); #c1(ACOX1) c2(NP_001171968) c3(130) c4(26244, 39301, 52358, 13187, 65415) c5(yR, yS, ch, f, q, v, fN, dL, yT); #c1(ACDX2) c2(NP_003491) c3(131) c4(26245, 39302, 52359, 13188, 65416) c5(nf, f, q, ap); #c1(ACDX3) c2(NP_001095137) c3(132) c4(26246, 39303, 52360, 13189, 65417) c5(do, A, B); #c1(ACOXL) c2(NP_001136279) c3(133) c4(26247, 39304, 52361, 13190, 65418) c5(bq, qf, A, fl, cT); #c1(ACP1) c2(NP_001035739) c3(134) c4(26248, 39305, 52362, 13191, 65419) c5(B, pV, hY, N, dB, w, bf, e, O, za, zi, cy, zo, zb, gl, mz, aC, zj, fO, x, ca, kl, dH, pb, wh, ag, cT, mD, aA, ux, kN, mk, mA, U, y, yV, yX, ml, f, zh, cs, bu, cc, iv, av, fy, V, ae, ze, yY, zl, eX, bt, zf, pJ, dP, in, iu, ap, b, yU, d, lz, zc, q, zm, ar, ff, yW, u, aE, qM, da, yZ, I, zd, j, ad, zk, ew, jG, jH, iq, fg, zg, A, qd, pR, mW, ds, hP, m, qs, or, zn, F, cU, oJ, qB, aV, ax, cV, J, dt, P, T, aX, nP, by, aM, nk, zp, fP, at, eG); #c1(ACP2) c2(NP_001289419) c3(135) c4(26249, 39306, 52363, 13192, 65420) c5(A, h, cT, eu, zq, J, ba, u, jU, pv); #c1(ACP5) c2(NP_001104506) c3(136) c4(26250, 39307, 52364, 13193, 65421) c5(fr, A, zr, b, qd, X, ie, iP, dB, zz, w, yU, zK, zL, bu, eV, zw, d, co, aX, zu, vR, zJ, zy, B, e, q, zC, zx, zB, sO, zA, u, jZ, ZH, fU, zt, ae, aC, zy, be, fO, ft, vM, jl, by, zs, zF, zE, zG, ch, zl, wz, xU, zM, ag, t, aA, kD, zD); #c1(ACP6) c2(XP_011507903) c3(137) c4(26251, 39308, 52365, 13194, 65422) c5(e0); #c1(ACPP) c2(NP_001090) c3(138) c4(26252, 39309, 52366, 13195, 65423) c5(vq, A, b, eu, w, di, cO, bf, zY, bu, y, zP, eK, h, B, zT, zV, zN, ar, O, cs, as, n, av, u, zW, bk, V, zQ, an, be, J, ad, P, zU, aft jl, zR, zX, cT, zO, zS, aA, wT); #c1(ACRBP) c2(NP_115878) c3(139) c4(26253, 39310, 52367, 13196, 65424) c5(A, b, X, ad, ck, av); #c1(ACRC) c2(XP_011529367) c3(140) c4(26254, 39311, 52368, 13197, 65425) c5(bM); #c1(ACR) c2(NP_001088) c3(141) c4(26255, 39312, 52369, 13198, 65426) c5(m, dM, aC, ps, h, J, mW, j, aft jG, jT, et, gl, pq); #c1(ACRV1) c2(NP_001603) c3(142) c4(26256, 39313, 52370, 13199, 65427) c5(sQ); #c1(ACSBG1) c2(NP_055977) c3(143) c4(26257, 39314, 52371, 13200, 65428) c5(eu, ix, al, O, co, Aa, ja, q, y, cs, Ab, pP, Ac, aC, v, II, jT, u, ex, zZ, cT, fl, zD); #c1(ACSBG2) c2(NP_001276107) c3(144) c4(26258, 39315, 52372, 13201, 65429) c5(am, ex); #c1(ACSF3) c2(NP_777577) c3(145) c4(26259, 39316, 52373, 13202, 65430) c5(em, jT, Ad, Ae, gm); #c1(ACSL1) c2(NP_001273640) c3(149) c4(26260, 39317, 52374, 13203, 65431) c5(Ag, vD, bb, ch, f, eX, fl, T, Af, gl, bf, aA, Ah, AM); #c1(ACSL3) c2(NP_976251) c3(147) c4(26261, 39318, 52375, 13204, 65432) c5(eH, Am, co, cy, sm, dA, B, q, Ak, Ai, A, O, gE, Al, Aj, at, bm, qe); #c1(ACSL5) c2(NP_057318) c3(148) c4(26262, 39319, 52376, 13205, 65433) c5(eH, An, Ao, V, b, m, W, T, ar, U, gl, O, gl); #c1(ACSL6) c2(NP_001009185) c3(149) c4(26263, 39320, 52377, 13206, 65434) c5(A, hW, ch, pF, xq, jw, jv, Ap); #c1(ACSM1) c2(NP_001305819) c3(150) c4(26264, 39321, 52378, 13207, 65435) c5(di, qs, eX, T, bp); #c1(ACSM2B) c2(NP_001098539) c3(151) c4(26265, 39322, 52379, 13208, 65436) c5(oG); #c1(ACSM3) c2(NP_005613) c3(152) c4(26266, 39323, 52380, 13209, 65437) c5(oy, bL, qs, A, bb, b, sH, eX, cx, Aq, eH, om, di, fD, xg, aA, et); #c1(ACSS1) c2(NP_001239605) c3(153) c4(26267, 39324, 52381, 13210, 65438) c5(bb, et); #c1(ACSS2) c2(NP_001070020) c3(154) c4(26268, 39325, 52382, 13211, 65439) c5(id, b, I, sj, dB, q, P, at); #c1(ACSS3) c2(NP_078836) c3(155) c4(26269, 39326, 52383, 13212, 65440) c5(et, dA); #c1(ACTA1) c2(NP_001091) c3(156) c4(26270, 39327, 52384, 13213, 65441) c5(dx, AA, bf, jw, As, Ar, AD, cy, re, Av, oD, o, cc, wp, Ay, nl, du, Az, rQ, cK, sK, Ax, AB, At, AC, iT, Au, Aw, bq); #c1(ACTA2) c2(XP_011538318) c3(157) c4(26271, 39328, 52385, 13214, 65442) c5(bL, b, fr, dB, bV, z, bW, aO, bC, bb, AH, wd, AG, AJ, AK, mR, ar, dh, AL, bU, wo, bp, AE, AF, ji, x, cK, et, sK, Al, rQ, hQ, AC, bh, wl, at, es); #c1(ACTB) c2(NP_001092) c3(158) c4(26272, 39329, 52386, 13215, 65443) c5(en, Ir, hM, Bj, Bf, e, jT, cy, t, AX, Bk, kz, mR, n, yL, gm, bp, fx, hR, cq, wh, AW, ag, i, aA, fl, eu, AU, ur, U, y, co, kH, cX, AZ, ak, vQ, bu, B, cs, fy, wP, yJ, jB, Bd, V, gv, eX, W, py, Bc, AN, Mt b, qz, Bh, ba, AM, d, Ag, Ba, AT, jd, AY, AV, q, jF, ar, fv, jG, u, kF, ad, G, ct, jU, wV, Bg, na, fl, A, k, AD, C, AD, aX, h, iZ, ik, oJ, cB, aq, AS, fU, tP, Be, dt, P, T, II, bM, Bb, by, AP, ii, AR, fP, Af, Am, bh, at, eG, Bi); #c1(ACTBL2) c2(NP_001017992) c3(159) c4(26273, 39330, 52387, 13216, 65444) c5(A, b, jj, bj, eV, O, cy, I, tF, BI, ak, gX, y, qY, qu, u, aE, o, ae, cV, Bm, dc, I, bq); #c1(ACTC1) c2(NP_005150) c3(160) c4(26274, 39331, 52388, 13217, 65445) c5(ml, dE, di, cO, Bo, oy, cr, f, bu, Br, mR, Bp, Bs, Bu, Bq, cK, Bn, sK, rQ, gs, hQ, Bt, AC, at); #c1(ACTG1) c2(NP_001605) c3(161) c4(26275, 39332, 52389, 13218, 65446) c5(4 b, jj, Bw, Bz, bj, eV, y, cp, Ag, cy, AT, kH, gX, BI, t, ak, tF, O, qY, u, aE, o, Bm, ae, Am, I, cV, dc, J, P, T, By, AP, Bv, G, dY, na, Af, Bx, I, bq, at); #c1(ACTG2) c2(NP_001186822) c3(162) c4(26276, 39333, 52390, 13219, 65447) c5(ak, b, jj, O, bj, eV, y, cy, I, tF, BI, gB, gX, BD, BE, qY, BB, u, aE, o, ae, sH, BC, I, x, iK, Y, Bm, dc, BA, bq); #c1(ACTL6A) c2(NP_004292) c3(163) c4(26277, 39334, 52391, 13220, 65448) c5(BF, by, cl, b, bu); #c1(ACTL6B) c2(NP_057272) c3(164) c4(26278, 39335, 52392, 13221, 65449) c5(BF); #c1(ACTL8) c2(XP_011540513) c3(165) c4(26279, 39336, 52363, 13222, 65450) c5(ac, cO); #c1(ACTL9) c2(NP_848620) c3(166) c4(26280, 39337, 52394, 13223, 65451) c5(fq); #c1(ACTN1) c2(NP_001093) c3(167) c4(26281, 39338, 52395, 13224, 65452) c5(BG, at, aC, f, cU, BH, eN, el); #c1(ACTN2) c2(NP_001094) c3(168) c4(26282, 39339, 52396, 13225, 65453) c5(hW, cc, mR, BJ, Bo, cK, sK, cM, B1); #c1(ACTN3) c2(NP_001095) c3(169) c4(26283, 39340, 52397, 13226, 65454) c5(BM, BL, X, lk, tx, av, BK, o); #c1(ACTN4) c2(NP_004915) c3(170) c4(26284, 39341, 52398, 13227, 65455) c5(bP, aw, b, yu, BP, eu, oC, fe, di, sU, cO, IO, U, BB, y, wB, hh, Ag, co, aX, wd, vG, cV, X, ar, av, u, aE, to, fU, V, BO, qL, BR, bd, P, T, vw, fx, et, fD, BN, ag, Af, i, ji, eG, hc); #c1(ACTR1A) c2(NP_005727) c3(171) c4(26285, 39342, 52399, 13228, 65456) c5(BS, iP, pp, BT, q, fO, J, iv, bm); #c1(ACTR1B) c2(NP_005726) c3(172) c4(26286, 39343, 52400, 13229, 65457) c5(bb, q, i); #c1(ACTR2) c2(NP_001005386) c3(173) c4(26287, 39344, 52401, 13230, 65458) c5(BO, BU, V, b, X, sE, eu, BV, 13, ag, P, A, fl, II, BW, U, bu, jD); #c1(ACTR3B) c2(NP_001035225) c3(174) c4(26288, 39345, 52402, 13231, 65459) c5(bq, by, ak, bu, cO); #c1(ACTR3)

c2(NP_001264069) c3(175) c4(26289, 39346, 52403, 13232, 65460) c5(X, P, 13W); #c1(ACTR5) c2(NP_079131) c3(176) c4(26290, 39347, 52404, 13233, 65461) c5(ao); #c1(ACTRT1) c2(NP_612146) c3(177) c4(26291, 39348, 52405, 13234, 65462) c5(dv, P, co, aX); #c1(ACVR1B) c2(NP_004293) c3(178) c4(26292, 39349, 52406, 13235, 65463) c5(qW, nV, BX, ip, iF, hV, ag, BY, ny, at, y); #c1(ACVR1C) c2(NP_001104501) c3(179) c4(26293, 39350, 52407, 13236, 65464) c5(X, av, aA, bm, q); #c1 (ACVR1) c2(NP_001096) c3(180) c4(26294, 39351, 52408, 13237, 65465) c5(A, b, k, X, cr, kB, BY, fl, sF, bw, U, e, O, d, bb, B, N, Cc, do, tg, av, u, kF, V, aB, Cb, dt, T, Ca, cy, Cd, BZ, rQ, hQ, fg); #c1(ACVR2A) c2(NP_001265508) c3(181) c4(26295, 39352, 52409, 13238, 65466) c5(A, b, cY, Cf, U, hP, bB, wP, cs, av, u, vR, kF, V, sH, ad, Ce, x, pq, wV, eD, ag); #c1(ACVR2B) c2(NP_001097) c3(182) c4(26296, 39353, 52410, 13239, 65467) c5(mz, vR, bf, I, b, fN, Cj, Ci, Ck, BY, fe, cc, CI, Cg, Ch, AM); #c1(ACVRL1) c2(NP_001070869) c3(183) c4(26297, 39354, 52411, 13240, 65468) c5(bL, b, yh, z, dB, Cx, di, Cn, lw, Co, Ct, y, jT, bb, kJ, h, IW, Cu, Cz, bw, Cp, cq, u, iF, vR, si, Cq, j, IR, IX, vc, Cm, hR, Cs, qp, CB, xd, Cr, ag, Cv, IS, Cy, Cw, bh, CA, ap); #c1(ACY1) c2(NP_001185824) c3(184) c4(26298, 39355, 52412, 13241, 65469) c5(em, CD, fU, CC, ni, cV, dB, cz, fo, cB, x, fy); #c1(ACY3) c2(NP_542389) c3(185) c4(26299, 39356, 52413, 13242, G5470) c5(dB, bm, q, b, cV); #c1(ACYP2) c2(NP_612457) c3(186) c4(26300, 39357, 52414, 13243, 65471) c5(d, ik, bb, e); #c1(ADAD1) c2(NP_001152757) c3(187) c4(26301, 39358, 52415, 13244, 65472) c5(jH, aV, I, aC, ig, di, at, aE); #c1(ADA) c2(NP_000013) c3(188) c4(26302, 39359, 52416, 13245, 65473) c5(eX, CO, hM, CP, bf, oU, cy, rh, t, CN, CI, CK, Dc, aD, mz, CS, aC, sH, bp, vB, CJ, x, qt, De, Di, cT, Da, fD, aA, CU, eu, xw, zL, y, CZ, pp, Dk, B, Db, jS, iv, by, HI, CX, CG, V, ae, Bs, bd, pr, bt, nb, uJ, Dh, fn, b, Df, ey, jD, nL, pL, nU, CR, CO, se, jG, u, dh, sB, I, Dg, cz, CM, G, aZ, CF, ao, ch, tW, Dj, aE, gd, CL, CV, aft zD, A, gw, CE, di, gE, CT, al, m, qs, aX, CW, h, Dd, CH, J, dt, P, jl, aM, CY, at, eg); #c1(ADAM10) c2(NP_001101) c3(189) c4(26303, 393RD, 52417, 13246, 65474) c5(dx, Dr, A, b, X, Dn, dB, Dm, aN, dk, w, bV, DI, z, bf, O, bu, aK, e, y, d, ed, dv, aX, rW, Dq, f, CR, q, gT, M, do, B, pN, qj, fH, av, u, aE, o, ff, Dp, cV, sX, du, v, J, jo, T, wt, x, bb, fx, et, fJ, aM, Do, Ds, P, fw, yE, fl, i, at, rb); #c1(ADAM11) c2(NP_002381) c3(190) c4(26304, 39361, 52418, 13247, 65475) c5(ac, bb, b, jz, xe, P, di, Iv, fH, as, bq, O, u, fJ, y, jQ); #c1(ADAM12) c2(NP_001275904) c3(191) c4(26305, 39362, 52419, 13248, 65476) c5(fl, b, Dv, w, kY, e, y, d, F, q, bu, ik, ar, av, fy, u, o, bm, qL, sH, Dt, bp, by, dU, T, sK, aq, eD, Du, i, bh, aA, aG); #c1(ADAM15) c2(NP_001248393) c3(192) c4(26306, 39363, 52420, 13249, 65477) c5(dx, A, b, X, Dn, kB, Dy, U, e, y, d, co, aX, Dx, f, bu, ar, B, cs, u, aC, sX, du, Dw, by, dv, T, Dz, fP); #c1(ADAM17) c2(NP_003174) c3(193) c4(26307, 39364, 52421, 13250, 65478) c5(ek, dx, f, b, ag, X, aF, z, ud, dB, DC, O, id, di, ic, kY, cO, bf, U, A, vl, y, d, ed, co, bb, DE, pp, kJ, fq, DB, N, q, bu, mR, DA, hb, cs, e, av, aV, u, fY, ff, g, sz, Dp, be, sB, V, I, cV, aC, du, J, j, ad, da, jo, dv, T, fO, bq, jl, by, et, hj, fM, sK, fy, sS, B, gd, fP, o, DD, gz, aA, at, bV); #c1(ADAM19) c2(NP_150377) c3(194) c4(26308, 39365, 52422, 13251, 65479) c5(g, jT, hW, DG, X, ak, gT, O, aZ, cO, I, BL, av, DF, et, fY, aG); #c1(ADAM20) c2(XP_005268209) c3(195) c4(26309, 39366, 52423, 13252, 65480) c5(4); #c1 (ADAM21) c2(NP_003804) c3(196) c4(26310, 39367, 52424, 13253, 65481) c5(jz, Iv, jQ) #c1(ADAM22) c2(NP_057435) c3(197) c4(26311, 39368, 52425, 13254, 65482) c5(hS, u, O, y); #c1(ADAM23) c2(NP_003803) c3(198) c4(26312, 39369, 52426, 13255, 65483) c5(g, td, V, b, fO, bu, cy, U, by, u, y, pp); #c1(ADAM28) c2(NP_055080) c3(199) c4(26313, 39370, 52427, 13256, 65484) c5(eX, aw, b, U, e, y, d, co, pp, DH, q, bu, ar, fy, u, g, V, I, fO, by, T, cT, aA); #c1(ADAM29) c2(NP_001265056) c3(200) c4(26314, 39371, 52428, 13257, 65485) c5(d, cT, aX, e); #c1(ADAM2) c2(NP_001265042) c3(201) c4(26315, 39372, 52429, 13258, 65486) c5(jo, ck, ff, b); #c1(ADAM33) c2(NP_001269376) c3(202) c4(26316, 39373, 52430, 13259, 65487) c5(dx, da, ml, DJ, DK, y, dv, cy, t, DM, bu, O, aD, u, aE, g, du, by, ti, qe, dP, DL, DI, fq, I, aA, at); #c1(ADAM7) c2(NP_003808) c3(203) c4(26317, 39374, 52431, 13260, 65488) c5(aX); #c1(ADAM8) c2(NP_001100) c3(204) c4(26318, 39375, 52432, 13261, 65489) c5(dx, A, aw, b, qd, X, kY, bw, e, O, d, co, cy, kJ, B, zx, ky, ar, u, g, aC, du, bp, dv, nk, dP, dS, mb, ag, bq, at, zH); #c1(ADAM9) c2(NP_003807) c3(205) c4(26319, 39376, 52433, 13262, 65490) c5(dx, DN, A, b, dB, dk, fl, e, y, d, co, aX, ml, f, q, bu, ar, B, cs, fy, u, o, ff, bm, nQ, nW, du, bp, ad, jo, dv, T, fx, by, DP, iR, DO, ag, i, ji, rb); #c1(ADAM-DEC1) c2(NP_001138743) c3(206) c4(26320, 39377, 52434, 13263, 65491) c5(sJ, fl, fP, b, sN); #c1(ADAMTS10) c2(NP_112219) c3(207) c4(26321, 39378, 52435, 13264, 65492) c5(er, ez, fq, DQ, f, DS, DR); #c1(ADAMTS12) c2(NP_112217) c3(208) c4(26322, 39379, 52436, 13265, 65493) c5(co, cy, pp, b, aC, be, DT, ad, ti, T, cs, cQ, u, y); #c1(ADAMTS13) c2(NP_620594) c3(209) c4(26323, 39380, 52437, 13266, 65494) c5(bP, Ef, DW, aw, tG, pT, k, aF, dB, qb, eW, bn, fw, DX, gE, Eh, ps, eV, aO, Ei, aX, b, Ec, AX, f, F, q, jV, DV, Em, DZ, cM, Ek, DY, u, fh, DU, fi, qC, be, Ed, ae, Ea, lb, sH, bc, gJ, J, Ej, dt, jo, aR, eX, cV, bh, x, bb, ya, pi, qD, pq, P, W, jE, vs, Eb, zE, g, bm, nG, vT, El, Ee, fD, bq, Eg, aft aA, at, y, ap); #c1(ADAMTS14) c2(NP_542453) c3(210) c4(26324, 39381, 52438, 13267, 65495) c5(En, ao, aV, ak, en); #c1(ADAMTS15) c2(NP_620686) c3(211) c4(26325, 39382, 52439, 13268, 65496) c5(A, V, pp, ad, Eo, T, cs, U, u, y); #c1(ADAMTS16) c2(NP_620687) c3(212) c4(26326, 39383, 52440, 13269, 65497) c5(jh, ao, il, kB, ik, di, bj); #c1(ADAMTS17) c2(NP_620688) c3(213) c4(26327, 39384, 52441, 13270, 65498) c5(bm, Ep, Eq, aW, DS); #c1(ADAMTS18) c2(NP_955387) c3(214) c4(26328, 39385, 52442, 13271, 65499) c5(Es, Er, aX, b, dA, Bu, T, at, u, cp); #c1(AD-AMTS19) c2(NP_598377) c3(215) c4(26329, 39386, 52443, 13272, 65500) c5(Et, I, jw, Ap); #c1(ADAMTS1) c2(NP_008919) c3(216) c4(26330, 39387, 52444, 13273, 65501) c5(dx, A, b, fr, Ev, fl, vZ, y, bQ, bb, Bc, B, q, bu, cU, aV, u, dh, fh, yJ, sB, du, bp, ft, dv, T, gs, iA, by, fy, Eu, aq, aE, ag, gR, bq, at, ap); #c1(ADAMTS20) c2(NP_079279) c3(217) c4(26331, 39388, 52445, 13274, 65502) c5(aX); #c1(ADAMTS2) c2(NP_055059) c3(218) c4(26332, 39389, 52446, 13275, 65503) c5(Ew, at, aY, f, J, fO, Ey, cT, en, Ex, y, do, En, gZ, u, EM); #c1(ADAMTS3) c2(NP_055058) c3(219) c4(26333, 39390, 52447, 13276, 65504) c5(dx, be, I, fc, du, dv, pZ, Ez, En, aV); #c1(ADAMTS4) c2(NP_005090) c3(220) c4(26334, 39391, 52448, 13277, 65505) c5(dx, be, b, qd, fc, du, dv, w, EA, pZ, fz, Ez, aC, En, O, aV, Ex, o); #c1(ADAMTS5) c2(NP_008969) c3(221) c4(26335, 39392, 52449, 13278, 65506) c5(dx, A, rK, b, aC, du, dv, w, rR, Ez, O, be); #c1(ADAMTS6) c2(NP_922932) c3(222) c4(26336, 39393, 52450, 13279, 65507) c5(h); #c1(ADAMTS7) c2(NP_055087) c3(223) c4(26337, 39394, 52451, 13280, 65508) c5(dx, en, kF, dS, aC, du, CO, be, dv, bq, at, aW, ap); #c1(ADAMTS8) c2(NP_008968) c3(224) c4(26338, 39395, 52452, 13281, 65509) c5(g, f, q, ag, T, O, U, u, y); #c1(ADAMTS9) c2(NP_891550) c3(225)

c4(26339, 39396, 52453, 13282, 65510) c5(jh, A, il, b, I, jM, EB, fO, bu, P, ix, T, bf, ik, aA, by, bq, o, aM); #c1 (ADAMTSL1) c2(NP_001035362) c3(226) c4(26340, 39397, 52454, 13283, 65511) c5(bj, cy, bq); #c1(ADAMTSL2) c2(NP_001138792) c3(227) c4(26341, 39398, 52455, 13284, 65512) c5(EE, rM, ED, vd, EC, EF, DS, ni, xr, Eh); #c1(ADAMTSL3) c2(NP_997400) c3(228) c4(26342, 39399, 52456, 13285, 65513) c5(V, b, tW, ak, ad, ic, cs, bq, U, ez); #c1(ADAMTSL4) c2(XP_011507946) c3(229) c4(26343, 39400, 52457, 13286, 65514) c5(EK, EH, X, t, EF, El, G, DS, dt, EG, Eh, av, EJ); #c1(ADAMTSL5) c2(NP_998769) c3(230) c4(26344, 39401, 52458, 13287, 65515) c5(bb); #c1(ADAP1) c2(NP_001271237) c3(231) c4(26345, 39402, 52459, 13288, 65519) c5(cV, o, AN); #c1(ADAP2) c2(NP_060874) c3(232) c4(26346, 39403, 52460, 13289, 65517) c5(cr, or, b, EM, xJ, xr, iD, EL, AP); #c1(ADARB1) c2(NP_056649) c3(233) c4(26347, 39404, 52461, 13290, 65518) c5(oC, aw, b, k, EN, w, a, hW, m, co, ak, q, fH, fy, bm, g, dj, kF, fJ, ao, ix, bh); #c1(ADARB2) c2(NP_061172) c3(234) c4(26348, 39405, 52462, 13291, 65519) c5(g, Eo, ao, bb, b, dA, tv, w, IV); #c1(ADAR) c2(NP_101020278) c3(235) c4(26349, 39406, 52463, 13292, 65520) c5(ED, en, ER, b, k, cY, EN, mk, iL, gE, al, jh, ES, IE, aX, pL, AX, q, aq, jZ, g, pE, V, m, Dg, gL, P, EQ, bM, oy, rW, EP, ao, kQ, bh, Dq, II); #c1(ADAT2) c2(NP_001273188) c3(239) c4(26350, 39407, 52464, 13293, 65521) c5(og); #c1(ADAT3) c2(NP_612431) c3(237) c4(26351, 39408, 52465, 13294, 65522) c5(ET); #c1(ADCK3) c2(NP_064632) c3(238) c4(26352, 39409, 52466, 13295, 65523) c5(EW, kS, EX, EU, EV); #c1 (ADCK4) c2(NP_001136027) c3(239) c4(26353, 39410, 52467, 13296, 65524) c5(EY, et, hc, lo, bd); #c1(ADCY10) c2(NP_001161221) c3(240) c4(26354, 39411, 52468, 13297, 65525) c5(da, EL, b, zl, DR, W, mk, T, Fa, Ez, di, U, op, Fb, O, V); #c1(ADCY1) c2(NP_066939) c3(241) c4(26355, 39412, 52469, 13298, 65526) c5(iF, dj, fU, ii, aY, do, cM); #c1(ADCY2) c2(NP_065433) c3(242) c4(26356, 39413, 52470, 13299, 65527) c5(cy, b, cV, Fc, ad, O, fz, os, I, bb, qe); #c1(ADCY3) c2(NP_004027) c3(243) c4(26357, 39414, 52471, 13300, 65528) c5(em, Fd, b, I, dA, ak, bu, a, a, by); #c1(ADCY5) c2(NP_001186571) c3(244) c4(26358, 39415, 52472, 13301, 65529) c5(Ag, I, aY, xM, cK, f, Fe, mA, T, Af, do, a, bM, di, aA, cM, op); #c1(ADCY6) c2(NP_056085) c3(245) c4(26359, 39416, 52473, 13302, 65530) c5(qt, Ff, cO); #c1(ADCY1) c2(NP_001105) c3(246) c4(26360, 39417, 52474, 13303, 65531) c5(dj, hW, aY, h, do, cA, cM); #c1(ADCY8) c2(NP_001106) c3(247) c4(26361, 39418, 52475, 13304, 65532) c5(dx, du, lc, aY, ak, dj, do, dv, cM, do, bq, Fg, o); #c1(ADCY9) c2(NP_001107) c3(248) c4(26362, 39419, 52476, 13305, 65533) c5(dj, qw, bb, or, ae, dA, eW, ak, gf, IL, eV, di, cQ, Fh, oy, hd); #c1(ADCYAP1) c2(NP_001093203) c3(249) c4(26363, 39420, 52477, 13306, 65534) c5(bP, f, b, eO, Ey, A, Fm, bf, O, jh, Fp, co, bb, sG, ak, B, hb, kX, aV, dh, g, Fj, ma, hW, cB, I, cV, fQ, v, bp, Fo, eX, Fk, bq, x, cK, aM, ao, Fn, ch, FI, ih, ag, Fi, iB, mD, eN); #c1(ADCYAPIR1) c2(NP_001109) c3(250) c4(26364, 39421, 52478, 13307, 65535) c5(f, fO, Ey, Fq, O, A, aW, co, oy, kJ, sG, ak, B, cB, iv, av, Fg, ma, hW, cV, Fs, cM, Fo, bp, x, Fr, qe, qp, aY, ih, qc, do, vt); #c1(ADD1) c2(NP_001110) c3(251) c4(26365, 39422, 52479, 13308, 65536) c5(bP, bL, fl, td, vh, eO, eR, di, dx, cO, bf, FA, pl, aO, oy, qs, dv, bb, h, q, aG, dl, iZ, FB, fH, Fw, pW, fh, xS, Si, I, sH, du, Fy, et, fJ, aM, ao, Fz, Fu, lc, aE, Fx, fD, Fv, Ft, bq, aA, at, ap); #c1(ADD2) c2(NP_001171984) c3(252) c4(26366, 39423, 52480, 13309, 65537) c5(oy, FD, qs, fl, Fx, h, FC, FE, di, zb, FF, FB, Ft, aft RE); #c1(ADD3) c2(NP_058432) c3(253)

c4(26367, 39424, 52481, 13310, 65538) c5(Fx, FJ, je, v, FI, w, di, FF, FH, FG, pl, aW, fh); #c1(ADGB) c2(NP_078970) c3(254) c4(26368, 39425, 52482, 13311, 65539) c5(Bm); #c1(ADGRA1) c2(NP_101077378) c3(255) c4(26369, 39426, 52483, 13312, 65540) c5(nk, oy); #c1(ADGRA2) c2(NP_116166) c3(256) c4(26370, 39427, 52484, 13313, 65541) c5(dU, ho); #c1(ADGRA3) c2(NP_660333) c3(257) c4(26371, 39428, 52485, 13314, 65542) c5(bf, do, FK); #c1(ADGRB1) c2(XP_011515501) c3(258) c4(26372, 39429, 52486, 13315, 65543) c5(g, bL, V, b, f, q, bu, w, U, by, dh, O); #c1(ADGRB2) c2(NP_001281264) c3(259) c4(26373, 39430, 52487, 13316, 65544) c5(g, do, dh, fw); #c1(ADGRB3) c2(NP_001695) c3(260) c4(26374, 39431, 52488, 13317, 65545) c5(g, fU, bb, cV, FL, do, T, oy, dh, O); #c1(ADGRD1) c2(NP_942122) c3(261) c4(26375, 39432, 52489, 13318, 65546) c5(mO, Fg); #c1(ADGRD2) c2(XP_006717411) c3(262) c4(26376, 39433, 52490, 13319, 65547) c5(kF); #c1(ADGRE1) c2(NP_001243181) c3(263) c4(26377, 39434, 52491, 13320, 65548) c5(A, FM, eW, vR, bk, cQ, pq); #c1(ADGRE2) c2(NP_001257981) c3(264) c4(26378, 39435, 52492, 13321, 65549) c5(ar, U, w, T); #c1(ADGRE5) c2(NP_001020331) c3(265) c4(26379, 39436, 52493, 13322, 65550) c5(fe, nV, fs, aC, hV, uH, by, FN, w, T, O, aZ, ar, U, bu, hP, be); #c1(ADGRF5) c2(NP_056049) c3(266) c4(26380, 39437, 52494, 13323, 65551) c5(hR, f, u, y); #c1(ADGRG1) c2(NP_001277071) c3(267) c4(26381, 39438, 52495, 13324, 65552) c5(d, jh, yR, aX, b, FR, FU, FP, hT, e, cY, FT, FS, nl, bw, FD, yv); #c1(ADGRG2) c2(NP_001073327) c3(268) c4(26382, 39439, 52496, 13325, 65553) c5(T, o); #c1(ADGRG3) c2(NP_740746) c3(269) c4(26383, 39440, 52497, 13326, 65554) c5(bb, FU); #c1(ADGRH) c2(NP_001027566) c3(270) c4(26384, 39441, 52498, 13327, 65555) c5(FW, do, DF, aZ, FV); #c1(ADGRG7) c2(NP_116176) c3(271) c4(26385, 39442, 52499, 13328, 65556) c5(jT, nV); #c1 (ADGRL1) c2(NP_001008701) c3(272) c4(26386, 39443, 52500, 13329, 65557) c5(FX, ma, ap); #c1(ADGRL3) c2(NP_056051) c3(273) c4(26387, 39444, 52501, 13330, 65558) c5(do, ma, f, FY); #c1(ADGRV1) c2(NP_115495) c3(274) c4(26388, 39445, 52502, 13331, 65559) c5(Ga, Gf, hS, vY, w, ow, eO, Gi, Ge, AD, ml, oJ, nW, Gb, Gd, gF, wh, FL, Gh, Bx, nE, Gg, Gc, at); #c1(ADH1A) c2(NP_000658) c3(275) c4(26389, 39446, 52503, 13332, 65560) c5(by, fy, GI, V, b, cV, dE, nu, bu, ag, Gk, Gj, at, bj, ay, o); #c1 (ADH1B) c2(NP_000659) c3(276) c4(26390, 39447, 52504, 13333, 65561) c5(dx, Gt, Gm, F, sA, GF, CP, Gq, Gy, e, at, gM, GH, GL, GG, Gp, ju, ik, rR, mz, du, vc, GI, GA, ag, Gu, bq, aA, GJ, Gz, GC, tG, fE, iP, mk, ob, bf, U, cM, ip, ml, f, bu, Go, bm, Gr, GI, V, ae, gv, qH, fw, jP, aG, bn, uy, b, GD, ia, Gx, z, nS, GE, d, jh, bb, Iz, Gv, q, dW, vu, Gj, u, ov, I, dT, gL, by, GM, ih, y, Gn, GK, di, vg, oy, sG, wG, hB, oE, Gs, Gw, GB, T, vv, aM, nk, Y, bh, ap); #c1(ADH4) c2(NP_0006 fil) c3(277) c4(26391, 39448, 52505, 13334, 65562) c5(gK, bn, GI, Gt, b, X, ju, H, q, dW, ip, ik, GI, il, ay, GN, bj, Gj, GE); #c1(ADH5) c2(NP_000662) c3(278) c4(26392, 39449, 52506, 13335, 65563) c5(GD, gB, b, GO, bw, y, co, jl, ip, f, q, dW, do, rR, Gj, GP, bp, ny, cy, GD, BX, u, ex); #c1(ADH) c2(NP_000663) c3(279) c4(26393, 39450, 52507, 13336, 65564) c5(Gj, GI, BX, ny, ip); #c1 (ADH7) c2(NP_000664) c3(280) c4(26394, 39451, 52508, 13337, 65565) c5(GK, A, Gt, b, GL, di, Gq, bf, U, e, oy, jh, bQ, ip, B, F, bu, cU, ik, IV, nR, d, V, dA, GS, by, GB, GI, GR, iA, Gj, ay, GM, at); #c1(ADHFE1) c2(NP_653251) c3(281) c4(26395, 39452, 52509, 13338, 65566) c5(V, b, GT, W, qX, U); #c1(ADI1) c2(NP_H0739) c3(282) c4(26396, 39453, 52510, 13339, 65567) c5(A, ae, X, B, aC, bF); #c1(ADIG) c2(NP_001018092) c3(283) c4(26397, 39454, 52511, 13340, 65568) c5(GU); #c1(ADIPOQ) c2(NP_001171271) c3(284) c4(26398, 39455, 52512, 13341, 65569) c5(dx, gK, B, dN, tC, dB, eH, w, cO, bf, bQ, rh, Hg, Hj, om, jm, mR, mz, aC, sH, du, gJ, bp, jT, dL, tS, gs, dS, fN, wK, Hf, ag, fD, Hd, bq, aA, cd, bP, ug, em, He, rd, ix, GV, U, Hi, y, V, co, f, bu, cs, bm, Hb, rN, Bs, GY, cx, GX, GZ, Fy, dv, eX, Hh, iA, py, cf, gA, jP, iu, ap, bn, b, aF, jJ, eR, Hc, sU, z, ey, aO, bb, jd, re, q, ar, jG, u, dh, o, sz, kF, I, Fw, gL, ad, wL, aZ, gn, et, jU, Ha, ch, mA, aE, rv, I, bL, A, GW, sv, di, C, wf, al, oy, m, qs, ob, h, cU, ik, ma, J, vF, P, gF, by, fM, aM, wU, ii, lc, Af, bh, at, eG, gf, gl); #c1(ADIPOR1) c2(NP_001277558) c3(285) c4(26399, 39456, 52513, 13342, G5570) c5(bP, dx, A, bf, b, mz, Hk, ey, cO, sv, w, di, z, HI, al, U, y, hh, bQ, B, bu, cU, om, ar, cs, jG, u, pR, o, em, kF, V, I, aC, du, dB, ad, gF, wL, dv, T, eX, iA, by, dL, fM, aM, dS, fN, eD, py, rv, I, bh, aA, at, fD, ap); #c1(ADIPOR2) c2(XP_006719081) c3(286) c4(26400, 39457, 52514, 13343, 65571) c5(dx, B, b, mz, cO, jJ, w, z, bf, al, A, U, y, dv, f, bu, cU, om, ar, cs, jG, u, o, sz, kF, V, I, aC, du, ad, gF, eX, iA, by, fM, aM, py, ch, bk, rv, fN, I, bh, aA, at, fD, ap); #c1(ADIRF) c2(NP_006820) c3(287) c4(26401, 39458, 52515, 13344, 65572) c5(o, b); #c1(ADK) c2(NP_001114) c3(288) c4(26402, 39459, 52516, 13345, 65573) c5(wK, Hm, b, dk, Ho, ch, nU, Hp, fD, hS, iZ, Hm, hw, aE, H, gl); #c1(ADM2) c2(NP_001240774) c3(289) c4(26403, 39460, 52517, 13346, 65574) c5(sz, Hq, b, bL, fq, q, cQ, at); #c1(ADM) c2(NP_001115) c3(290) c4(26404, 39461, 52518, 13347, 65575) c5(dx, gK, ml, iD, Hv, EM, HG, eH, HC, w, ku, cO, bf, eP, e, D, M, dv, cy, HA, wv, Hs, g, mz, aC, sH, du, gJ, bp, ft, vc, od, x, Eu, fx, hR, f, AW, we, ag, qP, iT, i, bq, aA, Ah, rn, sU, bP, id, X, sj, jj, eu, IW, bw, U, Hi, y, co, sr, ak, B, cs, ay, fY, HF, V, eX, cl, iA, fv, fw, Eo, HB, qh, re, ap, vq, b, aF, Hr, m, fl, ic, Hu, ey, pl, aO, d, bb, eA, vj, q, zx, HH, ar, HE, sK, u, dh, sz, I, gL, ad, lo, et, jU, vs, hU, ch, eD, Ht, aE, kC, I, bL, A, k, fr, kg, HD, lk, HJ, BY, di, Hz, al, aW, oy, vH, qs, h, cU, nM, Hx, HI, ma, cV, hZ, sB, Fs, J, T, fD, HK, Bb, cz, aM, Hy, Hw, at); #c1 (ADNP) c2(XP_011527049) c3(291) c4(26405, 39462, 52519, 13348, 65576) c5(wK, nU, HN, cz, HM, xw, dh, HL); #c1(ADO) c2(NP_116193) c3(292) c4(26406, 39463, 52520, 13349, 65577) c5(zM, zl, dt, jU, HO, HR, HP, HD); #c1(ADDRA1) c2(NP_000555) c3(293) c4(26407, 39464, 52521, 13350, 65578) c5(f, bS, Gm, eu, di, HS, wX, bf, y, gM, qs, cy, ak, mR, gP, sR, jG, u, dh, H, aZ, bq, cK, aM, ch, fw, aE, ih, HT, vZ, aA, at); #c1(ADDRA2A) c2(NP_001255429) c3(294) c4(25408, 39465, 52522, 13351, 65579) c5(dx, gK, Ib, Bu, Dy, tR, HU, dk, xb, di, pu, cQ, la, bj, wW, gM, qs, cy, sG, vf, HW, HY, mR, gP, fH, dh, H, dj, ma, si, HX, aC, du, j, cz, IR, xq, wX, aZ, cK, fJ, to, Eu, ch, hT, HZ, ih, HV, I); #c1(ADDRA2B) c2(NP_000557) c3(295) c4(26409, 39466, 52523, 13352, 65580) c5(dx, b, di, IW, bf, U, ey, gM, aX, f, ar, cs, u, dh, I, sH, du, ad, W, cy, aM, qt, mA, gd, fP, I, at); #c1(ADPGK) c2(NP_112574) c3(296) c4(25410, 39467, 52524, 13353, 65581) c5(Eo); #c1(ADPRH) c2(NP_001278878) c3(297) c4(25411, 39468, 52525, 13354, 65582) c5(10, dD); #c1(ADPRHL1) c2(NP_612439) c3(298) c4(26412, 39469, 52526, 13355, 65583) c5(Id); #c1(ADPRHL2) c2(XP_011539938) c3(299) c4(26413, 39470, 52527, 13356, 65584) c5(u); #c1 (ADRA1A) c2(NP_000571) c3(300) c4(26414, 39471, 52528, 13357, 65585) c5(de, io, ak, hA, b, yu, yB, le, yz, eR, hS, yD, w, di, yx, yn, cO, If, O, oE, A, yv, y, oy, yy, qs co, aX, or, yl, f, F, q, ys, ap, yp, X, yF, B, aJ, Ig, av, DY, u, el, Fg, zb, o, kF, cB, I, aC, nW, fO, bp, lh, P, ti, yk, sw, uw, cy, jv, jC, yA, yG, wx, at, ro, ym, ch, yr, cT, gu, oN, fD, iI, bh, aA, aG, eX, bj, yo); #c1(ADRA1B) c2(NP_000570) c3(301) c4(26415, 39472, 52529, 13358, 65586) c5(oy, qs, ak, kF, V, io, f, je, dj, bu, di, HS, fD, cy, U, by, et, aA); #c1(ADRA1D) c2(NP_000669) c3(302) c4(26416, 39473, 52530, 13359, 65587) c5(dx, In, aw, IR, ig, II, aN, mC, Jo, w, hM, lu, cO, Eh, IK, fR, Ej, cp, dv, cy, FP, Ja, Jp, EA, zb, Jb, sl, pq, ID, cB, IU, aC, bK, du, gm, ft, IA, vx, Jj, IH, gg, dH, lq, f, dk, Ip, sS, ag, cT, bk, fD, ry, wz, sY, fl, fi, X, hS, ur, dV, II, bf, Fh, U, cC, kV, cM, co, bi, lw, IN, bu, dZ, Ii, B, cs, oD, av, bm, wY, sF, iF, jB, qw, V, IM, IT, gv, lh, Ji, Hq, Jc, eX, bt, ar, bd, BV, qK, W, IL, IC, lx, In, iV, mD, IP, tl, dR, wT, vq, uy, eq, b, Jg, aF, IB, z, ly, ey, ba, IS, Im, wd, vf, q, zx, IY, It, DZ, mR, u, ov, o, cl, Id, Ir, Jo, aP, el, vS, Is, ad, IJ, IG, Jm, et, Jl, jU, Jd, jH, ao, kB, iR, IW, Bu, Ck, aE, aY, bq, aU, FY, bL, A, xu, k, fr, zF, Jn, Iv, IE, di, iL, gE, ID, kF, al, iK, m, qs, IZ, aX, sG, io, F, It, pC, Ex, y, Jf, Jk, IV, jZ, dj, ax, cV, IF, J, lq, dt, P, T, j, Ij, pw, gF, vv, aM, lz, ii, ID, Jh, Fo, eB, IX, iB, bh, at, lk); #c1(ADRA2A) c2(NP_000572) c3(303) c4(26417, 39474, 52531, 13360, 65588) c5(xJ, aF, FE, rd, hS, jc, au, di, bf, a, If, bj, cM, oy, jT, Jr, rr, f, Jq, B, Ig, DY, o, zb, is, dj, I, Jt, cx, hv, BZ, Js, wX, eX, mD, hR, aM, jH, gs, aY, ql, Ju, ih, dc, bh, aA, at, FY); #c1(ADRA2B) c2(NP_000573) c3(304) c4(25418, 39475, 52532, 13361, 65589) c5(dx, nU, b, yu, vD, yz, O, hS, yD, w, id, ak, yn, cO, bf, yA, A, yv, y, oy, yy, qs, co, aX, yl, f, F, ys, oE, yp, X, yF, B, cB, Ig, av, yB, u, el, Fg, mz, kF, I, aC, nW, du, fO, cx, bp, P, dv, yk, eX, aZ, uw, cy, qg, jv, jC, hj, aM, yG, at, ym, Ey, bq, Jv, yr, il, cT, gu, yx, di, aA, ap, yo); #c1(ADRA2C) c2(NP_000574) c3(305) c4(26419, 39476, 52533, 13392, 65590) c5(Ig, Jy, di, cO, cA, If, Jx, cM, oy, rr, xJ, mR, DY, dj, hW, I, cz, Jw, mO, to, aY, Jz, uX, jN, dr); #c1(ADRBI) c2(NP_000575) c3(306) c4(26420, 39477, 52534, 13363, 65591) c5(dx, gK, ml, b, yu, IW, dj, eR, pW, eH, id, di, wv, JC, cO, cA, bf, vl, ey, oy, qs, o, bb, qc, f, qr, bu, sM, mL, mR, sX, Ig, JD, aE, fY, sz, JB, ma, Bs, mc, cx, dv, rB, bq, cK, hR, vG, mO, rd, du, ch, er, JA, Cr, Fg, fD, I, ji, aA, at, iu, ap); #c1(ADRB2) c2(NP_000015) c3(307) c4(26421, 39478, 52535, 13364, 65592) c5(dx, gK, by, hg, JH, lw, Gm, dD, DT, vB, Ka, eH, tH, ak, cO, bf, e, O, gO, vr, bD, cy, rh, t, IL, dl, mR, wY, JF, et, Kd, Fg, xy, mz, JI, jH, aC, bK, sH, du, fO, bp, JT, JQ, aE, JM, ro, JN, vG, mO, dH, JD, qt, sS, fc, fN, tO, ag, cT, pH, bk, fz, dc, hM, aA, bP, td, Ke, rd, mk, ma, JE, bw, cM, ez, co, ml, f, bu, v, JX, DF, pW, em, Gr, V, dA, Bs, cx, gv, vb, dv, eX, bq, Fr, JY, aH, dP, py, aY, er, qc, gA, JO, cf, ji, iu, aG, Ig, b, aF, vh, eR, tG, cK, JL, gZ, pl, aO, d, bb, vC, q, ap, IY, dB, ac, wM, ar, u, nj, o, fh, sz, kF, I, sX, bc, pk, gL, cz, aD, G, rB, wx, JJ, GW, Jd, Kc, ao, fD, DR, dh, gd, aZ, I, hd, A, JC, Kb, JS, JR, JP, di, vg, JK, JV, oy, qs, aX, or, sG, fq, qr, JU, y, aV, aq, dj, ax, tP, cV, J, JG, P, ti, dK, jl, gF, JW, qe, aM, nk, ii, lc, vc, DI, iB, bh, at, DM); #c1(ADRB3) c2(NP_000015) c3(308) c4(26422, 39479, 52536, 13365, 65593) c5(gK, eH, cO, bf, yr, bD, rh, Kg, dl, orn, wY, Ha, mz, aC, sH, Kh, x, Kb, ro, fN, Kf, we, Fi, fD, bg, aA, we, td, rd, ob, oA, y, eX, os, Ki, em, V, dA, ox, oK, iA, tm, or, ap, Ig, uy, b, jJ, eR, au, z, ey, eA, bX, IY, u, dh, o, kF, I, sX, ad, xk, GW, jU, Jd, ao, oh, mA, aE, I, ka, di, JC, wf, oy, m, qs, az, jl, or, cU, dj, vF, bR, gF, aM, lo, at); #c1(ADRBK1) c2(NP_001810) c3(309) c4(28423, 39480, 52537, 13366, 65594) c5(gK, hV, b, JS, KI, IW, bg, A, di, ak, cO, bf, em, bj, ey, y, yr, aX, dN, Dq, f, q, Kk, yp, mR, B, Km, u, dh, o, sz, oV, aC, bK, mc, W, T, bb, hR, aM, jE, nV, uJ, Kj, bm, HN, Cr, yr, yE, iF, gj, bg, aA, at, cK, oT); #c1(ADRBK2) c2(NP_005151) c3(310) c4(28424, 39481, 52538, 13367, 65595) c5(iw, mc, hW, f, w, hN, hM, ak, cB, cO, Kn, hR, bj, be, mR); #c1(ADRM1) c2(XP_011528804) c3(311) c4(28425, 39482, 52539, 13368, 65596) c5(A, aw, b, X, B, bu, aC, P, T, av, by, u, y); #c1(ADSL) c2(NP_000017) c3(312) c4(28428, 39483, 52540, 13369, 85597) c5(em, nU, gt, b, ni, oh, f, Ko, bm, w, bK, Kp, cz, u, Kq); #c1(ADSS) c2(NP_001117) c3(313) c4(28427, 39484, 52541, 13370, 85598) c5(fg, Kr, fI, bb, II); #c1 (ADSSL1) c2(NP_689541) c3(314) c4(28428, 39485, 52542, 13371, 65599) c5(ch, co); #c1(ADTRP) c2(NP_001137420) c3(315) c4(28429, 39488, 52543, 13372, 65600) c5(at, cO); #c1(AEBP2) c2(NP_001107848) c3(318) c4(28430, 39487, 52544, 13373, 65601) c5(Ks); #c1(AEN) c2(NP_073804) c3(317) c4(28431, 39488, 52545, 13374, 65602) c5(o); #c1(AES) c2(NP_945320) c3(318) c4(28432, 39489, 5254, 13375, 65603) c5(Kt, h, yr, Ku, ji, at); #c1(AFAP1) c2(NP_001128119) c3(319) c4(28433, 39490, 52547, 13378, 65604) c5(A, V, f, B, dZ, T, dV, Kv, ct, u, y, ez); #c1(AFAP1L1) c2(NP_001139809) c3(320) c4(28434, 39491, 52548, 13377, 65605) c5(Kw); #c1(AFAP1L2) c2(NP_001001936) c3(321) c4(28435, 39492, 52549, 13378, 65606) c5(jh, nV, aw, b, hV, bu, co, by); #c1(AFF1) c2(NP_001180185) c3(322) c4(28438, 39493, 52550, 13379, 65607) c5(m, b, t, h, J, mW, fJ, G, iv, fH, at, gi); #c1(AFF2) c2(NP_001182593) c3(323) c4(28437, 39494, 52551, 13380, 65608) c5(KC, xJ, KN, KF, jw, zp, KH, oy, KE, KA, Mt Ky, Kz, KB, KM, bK, el, Ap, Kx, nx, nz, iv, J, KL, G, KK, KJ, rD, KG, KD, KI); #c1(AFF3) c2(NP_001020279) c3(324) c4(28438, 39495, 52552, 13381, 65609) c5(c, JH, b, y, oy, t, h, nU, M, iv, on, IV, u, aE, ax, aC, J, G, dH, xe, Eo, fD); #c1(AFF4) c2(NP_055238) c3(325) c4(28439, 39498, 52553, 13382, 65610) c5(b, t, ie, J, P, on, G); #c1(AFG3L2) c2(NP_008787) c3(328) c4(28440, 39497, 52554, 13383, 65611) c5(M, KS, IK, Y, KR, kV, KU, v, KV, bN, zk, rw, KP, yH, KG, KT, KO, kS, bG, zp); #c1(AFM) c2(NP_001124) c3(327) c4(28441, 39498, 52555, 13384, 65612) c5(gE, b, X, Mt q, Ky, iL, z, av, bm); #c1(AFP) c2(NP_001125) c3(328) c4(28442, 39499, 52558, 13385, 65613) c5(gK, IJ, hg, aw, Lb, dD, gG, mC, bV, bf, kS, Li, Lm, KV, Ls, Lp, KX, Lw, jT, fp, cg, jE, Lz, fD, ag, Lo, bk, Fv, Dv, z, wy, Lr, y, f, LI, vD, bu, LB, Lf, cs, av, bm, jB, wB, kZ, gv, ar, mF, Lx, JY, W, gt, cf, dY, Le, CA, FG, ck, b, LA, q, Lq, dl, La, DZ, HE, u, KZ, Ly, ad, Lc, Lk, ct, et, Lt, wV, uH, wP, xX, fl, Lv, Ln, gE, Lu, C, iL, KG, KY, al, Ld, Lh, eq, jZ, Lg, fU, dt, T, II, Lj, by, ac, qp, Y, xM, sf, Af, bh); #c1(AGA) c2(NP_000018) c3(329) c4(28443, 39500, 52557, 13386, 85814) c5(A, LD, LF, oz, ig, iC, gF, bb, B, bu, cU, nl, LG, by, P, eq, oy, iA, LH, LE, LC, nG); #c1(AGAP1) c2(NP_001032208) c3(330) c4(28444, 39501, 52558, 13387, 65615) c5(cz, dA); #c1(AGAP2) c2(NP_001118244) c3(331) c4(28445, 39502, 52559, 13388, 85818) c5(A, LI, b, EM, B, w); #c1(AGAP3) c2(NP_001038000) c3(332) c4(2844, 39503, 52580, 13389, 65617) c5(dA); #c1 (AGAP4) c2(NP_597703) c3(333) c4(28447, 39504, 52581, 13390, 65618) c5(q, b); #c1(AGBL1) c2(NP_889549) c3(334) c4(28448, 39505, 52562, 13391, 65619) c5(vW, ho, LJ, LK, hT); #c1(AGBL2) c2(NP_079059) c3(335) c4(28449, 39508, 52583, 13392, 65620) c5(aC, Dg, nP, be); #c1(AGBL3) c2(NP_848858) c3(338) c4(28450, 39507, 52584, 13393, 65621) c5(HI); #c1(AGBL4) c2(XP_011540811) c3(337) c4(28451, 39508, 52585, 13394, 65622) c5(IV, aW); #c1(AGER) c2(NP_001127) c3(338) c4(28452, 39509, 52566, 13395, 65623) c5(dx, by, dM, dN, sJ, xb, bW, aK, e, op, dv, LL, LN, cl, fH, Hs, mz, aC, du, bp, x, av, fy, dS, bk, fD, bg, aA, td, vD, LM, kB, sF, bf, bw, vl, y, co, BL, ml, f, B, gg, DF, V, Bs, oy, fJ, vH, wl, ap, ck, b, bg, ey, LP, an, d, bb, q, ar, sR, jG, u, dh, o, fh, da, I, LR, gn, BZ, aZ, et, jH, LO, oh, mA, aE, gd, I, vZ, wR, bL, A, HD, IW, sv, di, eO, wf, sx, m, aX, nM, eV, si, T, cz, aM, lc, sp, aT, at, LQ, gf); #c1(AGFG1) c2(NP_001128559) c3(339) c4(26453, 39510, 52597, 13396, 65624) c5(fy, ER, b, aC, t, nO, eu, po, Bj, cf, bf, yW, nR, u, fx, y, nM);

c1(AGFG2) c2(NP_005057) c3(340) c4(26454, 39511, 52568, 13397, 65625) c5(b, hX, h, jG, J, M, P, n, iv, av, c0; #c1(AGGF1) c2(NP_050515) c3(341) c4(26455, 39512, 52569, 13398, 65626) c5(bL, LS, LT, ad, cs, Cr, Ct); #c1(AGK) c2(XP_005250080) c3(342) c4(26456, 39513, 52570, 13399, 65627) c5(jh, A, LEI b, LV, B, P, cK, oA, u, y); #c1(AGMO) c2(NP_001004320) c3(343) c4(26457, 39514, 52571, 13400, 65628) c5(sF, I); #c1(AGc2) c2(NP_001158095) c3(344) c4(26458, 39515, 52572, 13401, 65629) c5(A, b, LX, X, iU, eR, Ak, dd, iL, gE, y, co, aX, h, f, q, bu, M, B, hb, av, u, zW, ff, dj, V, fO, dB, T, iD, fx, wd, LW, LY, bm, ag, LZ, ap); #c1(AGPAT1) c2(XP_005248852) c3(345) c4(26459, 39516, 52573, 13402, 65630) c5(da, m, b, I, fN, ag, Hh, dL, aE, aW); #c1(AGPAT2) c2(NP_001012745) c3(346) c4(26460, 39517, 52574, 13403, 65631) c5(b, fr, bf, Md, cU, Ma, Mt Me, X, fv, av, aM, mt, ft, dt, Hh, iA, dL, jG, sK, Mc, fN, Kf, aA, Mb); #c1(AGPAT3) c2(XP_005724093) c3(347) c4(26461, 39518, 52575, 13404, 65632) c5(v); #c1 (AGPAT4) c2(NP_054518) c3(348) c4(26462, 39519, 52575, 13405, 65633) c5(gf); #c1(AGPAT9) c2(NP_001243350) c3(349) c4(26463, 39520, 52577, 13406, 65634) c5(yN, f, bq, aA, at, u, y); #c1(AGPS) c2(NP_003550) c3(350) c4(26464, 39521, 52578, 13407, 65635) c5(fl, gt, Mf, Mh, Mg, tF, o); #c1(AGR2) c2(NP_005399) c3(351) c4(26465, 39522, 52579, 13408, 65636) c5(Mo, A, aw, b, X, Mj, DT, BY, bn, Fr, bw, O, hP, y, MI, kJ, Mn, f, q, ar, B, av, u, V, Mi, W, T, Mm, cy, jH, Mk, ag, fP, dn, Mp, at, eG); #c1(AGR3) c2(NP_789783) c3(352) c4(26466, 39523, 52580, 13409, 65637) c5(A, X, Mq, B, q, T, fP, av, u, Mr); #c1(AGRN) c2(XP_011539733) c3(353) c4(26467, 39524, 52581, 13410, 65638) c5(Ms, dA, h, cz, xQ, Mt, o); #c1(AGRP) c2(XP_011521229) c3(354) c4(26468, 39525, 52582, 13411, 65639) c5(b, LA, jJ, rd, w, di, gE, bf, gZ, eV, LB, am, pp, mF, h, eX, Me, Mu, mz, ae, hv, cx, P, Hh, ya, Mw, aM, rQ, Mv, dY, I, rv, aA); #c1(AGT) c2(NP_000020) c3(355) c4(26469, 39525, 52583, 13412, 65640) c5(tM, gK, dM, MM, dN, dD, dB, jw, ns, eW, sJ, nm, nt, nq, nr, nn, bf, no, np, eD, e, gO, vr, Mx, bB, cy, va, kJ, vG, sW, wv, iT, dl, sM, jm, mR, tE, um, Hs, vh, cc, ha, xo, mm, zv, sH, du, gJ, jE, MD, m, by, ME, od, cV, vM, fx, hR, dL, gg, su, pq, AL, oC, MT, tR, qt, dS, fc, fN, wK, vY, tO, ag, dx, w, vK, fY, i, dc, vJ, tH, aA, bT, bV, bP, ug, wa, id, td, wo, u, X, cO, rd, wR, pX, sF, IW, MN, ft ho, eP, cM, V, ed, co, MI, sT, ml, f, vD, bu, xb, B, eH, sj, vo, av, cp, bm, MG, pW, em, GI, MH, ae, Bs, cd, gv, gF, dv, eX, bt, bq, cK, qH, qD, d, W, LID, Fz, aY, Fu, er, fw, vH, MB, gA, cf, zS, wX, re, aG, wH, sV, uy, wm, b, aF, ak, Mz, eR, MS, Hq, MC, A, jj, sU, z, ey, pl, aO, yK, Ag, xi, bb, lz, wd, wp, vf, q, MV, ap, mL, ar, sR, Km, vX, sK, mO, dh, o, fh, sz, vD, kF, I, wl, sX, Fw, LR, hv, j, by, xk, MJ, MD, uw, gE, et, Ha, cU, ao, vs, LO, fD, ch, eQ, hT, vT, aE, ih, MR, MA, I, vZ, yA, uE, bL, uk, bW, gU, iC, sv, gN, MP, xh, di, C, iL, eD, wf, sB, al, vE, sx, vl, aW, ek, oy, tn, qs, aX, or, sG, wN, qr, HY, iZ, y, nl, ev, aV, jZ, to, bc, uD, yD, xf, bd, fl, uR, My, T, MK, bh, ML, cr, cq, fz, aM, MF, ta, MU, lc, vc, El, uf, fP, Af, tT, at, eG, gf, MG, oT); #c1(AGTPBP1) c2(NP_001273544) c3(356) c4(26470, 39527, 52584, 13413, 65641) c5(cy, cV, Dg, nW, dA, MW, HS, aw); #c1(AGTR1) c2(NP_004825) c3(357) c4(26471, 39528, 52585, 13414, 65642) c5(dx, dM, dN, bx, dD, iU, vB, eH, sJ, tH, cO, vp, bu, eD, Na, gO, vr, wo, bB, cy, va, kJ, wd, wv, dl, sL, bh, mR, um, uL, ha, E, BB, Nd, sH, du, gJ, dB, by, vc, fx, hR, mO, jE, dS, fN, wK, tO, ag, vK, i, dc, bq, aA, sW, bP, wa, id, td, iF, X, vD, LM, ut, bf, vl, sN, cM, ml, f, aG, Nc, B, sj, vo, av, bm, wH, pW, em, V, Bs, cd, gv, IR, dv, eX, cK, iA, Ng, qD, LID, Fz, aY, er, fw, vH, Bc, cf, on, ap, uh, uy, wm, b, vh, eR, Hq, vY, A, sU, tG, as, MY, ey, pl, all Ne, xi, bb, MX, wp, vf, q, AK, mL, ar, Km, Nf, sK, u, dh, o, fh, sz, Nb, jj, I, sX, Fw, LR, fz, j, by, IX, lo, Be, et, uf, ao, hO, fD, eQ, rq, aE, IS, I, xf, wR, bL, uk, MZ, bW, gU, IW, BY, di, eD, wf, al, vE, jw, aW, oy, tn, qs, aX, or, sG, tL, cU, y, sV, aq, bc, tP, m, an, uo, bd, fl, W, T, MK, tk, cr, gF, aM, ta, MU, lc, Af, tT, at, eG, gf, oT); #c1(AGTR2) c2(XP_011535835) c3(358) c4(26472, 39529, 52586, 13415, 65643) c5(dx, f, iU, eH, sJ, cO, bf, gO, dv, cy, et, wv, mR, ha, lb, sH, du, bp, zU, wh, gs, vz, bk, fD, bq, aA, fl, td, Ni, y, jb, eX, bu, B, fY, bB, aY, er, vH, gR, cf, ap, Ig, b, aF, Hq, ey, bb, MX, Mt q, jV, uz, u, dh, o, kF, I, LR, Nh, wd, hU, ch, aE, ih, aG, A, a sv, di, wf, jw, oy, qs, iZ, oJ, sV, nz, ma, vF, W, P, T, MK, Ap, HL, tf, Af, Nj, at, eG); #c1(AGXT2) c2(NP_114106) c3(359) c4(26473, 39530, 52587, 13416, 65644) c5(ni, di); #c1(AGXT) c2(NP_000021) c3(360) c4(26474, 39531, 52588, 13417, 65645) c5(c, bL, dM, uy, b, aD, dD, dB, sW, xh, w, id, C, iL, bf, vl, re, jw, aO, uD, Mx, co, bb, wp, ni, ml, f, q, CO, ar, y, bK, ev, fP, u, MG, iT, MT, em, kF, I, nl, Nk, qs, bd, dt, vE, bQ, yk, eX, Nl, cy, di, et, yA, aM, dO, iK, dS, eQ, vU, DO, Nm, ih, sG, vf, MR, fD, bq, T, aA, at, gf, Nn, ap); #c1(AHCY) c2(NP_000678) c3(361) c4(26475, 39532, 52589, 13418, 65646) c5(dx, IJ, bW, b, gE, No, di, z, bf, dv, bb, Np, Em, cs, H, fh, Nr, V, cV, du, cd, ad, I, fO, x, aM, Nq, Ns, so, xf, gl); #c1(AHCYL2) c2(NP_001124192) c3(362) c4(26476, 39533, 52590, 13419, 65647) c5(T, cO); #c1 (AH11) c2(NP_001128304) c3(363) c4(26477, 39534, 52591, 13420, 65648) c5(f, gw, jz, eu, NA, C, xw, jQ, BO, jT, pw, I, ml, ak, vU, M, qj, HE, jG, hT, fs, nQ, FR, aC, Nw, nW, gm, J, Nz, rQ, Nx, Ny, cz, et, P, nR, Nv, aV, he, fG, Nt, nU, aA, Nu); #c1(AHNAK) c2(NP_076965) c3(364) c4(26478, 39535, 52592, 13421, 65649) c5(f, cy, iP, NC, dB, NB); #c1(AHR) c2(NP_001612) c3(365) c4(26479, 39536, 52593, 13422, 65650) c5(dx, by, B, pV, rB, jK, w, aw, O, cU, dv, cy, b, MR, t, nZ, eE, oP, g, JP, NM, aC, du, jE, bp, od, NN, dL, av, BX, wh, vz, fN, NE, yE, xr, pH, i, bq, jl, X, jz, NF, mk, NH, kY, bw, NL, y, NV, ed, co, ip, f, bu, NK, cs, NS, NB, fy, bm, iT, iF, V, ae, yg, NP, eX, LL, iA, jR, vH, ji, qh, An, am, wn, NU, z, ey, jh, q, ND, NJ, vu, ar, ff, jG, u, o, da, NT, Mi, ad, G, aZ, jU, jH, iR, xU, gd, I, af, A, pR, di, C, jw, hP, aW, jQ, oy, cr, fq, Nl, F, Ir, oJ, kt, NO, fU, qB, cV, be, J, GB, jo, NG, T, fO, aX, Ap, ac, jT, NG, fP, Ez, eG, gl); #c1(AHRR) c2(NP_001229341) c3(366) c4(26480, 39537, 52594, 13423, 65651) c5(cO, am, b, eG, Nl, J, bp, wn, NT, i, I, u, y, NW); #c1(AHSA1) c2(NP_036243) c3(367) c4(26481, 39538, 52595, 13424, 65652) c5(dx, en, Ob, gG, dB, Od, w, cO, bf, e, O, dv, dN, kz, cl, Hs, De, aC, du, aB, gm, bp, ft, jT, ag, cT, bk, do, aA, fO, X, LM, mk, Ni, bw, U, y, V, co, DM, f, bu, B, cs, av, fy, bm, iT, iF, rN, ae, NZ, BV, dt, Oa, yM, zS, b, aF, Of, NY, ey, gZ, d, fv, re, q, dQ, ar, jG, u, dh, o, da, I, j, ad, CZ, jU, kB, HN, xU, yA, Jh, A, k, fr, di, gE, al, jx, aX, h, F, n, aV, NX, cV, be, J, Oc, P, II, ji, by, wU, mb, fP, iB, eG, ja); #c1(AHSA2) c2(NP_689605) c3(368) c4(26482, 39539, 52596, 13425, 65653) c5(ig); #c1(AHSG) c2(NP_001613) c3(369) c4(26483, 39540, 52597, 13426, 65654) c5(dx, bL, eX, b, w, iV, Og, bf, U, Oh, y, gO, dv, bb, ae, f, q, aO, sQ, fH, mm, cp, u, dr, o, si, V, I, du, v, gL, bq, et, fJ, aM, dy, dS, bm, mA, fD, fN, Di, aA, at, eG, ap); #c1(AICDA) c2(NP_065712) c3(370) c4(26484, 39541, 52598, 13427, 65655) c5(3, bx, gG, Do, w, Du, e, O, BO, it, cy, Os, t, qU, aD, fH, pq, jS, sE, jH, aC, bK, gm, fO, BW, jT, kN, cq, pP, ie, ag, cT, Or, zr, X, jz, eu, U, y, co, pp, Ot, f, vQ, bu, xl, zQ, bm, V, Dv, Dj, BV, bt, fJ, dP, py, iV, Dm, ji, II, b, Op, eR, au, ic, jD, d, q, ar, Jm, jG, u, KL, gL, by, CM, G, pD, jU, iw, wV, BU, kh, wP, A, gw, gN, Iv, iL, gE, al, jQ, aX, il, az, hN, aV, Oq, J, P, ti, cl, On, ac, Ok, fP, bh); #c1(AIDA) c2(NP_073742) c3(371) c4(26485, 39542, 52599, 13428, 65656) c5(jV); #c1(A1F1) c2(NP_001614) c3(372) c4(26486, 39543, 52600, 13429, 65657) c5(dx, DB, b, k, Ow, aN, bg, dk, w, dV, Dy, vp, O, aK, pl, y, m, dv, LS, MX, bj, zm, aC, DC, dZ, aW, as, OA, aV, u, aE, o, fh, wK, ma, ae, an, du, kp, j, jl, Oz, HL, eJ, ou, hU, Ox, bk, fl, aA, eG, rn); #c1(AIFM1) c2(NP_001124318) c3(373) c4(26487, 39544, 52601, 13430, 65658) c5(OG, A, b, cG, OD, y, tp, co, aX, cN, DE, h, B, q, k, O, cs, jG, u, dh, fh, si, qZ, OF, bp, vS, x, bb, Ma, Y, ch, jh, aE, cb); #c1(AIFM2) c2(NP_001185625) c3(374) c4(26488, 39545, 52602, 13431, 65659) c5(X, av); #c1(AIFM3) c2(NP_001018070) c3(375) c4(26489, 39546, 52603, 13432, 65660) c5(x); #c1(AIG1) c2(NP_001273516) c3(376) c4(26490, 39547, 52604, 13433, GSM) c5(h); #c1(AIM1) c2(NP_001615) c3(377) c4(26491, 39548, 52605, 13434, 65662) c5(A, aX, cY, B, bb, aw, fh); #c1(AIM2) c2(NP_004824) c3(378) c4(26492, 39549, 52606, 13435, 65663) c5(A, b, mW, w, bW, U, OH, y, m, aX, f, B, pN, cs, u, gl, V, ae, ad, T, dP, DJ, fl, DI); #c1(AIMP1) c2(NP_001135887) c3(379) c4(26493, 39550, 52607, 13436, 65664) c5(dx, b, w, iL, OK, bj, y, oy, dv, aX, yE, vu, u, dA, aC, du, v, P, T, kJ, ag, cT, bq, rn); #c1(AIMP2) c2(NP_006294) c3(380) c4(26494, 39551, 52608, 13437, 65665) c5(dx, en, Ob, gG, dB, Od, w, cO, bf, e, O, dv, dN, kz, cl, Hs, De, aC, du, aB, gm, bp, ft, jT, jE, ag, cT, bk, i, do, aA, fO, X, LM, mk, bw, U, y, V, co, DM, f, bu, B, cs, av, fy, bm, iT, iF, rN, ae, NZ, BV, Oa, yM, zS, b, aF, Df, NY, ey, gZ, d, fv, re, q, dB, ar, jG, u, dh, o, da, I, j, ad, CZ, jU, kB, HN, xU, I, yA, Jh, A, k, fr, di, gE, al, jx, aX, h, F, n, aV, cV, be, J, Oc, P, II, ji, by, A, mb, fP, iB, eG, ja); #c1(AIP) c2(NP_003966) c3(381) c4(26495, 39552, 52609, 13438, 65666) c5(A, aw, b, DV, HC, iL, OD, aW, DE, B, DM, q, jF, Km, bm, DT, iF, OQ, cV, qq, W, DU, Ce, Jj, nV, OR, DW, DN, DP, yE, DL, DS); #c1(AIPL1) c2(NP_001028226) c3(382) c4(26496, 39553, 52610, 13439, 65667) c5(ba, OZ, cB, nQ, Pa, ml, DY, v, fC, ea, Nx, DX, Ir, nR, nW); #c1(AIRE) c2(NP_000374) c3(383) c4(26497, 39554, 52611, 13440, 650667) c5(Pp, by, pV, Pg, z, eu, aE, mk, Pf, C, PI, Pb, jw, Pm, m, Ap, aX, or, pp, yX, Pe, Pn, aC, Pj, Pc, ac, Pd, qB, kN, aq, nj, pw, Ph, wp, lb, fl, Dp, j, BV, dt, Po, jV, gn, cr, Pk, aw, iz, xD, Lz, nc, bY, no, Pi, Bx, iB, bq, at, bT, ap); #c1(AJAP1) c2(XP_011540088) c3(384) c4(26498, 39555, 52612, 13441, 650669) c5(oy, cV, Fs, bu, kC, w, ku, bf, D); #c1(AJUBA) c2(NP_116265) c3(385) c4(26499, 39556, 52613, 13442, 65670) c5(jh, D, u, V); #c1(AK1) c2(NP_00047) c3(386) c4(26500, 39557, 52614, 13443, 65671) c5(Pq, I, tx, sR, aU, at, Pr); #c1(AK3) c2(NP_0011081) c3(387) c4(26501, 39558, 52615, 13444, 65672) c5(Ps, bc, NZ, oB, qz, eN); #c1(AKG) c2(NP_001015891) c3(388) c4(26502, 39559, 52616, 13445, 65673) c5(f, rr, LR, N, M, cT, A, Pt, B, iv, ss, pv); #c1(A1(1) c2(NP_0540) c3(389) c4(26503, 390, 52617, 13446, 65674) c5(MW, Pu); #c1(AK8) c2(NP_689785) c3(390) c4(26504, 39561, 52618, 13447, 65675) c5(dB); #c1(AK9) c2(NP_65942) c3(391) c4(26505, 390, 52619, 13448, 65676) c5(v0); #c1(AKAP10) c2(NP_009133) c3(392) c4(26506, 390, 52620, 13449, 65677) c5(eX, V, f, di, fD, bq, D, u, y); #c1(AKAP12) c2(NP_005091) c3(393) c4(26507, 304, 52621, 13450, 65678) c5(A, b, D, e, d, jh, aJ, bb, kJ, h, B, q, bu, ik, n, cB, iv, jG, u, fs, V, il, by, T, et, py); #c1(AKAP13) c2(NP_001257475) c3(394) c4(26508, 39565, 52622, 13451, 65679) c5(jH, A, cy, V, b, X, eG, h, B, rr, dB, ck, ik, iv, Pv, fP, av, u, LI, y, n); #c1(AKAP17A) c2(NP_005079) c3(395) c4(26509, 39566, 52623, 13452, G50) c5(gm, b); #c1(AKAP1) c2(NP_003479) c3(396) c4(26510, 39567, 52624, 13453, 656B1) c5(A, B, do, aA, u, y, fh); #c1(AKAP2) c2(NP_001004065) c3(397) c4(26511, 39568, 52625, 13454, 650678) c5(d, ik, e); #c1(AKAP3)

c2(NP_001265238) c3(398) c4(26512, 39569, 52626, 13455, 650) c5(X, av, ck, aw); #c1(AKAP4) c2(NP_003877) c3(399) c4(26513, 39570, 52627, 13456, 65684) c5(Pw, ck, re, y, u, iT, jb); #c1(AKAP5) c2(NP_004848) c3(400) c4(26514, 39571, 52628, 13457, 65685) c5(Px, zR, oN); #c1(AKAP6) c2(NP_004265) c3(401) c4(26515, 39572, 52629, 13458, 656B6) c5(cy, dA, jJ, xj, do, IL, at); #c1(AKAP7) c2(NP_004833) c3(402) c4(26516, 39573, 52630, 13459, 656B7) c5(1V, cp, vY, cO); #c1(AKAP9) c2(NP_005742) c3(403) c4(26517, 39574, 52631, 134600, 65688) c5(Dr, nV, Pz, V, b, hV, Py, mk, y, D, u, mQ, sK); #c1(AKIP1) c2(NP_001193575) c3(404) c4(26518, 39575, 52632, 13461, 65689) c5(PA, re, u, iT, y); #c1(AKIRIN2) c2(NP_060534) c3(405) c4(26519, 39576, 52633, 13462, 65690) c5(d, A, aC, DB, q, PB, B, bm, e); #c1(AKNA) c2(NP_110394) c3(406) c4(26520, 39577, 52634, 1343, 65691) c5(re, iT, b); #c1(AKRIB10) c2(NP_064695) c3(407) c4(26521, 39578, 52635, 13464, 65692) c5(dx, Kt, b, PC, gG, wf, PE, al, LI, d, co, MI, kJ, dL, re, f, q, e, cU, ar, cs, fv, fy, u, iT, V, du, bp, ad, W, T, PD, aX, iA, et, GL, jE, py, bm, ag, jk, ji, Mp); #c1(AKRIB1) c2(NP_001619) c3(408) c4(202, 39579, 52636, 1345, 65693) c5(dx, dM, dN, DT, eH, cO, bf, PI, D, gD, dv, cy, t, PH, du, gJ, jE, x, wh, we, aA, bP, ug, PG, X, vD, dV, y, co, ml, f, PF, bu, dZ, cs, av, bm, iT, fi, GI, bd, iA, if, dP, vH, PK, ap, uh, Ig, b, ey, bb, re, gz, q, qe, u, dh, PJ, jj, I, im, ad, G, et, iw, PL, ch, aE, gd, ue, di, bL, ds, wf, jk, h, cU, hN, oJ, fD, cV, J, W, T, by, ac, aM, nk, Y, lc, at, rr); #c1(AKRIC1) c2(NP_001344) c3(409) c4(203, 39580, 52637, 13466, 65694) c5(d, co, kF, V, b, eG, hx, e, q, bp, wy, cU, bQ, PM, iA, jl, D, fy, u, av, y); #c1(AKRIC2) c2(NP_001128713) c3(410) c4(204, 39581, 52638, 13467, 65695) c5(A, b, wy, PM, PD, e, y, d, PP, PN, B, q, ar, fy, bm, kF, NW, jh, Mp, jE, py, u, i, aA, eG); #c1(AKRIC3) c2(NP_001240837) c3(411) c4(26525, 39582, 52639, 134 GB, 65696) c5(A, aw, b, k, X, jj, wy, PM, kY, D, Bz, fx, y, d, cU, bQ, jl, t, h, f, e, Kg, bu, eE, ar, B, aJ, jG, u, iT, da, em, kF, Be, PG, J, bp, vF, PS, co, T, Fr, iA, pb, PR, i, fq, I, aA, eG, re); #c1(AKRIC4) c2(NP_001809) c3(412) c4(26526, 39583, 52640, 13469, 65697) c5(A, b, aN, ak, y, rY, PN, h, B, tF, PV, n, PT, u, PU, fO, pF, MW, P, ll, bb, fx, pi, cT, i, I, bq, ci, pv); #c1(AKRID1) c2(NP_001177835) c3(413) c4(26527, 39584, 52641, 13470, 65698) c5(PW, yO); #c1(AKRIE2) c2(NP_001035267) c3(414) c4(26528, 39585, 52642, 13471, 65699) c5(bK, hl, q, PX, wy); #c1(AKR7A3) c2(XP_011539349) c3(415) c4(26529, 39586, 52643, 13472, 65700) c5(b); #c1(AKT1) c2(NP_001014431) c3(416) c4(26530, 39587, 52644, 13473, 65701) c5(dx, Qd, by, ak, aw, dN, gG, iU, HG, Ip, w, cO, bf, ps, ra, O, QA, dv, iy, kJ, e, dl, Mu, kz, mR, cl, fH, jC, Qx, oJ, Qs, mz, Ad, aC, zv, DT, du, fO, gm, QC, ft, x, PZ, fx, jT, dL, cq, ja, wh, fy, lu, dS, Ilk, Fr, jh, ag, cT, qP, i, aA, Dr, Of, iF, cY, Qg, iP, jz, kP, wy, hS, Bd, Qj, kY, bo, ot, bw, U, xw, cM, ed, co, hO, pp, yE, cK, f, Qh, cs, bu, gX, k, B, iv, Qw, oD, av, I, bm, iT, QD, d, jB, be, ca, V, yg, ze, Bs, QP, fl, jK, v, Qz, gv, IR, lh, cU, eX, bt, Qt, Qj, iA, pi, fJ, sP, xd, QV, if, iY, QG, QO, PY, in, Le, vH, Qr, og, tl, ji, iu, Qu, Qg, ck, ny, b, QB, QL, Qy, QR, A, ic, z, IT, ey, re, fT, Mr, hh, Ag, bb, QE, jd, Qe, Qi, hV, q, jV, es, X, QC, vu, ar, ff, hb, n, fv, jG, u, Qq, o, fh, In, Qb, jj, kF, jE, I, Mi, gL, ad, da, IX, Q, xq, rw, Ca, qY, et, M, Lt, yG, P, ao, nV, jR, kB, hX, iR, IS, he, dh, cX, ct, IS, QM, HV, g, di, yA, bp, cS, QQ, de, lb, Qy, IQ, iL, sD, fr, pR, gw, pD, FE, BY, pw, ds, lv, JC, gE, gF, Qa, bj, yw, iK, pF, fG, MT, Qh, LS, il, Ec, h, F, jG, cc, oE, Ir, ik, y, cB, bK, LI, QJ, aq, jN, dj, fU, si, nG, cV, Be, QK, mc, dB, J, W, qt, jo, Ql, T, ll, aX, nP, cz, fM, aM, to, qp, js, QN, Qm, Qn, Ql, j, QH, bh, at, eG, Qp, iE); #c1(AKTIS1) c2(NP_001092103) c3(417) c4(26531, 39588, 52645, 13474, 65702) c5(ma, aX, fw, es, jo, ff, bq, O); #c1(AKT2) c2(NP_001229957) c3(418) c4(26532, 39589, 52646, 13475, 65703) c5(dx, f, QF, b, em, X, QY, O, dv, QR, w, di, ak, bw, bf, ey, A, gF, y, gD, d, ed, QV, co, aX, LI, kJ, gz, e, q, yE, bu, QX, ar, B, hb, cs, Qw, av, fy, u, dh, OW, fU, kF, i, I, cV, Bs, du, gm, ad, Bg, P, bG, T, eX, x, Hh, iA, by, fM, aM, cU, jT, nV, qt, cf, in, ag, tl, ji, aA, fx, Mb); #c1(AKT3) c2(NP_001193658) c3(419) c4(26533, 39590, 52647, 13476, 65704) c5(A, Of, Ra, b, X, dB, hS, sJ, w, kY, e, y, d, qf, aX, fy, B, q, O, hb, av, aV, u, Fg, Qb, FR, jE, P, T, Gl, QZ, ao, nV, bm, cf, DO, PY, in, Qn, i); #c1(AKTIP) c2(NP_071921) c3(420) c4(26534, 39591, 52648, 13477, 65705) c5(16, X, re, ak, Rd, T, Rc, iT); #c1(ALAD) c2(NP_000022) c3(421) c4(26535, 39592, 52649, 13478, 65706) c5(A, b, RI, dB, tR, Rf, hM, wX, zf, O, jd, Rg, B, q, Rh, I, g, Pz, ao, gL, Rk, QI, Re, di, et, aH, dk, ch, OR, ih, i, Rj, OL, Ri, GJ); #c1(ALAS1) c2(NP_001291372) c3(422) c4(26536, 39593, 52650, 13479, 65707) c5(A, Rm, nY, aF, kU, IW, q, Rk, B, ch, bf, bm, AM); #c1(ALAS2) c2(NP_000023) c3(423) c4(26537, 39594, 52651, 13480, 65708) c5(Rr, Ln, Rs, z, kV, yK, Ro, kT, f, GG, nY, Rq, kX, Rn, nx, nz, yD, LG, dt, pq, gt, kU, kA, aU, Rp, CU); #c1(ALB) c2(NP_000468) c3(424) c4(26538, 39595, 52652, 13481, 65709) c5(dx, gK, by, dM, aw, lo, Rx, dD, gG, dB, vB, aN, eC, HC, sJ, en, cO, vp, yi, aK, gD, dv, Hg, Pn, dl, om, gP, RW, g, mz, RM, aC, nl, du, yD, fD, vo, aE, RY, hR, vG, pq, eH, jE, eU, fN, Rw, Ry, xb, dX, fD, do, Ft, aA, bT, rn, bP, td, fi, X, dE, eu, wy, hS, W, Ku, bf, U, y, Ei, RD, pp, ml, f, vD, bu, RA, oD, av, RR, bm, wY, fY, Ry, RJ, jB, wB, Sa, Bs, gv, vJ, Fy, eX, RH, bd, qD, RD, aH, Rz, RE, dY, Ru, RP, RN, ji, fW, ap, bn, uy, b, qz, eR, RL, at, jj, sU, z, Sb, ey, ec, Rt, bb, wd, iW, q, RV, dQ, RF, ar, u, dh, o, fh, RG, vD, kF, I, wl, RK, LR, RI, BZ, nk, rB, bc, et, px, jH, hU, RS, pS, RT, RU, hT, mA, ov, cX, ue, xX, fl, ws, C, bL, Sc, gn, di, RC, iL, gE, wf, al, aW, RX, vH, qs, aX, kn, fq, ox, oE, eN, RD, Ek, aV, jZ, iq, RZ, ma, IP, J, dt, dU, P, T, ll, gF, ad, fM, aM, Lc, Y, cH, zp, jk, bh, RB, gf, oT); #c1(ALCAM) c2(NP_001230209) c3(425) c4(26539, 39596, 52653, 13482, 65710) c5(ji, A, aw, b, X, w, iG, ct, bf, U, e, y, d, Ag, aX, B, F, bu, ik, fy, cs, fv, av, aV, u, g, og, V, il, jh, Be, ad, W, T, Qt, jC, nP, by, aM, jE, nV, bm, Af, i, Oi); #c1(ALDHIBA1) c2(NP_001138868) c3(426) c4(26540, 39597, 52E4, 13483, 65711) c5(nX, Sd, ob); #c1(ALDH18A1) c2(NP_001017423) c3(427) c4(26541, 39598, 52E5, 13484, 65712) c5(em, BX, ip, Sg, Sf, vc, ny, Se); #c1(ALDHIA1) c2(NP_000680) c3(428) c4(26542, 39599, 52656, 13485, 65713) c5(g1(Si, aw, b, X, eu, An, kY, z, bf, U, A, y, Sj, yg, MT, Sh, Si, fq, ID, f, F, q, cU, ik, B, bw, hV, av, aM, u, dh, oJ, fU, V, il, cV, J, fD, dB, co, T, GI, ar, fy, ac, Ha, wh, nV, iY, bm, Ilk, Sk, ag, Lr, Oi, aA, RB); #c1(ALDHIA2) c2(NP_001193826) c3(429) c4(26543, 39600, 52657, 13486, 65714) c5(nV, aw, mo, tW, f, K, W, FN, A, T, B, cr, oi, di, ay, Mw, et, rH, kq); #c1(ALDHIA3) c2(NP_000684) c3(430) c4(26544, 39601, 52658, 13487, 85715) c5(co, aw, b, Sn, kD, cr, bu, Sm, w, bQ, i, oi, aX, fx, u, y); #c1(ALDHIB1) c2(NP_0000) c3(431) c4(26545, 390, 52659, 13488, 65716) c5(gM, gK, at, bf); #c1(ALDHIL1) c2(NP_001257293) c3(432) c4(26546, 390, 520, 13489, 65717) c5(gK, IJ, A, b, k, HG, aD, oy, co, bb, f, fy, u, V, gm, bp, jl, Nq, Ns, i, I, aA); #c1(ALDH2) c2(NP_000681) c3(433) c4(26547, 39604, 52661, 13490, 65718) c5(dx, gK, St, aw, Gt, Hv, aE, sA, SB, GF, CP, cO, Gy, e, cp, gM, dv, cy, b, GH, GL, nZ, GG, Gp, mR, ju, mz, du, bp, GK, GI, x, hR, BX, GA, f, Su, fN, ag, mx, i, Gu, pt, aA, GC, wa, fE, iP, Sy, ob, sF, bf, bw, U, Dh, cM, co, ip, ml, ak, bu, So, Go, Bs, by, kN, bm, yJ, SA, Gr, V, zA, nu, gv, pr, Js, eX, bt, bg, cK, qH, GB, dD, nJ, oM, jP, ap, bn, uy, am, Sx, ia, z, ey, nS, fD, GE, d, jh, Sh, bb, Iz, kW, bX, q, dW, Sz, ar, vX, aM, u, dh, o, I, dT, cz, Sq, rB, Mw, uf, GM, ov, aG, I, bL, oC, A, gN, di, xa, wf, hP, yl, oy, qs, cr, iI, bj, Sr, F, Ss, ik, y, W, bR, uF, Sw, Di, gF, by, vv, Sp, nk, Y, Sv, wG, bh, at, T); #c1(ALDH3A1) c2(NP_0000) c3(434) c4(26548, 305, 52662, 13491, 65719) c5(A, aw, b, X, bm, ja, B, q, bp, cz, w, T, ji, Lr, fy, u); #c1(ALDH3A2) c2(NP_000373) c3(435) c4(26549, 390, 52663, 13492, G5720) c5(1p, SC, dw, iL, nW, f, Nx, SE, GO, do, SF, wt, KG, nU, SG, GP, SD, aW); #c1(ALDH3B1) c2(NP_0000) c3(436) c4(26550, 39607, 52664, 13493, 65721) c5(qA, f, dB, D; #c1(ALDH4A1) c2(NP_001306147) c3(437) c4(26551, 390, 520, 13494, 65722) c5(SH); #c1 (ALDH5A1) c2(NP_733936) c3(438) c4(26552, 390, 520, 13495, 65723) c5(SN, f, or, hS, GT, SI, nU, Si, xJ, dt, SK, SM, bM, SL); #c1(ALDHA1) c2(NP_005580) c3(439) c4(26553, 39610, 520, 13496, 65724) c5(sO, aA, SD, SP, at); #c1(ALDH7A1) c2(NP_001173) c3(440) c4(26554, 39611, 52668, 13497, 65725) c5(A, aw, b, LM, hS, di, a, si, co, cm, cp, co, aX, SS, kH, SD, B, bu, y, fy, u, cf, hW, nD, nW, Dt, FC, v, IR, IX, cy, J, Lt, dP, aY, SR, zM, gd, cT, I, dc, nE, qh); #c1(ALDH9A1) c2(NP_0000) c3(441) c4(26555, 39612, 520, 13498, 65726) c5(do, di, dB, cp); #c1(ALD0A) c2(NP_001230106) c3(442) c4(26556, 39613, 52670, 13499, 65727) c5(yd, CY, ma, gs, fr, ft, ST, cz, ji, Im, at, u, pq); #c1(ALDOB) c2(NP_000026) c3(443) c4(26557, 39614, 52671, 13500, 65728) c5(jH, bY, I, ch, q, bu, SU, ik, gE, bm); #c1(ALD0C) c2(NP_005156) c3(444) c4(26558, 39615, 52672, 13501, 65729) c5(SV, q, cV); #c1(ALG10B) c2(NP_001013642) c3(445) c4(26559, 39616, 52673, 13502, G5730) c5(mO, MA); #c1(ALG1D) c2(NP_116223) c3(446) c4(26560, 39617, 52674, 13503, 65731) c5(o, mO, SW, MA); #c1(ALGI1) c2(NP_001004127) c3(447) c4(26561, 39618, 52675, 13504, 65732) c5(SX, SY); #c1 (ALGI2) c2(NP_077010) c3(448) c4(26562, 39619, 52676, 13505, 65733) c5(KC, LE, SZ, Ta); #c1(ALGI3) c2(NP_001093392) c3(449) c4(26563, 39620, 52677, 13506, 65734) c5(IC, Tb); #c1(ALG1) c2(NP_061982) c3(450) c4(26564, 39621, 52678, 13507, 65735) c5(KC, jl, I, eJ, PY, Tc, eq, x, bM, fy, u, y); #c1(ALGIL) c2(NP_001015050) c3(451) c4(26565, 302, 52679, 13508, 65736) c5(jE, bm, cO); #c1(ALG2) c2(NP_149078) c3(452) c4(26566, 303, 52B80, 13509, 65737) c5(Td, xQ, aX, b); #c1(ALG3) c2(NP_001006942) c3(453) c4(26567, 304, 52681, 13510, 65738) c5(LE, Te, SY); #c1(ALG8) c2(NP_001007028) c3(454) c4(26568, 305, 52682, 13511, 65739) c5(Tf, LE, I); #c1(ALG9) c2(NP_001071158) c3(455) c4(26569, 39626, 520, 13512, G5740) c5(og, f, Tg, he, zb); #c1(ALKBH1) c2(NP_006011) c3(456) c4(26570, 307, 52684, 13513, 65741) c5(OB, i, b, bK, el, xg, mU, Th, T, bt, p, by, bf, fx, ap, iR, rn, AM); #c1(ALKBH2) c2(NP_001001655) c3(457) c4(26571, 39628, 52685, 13514, 65742) c5(iR, BY, T, fx, i); #c1(ALKBH3) c2(NP_631917) c3(458) c4(26572, 39629, 52686, 13515, 65743) c5(d, A, aw, ao, b, B, fD, ag, co, T, fy, i, ji, ar, fx, pq, iR, e, zD); #c1(ALKBH7) c2(NP_1150) c3(459) c4(26573, 39630, 52687, 13516, 65744) c5(GU); #c1(ALKBH8) c2(NP_001287939) c3(40) c4(26574, 301, 520, 13517, 65745) c5(b, BY, T, i, fx, iR); #c1(ALK) c2(NP_004295) c3(461) c4(26575, 302, 52689, 13518, 65746) 0503, aw, Gt, dB, Tw, Ty, w, bf, e, D, kJ, t, yh, cl, kX, Ab, g, og, qm, gm, bp, Tp, jT, TI, bm, ie, aV, ag, cT, Tx, X, jz, mk, bw, U, y, co, pp, Ts, f, iv, Tk, ay, fy, Tu, Ti, V, dA, Cq, Tn, ny, fJ, QG, To, jR, tl, ji, TA, hV, b, GB, zL, Tj, Tm, d, Qu, gz, q, es, ND, ar, Tr, jG, Tv, u, GM, ad, as, Tt, fH, Tz, nV, QV, af, A, gw, TB, jQ, MT, aX, Tq, gT, cB, QJ, fU, gR, cV, an, J, P, Ql, T, FF, jl, qp, js, QN, G, at); #c1(ALLC) c2(NP_060906) c3(462) c4(26576, 39633, 52690, 13519, 65747) c5(aX, P, cT, jT, vv, TC); #c1(ALMS1) c2(NP_055935) c3(463) c4(26577, 39634, 52691, 13520, 65748) c5(TE, I, ml, TD, mR, fD, bq, bf, aA, cK, aE, AM); #c1(ALOX12B) c2(NP_001130) c3(464) c4(26578, 39635, 52692, 13521, 65749) c5(d, fh, co, bb, dw, dA, TF, TG, bq, av, at, u, e, ap); #c1(ALDX12) c2(NP_000688) c3(465) c4(26579, 39639, 52693, 13522, 65750) c5(dx, A, TH, b, X, jg, dB, mk, ck, di, ic, cO, cy, U, ho, e, y, cp, d, jh, qs, dv, aX, yN, ml, ak, bu, B, av, u, o, fh, ma, V, I, cV, aC, du, by, W, T, bq, bb, ac, i, I, Di, aA, h, ap); #c1(ALOXI5B) c2(NP_001034219) c3(466) c4(26580, 39637, 52694, 13523, 65751) c5(dx, co, il, V, b, du, F, W, dv, do, A, ik, B, aJ, IW, U, jj, u, av); #c1(ALDX15) c2(NP_001131) c3(467) c4(26581, 39638, 52695, 13524, 65752) c5(dx, fh, by, A, bf, b, el X, vD, dB, aE, dv, di, ic, cO, vp, U, sx, oU, aO, cp, bb, ed, co, LS, il, fH, ml, f, N, cs, bu, tF, ik, y, iv, bw, ar, av, jb, u, dh, o, ff, du, V, I, cV, Be, sB, J, bp, be, W, bR, P, ti, T, bq, x, aX, ad, cy, jG, ac, aM, ct, hU, jg, jh, B, aC, ag, fJ, fg, bk, i, I, Di, aA, at, eG, bX, ap); #c1(ALDX5AP) c2(NP_001191335) c3(468) c4(26582, 39639, 52696, 13525, 65753) c5(dx, fl, je, tC, eO, eR, Kc, di, sU, z, bW, pl, aO, dv, bb, kJ, eX, IW, op, cy, jm, y, u, o, fh, TI, tw, du, cM, W, P, bq, LL, MF, nk, hU, dP, dS, aY, lc, TJ, fw, Af, do, Di, aA, at, ap); #c1 (ALDX5) c2(NP_000689) c3(469) c4(26583, 39640, 52697, 13526, 65754) c5(dx, B, iU, vB, eH, w, bf, O, yr, dv, cy, do, fH, TP, g, og, lb, du, gJ, fO, ft, x, jT, su, aL, gs, TO, ag, i, bq, aA, bP, gk, X, TM, Kc, IW, bw, U, Co, y, BL, ml, f, bu, cs, av, bm, yJ, V, Bs, v, cd, gv, LL, J, fJ, aH, dO, TQ, ap, ck, bW, b, aF, eR, cl, fD, aO, bb, k, q, jV, ar, ff, Dq, oil sR, jG, TL, u, dh, o, fh, I, TK, gL, ad, IX, et, jU, ao, hU, gd, I, uE, hd, bL, A, sO, fr, lk, di, iL, ell hP, oy, h, aC, ik, ma, si, be, bd, W, ti, T, j, Di, qe, DI, fP, TN, bh, aT, at, DM, oT); #c1(ALOXE3) c2(NP_001159432) c3(470) c4(26584, 39641, 52698, 13527, 65755) c5(A, dw, TF, TR, TS, av); #c1(ALP1) c2(NP_001622) c3(471) c4(26585, 39642, 52699, 13528, 65756) c5(3, b, cY, Id, wn, w, kY, z, A, y, MT, co, aX, h, f, q, M, kz, n, cs, fH, u, iT, be, LR, J, fQ, T, eq, jT, fJ, jH, jE, bm, PY, ag, oi, re); #c1(ALPK1) c2(NP_001095876) c3(472) c4(26586, 39643, 52700, 13529, 65757) c5(iw, ar, aY, fP, ik, do, ot, bf, aA, jG, cM, gO); #c1(ALPK2) c2(NP_443179) c3(473) c4(26587, 39644, 52701, 13530, 65758) c5(fy, q, b); #c1(ALPK3) c2(NP_065829) c3(474) c4(26588, 39645, 52702, 13531, 65759) c5(ml, nW, n11, TT); #c1(ALPP) c2(NP_001623) c3(475) c4(26589, 39646, 52703, 13532, 65760) c5(b, fr, wy, bo, TX, q, cs, TW, bm, TV, aC, fO, ft, P, od, rO, ad, wV, TU, lo, wP, bT); #c1(ALPPL2) c2(NP_112603) c3(476) c4(26590, 39647, 52704, 13533, 65761) c5(d, wV, bb, TY, ml, ad, oH, wP, BY, od, cs, wy, bj, nW); #c1(ALS2CL) c2(NP_001177636) c3(477) c4(26591, 39648, 52705, 13534, 65762) c5(ao, Bm); #c1(ALS2CR12) c2(NP_001120863) c3(478) c4(26592, 39649, 52706, 13535, 65763) c5(d, ik, aX, e, i); #c1(ALS2) c2(NP_001129217) c3(479) c4(26593, 39650, 52707, 13536, 65764) c5(Uc, ao, IK, xM, Ua, f, PY, DC, v, Ud, Lib, Lie, bM, OA, bN, TZ); #c1(ALX1) c2(XP_005269222) c3(480) c4(26594, 39651, 52708, 13537, 65765) c5(IJ, Ug, b, kD, X, u, Ui, y, UT AP, av, Uh); #c1(ALX4) c2(NP_068745) c3(481) c4(26595, 39652, 52709, 13538, 65766) c5(b, Un, gG, bf, U, hP, Uk, co, Uj, ar, Um, bm, zW, R, V, I, cs, qf, ad, W, P, AP, jR, cl, bq, at); #c1(ALYREF) c2(NP_005773) c3(482) c4(26596, 39653, 52710, 13539, 65767) c5(d, ao, en, eu, P, cO, e); #c1(AMACR) c2(NP_001161067) c3(483) c4(26597, 39654, 52711, 13540, 65768) c5(gK, by, A, aw, b, oa, i, wy, Uo, z, a, U, Oh, Mn, y, jx, qZ, co, B, q, bu, ar, Up, aJ, cs, Oq, u, Dx, GM, ff, Bd, V, cV, dB, gm, ad, W, jo, T, x, Fr, mY, hR, Mp, ID, sg, cH, fP, gR, I, aA, ib); #c1(AMBN) c2(NP_057603) c3(484) c4(26598, 39655, 52712, 13541, 65769) c5(kC, Ur); #c1(AMBP) c2(NP_001624) c3(485) c4(26599, 39656, 52713, 13542, 65770) c5(dx, g, A, aw, b, vq, X, dB, NA, di, II, y, dv, Tp, Uw, O, Us, Tr, av, u, yJ, Uv, dA, du, fO, dt, sV, Fo, T, oh, LH, aH, qt, Uu, iR, rw, wT, ap); #c1(AMBRA1) c2(NP_001254711) c3(486) c4(26600, 39657, 52714, 13543, 65771) c5(c, V); #c1(AMD1) c2(NP_001274143) c3(487) c4(26601, 39658, 52715, 13544, 65772) c5(IJ, f, Ir, b, UA, A, IW, Ux, y, aW, rh, ml, ak, Liz, B, u, V, nQ, dU, UB, Uy, aA, vL); #c1(AMELX) c2(NP_001133) c3(488) c4(26602, 39659, 52716, 13545, 65773) c5(cd, A, b, h, B, eu, eR, be, UC, kC, bY, ku, Ur, u, bT, y); #c1(AMELY) c2(NP_001134) c3(489) c4(26603, 39660, 52717, 13546, 65774) c5(UC, q); #c1(AMER1) c2(NP_689637) c3(490) c4(26604, 39661, 52718, 13547, 65775) c5(jB, UD, V, b, mF, h, nU, q, jo, fe, RF, ct, bw, U, QG, ff); #c1(AMER2) c2(NP_689917) c3(491) c4(26605, 39662, 52719, 13548, 65776) c5(ct, fe); #c1(AMER3) c2(NP_001098663) c3(492) c4(26606, 39663, 52720, 13549, 65777) c5(ct, U, V); #c1(AMFR) c2(NP_001135) c3(493) c4(26607, 39664, 52721, 13550, 65778) c5(cO, aX, b, f, q, bp, UE, ae, i, fs, o); #c1(AMH) c2(NP_000470) c3(494) c4(26608, 39665, 52722, 13551, 65779) c5(dx, B, bx, Ip, sJ, w, hC, bV, bf, eD, bQ, iT, PH, UP, g, fe, UQ, aC, du, UL, fx, jT, av, dH, fy, fc, bY, yE, cT, pW, i, UJ, UU, bq, aA, bT, id, X, wy, ig, yD, ix, y, f, UV, bu, UM, FG, PX, uO, ae, v, dv, bt, UH, iu, ck, b, aF, eV, HD, bb, UI, jd, re, nU, vu, qT, pY, dh, da, PJ, kF, I, UK, UG, j, by, Ca, In, jU, jH, US, u, UW, aE, yy, gd, I, gx, DU, A, UO, UX, qi, jw, m, aX, wp, Nl, UN, UF, aV, UR, ax, cV, bd, W, UT, aM, fP, PS, at, eG, gf); #c1(AMHR2) c2(NP_001158162) c3(495) c4(26609, 39666, 52723, 13552, 65780) c5(A, b, X, Tw, UX, jw, iK, bQ, UZ, re, Mt ar, y, os, UF, av, u, UP, iT, kF, wp, qq, Ca, Lu, UJ, yy, UY, PS, eG); #c1(AMICA1) c2(NP_001091996) c3(496) c4(26610, 39667, 52724, 13553, 65781) c5(M); #c1(AMIGO2) c2(NP_862830) c3(497) c4(26611, 39668, 52725, 13554, 65782) c5(ar, bj, o, JY); #c1(AMMECR1) c2(NP_001020751) c3(498) c4(26612, 39669, 52726, 13555, 65783) c5(Va); #c1(AMN) c2(NP_112205) c3(499) c4(26613, 39670, 52727, 13556, 65784) c5(aH, nb, Vb, Vc, jG, mU, J, mS, mX, bk, mT, ex, G, Vd); #c1(AMOT) c2(XP_005262147) c3(500) c4(26614, 39671, 52728, 13557, 65785) c5(b, dA, Hg, pR, w, T, o, bf, u, y); #c1(AMOTL1) c2(NP_001287936) c3(501) c4(26615, 39672, 52729, 13558, 65786) c5(u); #c1(AMPD2) c2(XP_011539550) c3(502) c4(26616, 39673, 52730, 13559, 65787) c5(dx, aF, Ve, du, v, fN, V0); #c1(AMPD3) c2(NP_000471) c3(503) c4(26617, 39674, 52731, 13560, 65788) c5(x, f, Vh, Vg); #c1(AMPH) c2(NP_001626) c3(504) c4(26618, 39675, 52732, 13561, 65789) c5(b, Vj, IV, aq, ak, VI, bu, xP, Vi, Vk, fM, oD, bp, u, y); #c1(AMT) c2(NP_000472) c3(505) c4(26619, 39676, 52733, 13562, G5790) c5(IJ, bn, iy, wm, aC, hS, jT, Vm, Vn, I); #c1(AM71) c2(XP_011513452) c3(506) c4(26620, 39677, 52734, 13563, 65791) c5(Vo); #c1(ANAPC10) c2(NP_001243638) c3(507) c4(26621, 39678, 52735, 13564, 65792) c5(V, b, X, W, av, U); #c1(ANAPC11) c2(NP_001002244) c3(508) c4(26622, 39679, 52736, 13565, 65793) c5(h, bm, jE, b); #c1(ANAPC13) c2(NP_001229304) c3(509) c4(26623, 39680, 52737, 13566, 65794) c5(xr); #c1(ANAPC1) c2(NP_073153) c3(510) c4(26624, 39681, 52738, 13567, 65795) c5(x, Vp); #c1(ANAPC2) c2(NP_037498) c3(511) c4(26625, 39682, 52739, 13568, 65796) c5(b, X, f, ar, ct, ji, av); #c1(ANAPC4) c2(NP_001273685) c3(512) c4(26626, 390, 52740, 13569, 65797) c5(aC, u, y); #c1(ANAPC5) c2(NP_001131031) c3(513) c4(26627, 39684, 52741, 13570, 65798) c5(f); #c1(ANAPC7) c2(NP_001131136) c3(514) c4(26628, 39685, 52742, 13571, 65799) c5(Be, DP, u, y); #c1(ANG) c2(NP_001091046) c3(515) c4(26629, 39686, 52743, 13572, 65800) c5(bP, jl, A, aw, b, zH, GB, Ue, Vw, dB, di, JC, Dy, U, bj, y, aX, Vx, nY, jd, h, f, q, bu, cU, Vr, ar, B, os, av, JD, u, n, fi, ma, fs, V, cV, aC, nl, sH, be, v, bp, ad, Vu, T, fD, ji, bb, Vv, jT, DA, JY, ao, Vq, bm, Fr, PY, tD, ag, cT, Vt, fD, od, Vs, es); #c1(ANGPT1) c2(NP_001137) c3(516) c4(26630, 39687, 52744, 13573, 65801) c5(dx, gK, jK, B, aw, Vz, aE, w, VD, cO, bf, xl, VC, dv, cy, n, VB, aC, VA, du, gm, bp, dB, gg, cq, fy, VG, ag, vJ, bq, aA, id, X, kB, sF, IW, bw, U, y, ed, co, pp, ml, f, os, bu, gX, O, iv, vo, av, JD, bm, iT, yJ, be, V, ae, gv, IR, eX, xd, fw, gA, VE, ji, FG, b, aF, oi, z, aO, bb, eA, re, q, vu, ar, fv, u, dh, da, il, kt, ad, IX, lo, et, g, ch, eQ, hT, xU, gd, ue, IS, di, yA, bL, A, k, pR, BY, ds, Vy, JC, gE, mc, LI, h, M, ik, oJ, ax, IP, sB, J, dU, T, fD, by, fM, aM, VF, qp, hq, bh, at, eG, gf); #c1(ANGPT2) c2(NP_001112359) c3(517) c4(26631, 390, 52745, 13574, 65802) c5(ek, gK, ml, aw, dN, gG, dB, aE, HG, eW, w, dx, cO, bf, O, vr, wo, dv, kJ, wd, VI, dl, mR, cl, GB, Hs, oP, VB, og, aC, sH, du, gm, bp, cV, fx, FG, wh, VG, a ag, cT, i, vJ, mD, aA, wa, fl, VK, X, EB, kB, kY, IW, bw, VJ, y, ed, co, ml, f, UV, bu, gX, B, os, av, fy, bm, fY, wK, sB, V, ae, Bs, n, cd, IR, eX, bq, be, xe, wX, ci, ap, uy, b, aF, A, ey, eV, aO, bb, eA, Bc, q, ar, VM, fv, u, dh, fh, da, sz, VL, by, IX, In, et, yG, VH, nV, ch, xU, ih, IS, I, wR, uk, iL, k, VN, pR, tR, di, JC, gE, wf, sx, U, qs, cr, LI, h, cc, cU, Cz, oJ, sV, Ek, jZ, fU, tp, Be, sj, mc, J, dU, P, My, T, fO, IP, ya, fM, aM, qp, hq, at, eG, gf, gl); #c1(ANGPT4) c2(NP_057069) c3(518) c4(26632, 39689, 52746, 13575, 65803) c5(bL, WE, ip, H, dB, HY, xb, w, T, oJ, ny, fM, fs, O, yG, o, LI); #c1(ANGPTL1) c2(NP_004664) c3(519) c4(26633, 39690, 52747, 13576, 65804) c5(b, H, O, pp, co, VD, ip, q, y, iv, bm, BS, fs, BT, J, bp, T, fQ, ny, bb, BX, u, fw, AX); #c1(ANGPTL2) c2(NP_036230) c3(520) c4(26634, 39691, 52748, 13577, 65805) c5(dx, A, BW, b, PC, X, sE, eu, PE, U, jD, BO, dv, dN, B, bu, fr, ay, V, ed, du, cd, BV, P, II, PD, ft, BU, ag, aA, at, ap); #c1(ANGPTL4) c2(NP_00103475 G) c3(521) c4(26635, 39692, 52749, 13578, 65806) c5(dx, fr, eX, b, PC, X, pR, dB, O, hM, lw, nT, dN, PE, U, y, tp, dv, or, fi, f, F, q, bu, RX, ar, ff, bw, ay, u, dh, yJ, em, Ad, V, I, ed, du, bd, be, T, PD, VP, PZ, gF, ft, dL, ac, yG, ao, mz, bm, xU, by, fN, bq, aA, at, af, ap); #c1(ANGPTL6) c2(NP_114123) c3(522) c4(26636, 39693, 52750, 13579, 65807) c5(aA, U, LS, V, oG); #c1(ANK1) c2(NP_000028) c3(523) c4(26637, 39694, 52751, 13580, 65808) c5(A, b, X, VY, vZ, VX, cy, VS, ay, u, o, VR, nl, rN, I, Bs, be, FC, mm, ao, VQ, tb, zT, VW, VT, VU, VV); #c1(ANK2) c2(NP_001120965) c3(524) c4(26638, 39695, 52752, 13581, 65809) c5(oy, hR, at, Bs, le, VZ, FC, VX, Wa, hS, A, vZ, HS, cV, cO, bq, dR, pP, dh, mO, ap); #c1(ANK3) c2(NP_001191332) c3(525) c4(26639, 39696, 52753, 13582, 65810) c5(f, Ey, cA, xw, Wb, ih, sG, ak, vu, cM, IV, o, to, dj, hW, bK, Wc, cz, rT, vv, dk, he, vW, Wd); #c1(ANKFN1) c2(NP_694960) c3(526) c4(2GG40, 39697, 52754, 13583, 65811) c5(Ns, aV, jN); #c1(ANKFY1) c2(NP_057460) c3(527) c4(26641, 39698, 52755, 13584, 65812) c5(fD); #c1(ANKHD1-EIF4EBP3) c2(NP_065741) c3(528) c4(26642, 39699, 52756, 13585, 65813) c5(A, fU, B, b, iv); #c1(ANKHD1) c2(NP_OG0217) c3(529) c4(26643, 39700, 52757, 13586, 65814) c5(A, b, B, J, fO, iv); #c1(ANKH) c2(NP_473368) c3(530) c4(26644, 39701, 52758, 13587, 65815) c5(VR, nl, VQ, mm, eG, be, VY, v, tb, hS, VW, VT, VU, cK, We, cp, AP, aA, VV, rN); #c1 (ANKK1) c2(NP_848 Gc5) c3(531) c4(26645, 39702, 52759, 13588, 65816) c5(GK, oC, f, Gt, tZ, GL, Hv, qa, a, kF, jw, cM, Wj, aX, ip, sG, ak, ik, Wi, bK, IV, rX, bc, hW, nl, Wf, nu, Wh, GB, GI, iN, vv, Gj, Wg, to, aY, GM, Jz, ih, jN, i, dc, aA, jP); #c1(ANKLE1) c2(NP_001265373) c3(532) c4(26646, 39703, 52760, 13589, 65817) c5(X, u); #c1(ANKLE2) c2(NP_055929) c3(533) c4(26647, 39704, 52761, 13590, 65818) c5(aC, Ti); #c1(ANKMY1) c2(NP_001269700) c3(534) c4(26648, 39705, 52762, 13591, 65819) c5(o); #c1(ANKRD10) c2(NP_001273650) c3(535) c4(26649, 39706, 52763, 13592, 65820) c5(f1); #c1(ANKRDI1) c2(NP_037407) c3(536) c4(26650, 39707, 52764, 13593, 65821) c5(rO, Wk, nU, cz, WI, cQ, u, y); #c1(ANKRDI2) c2(NP_001190985) c3(537) c4(26651, 39708, 52765, 13594, 65822) c5(bw, u, y); #c1(ANKRDI8A) c2(NP_671728) c3(538) c4(26652, 39709, 52766, 13595, 65823) c5(bp); #c1(ANKRD1) c2(NP_05520 G) c3(539) c4(26653, 39710, 52767, 13596, 65824) c5(rd b, X, xj, Wm, cO, cr, ja, f, q, mR, cl, ar, ay, bm, Bs, mc, ew, cK, sK, ao, hU, eG); #c1(ANKRD23) c2(NP_659431) c3(540) c4(26654, 39711, 52768, 13597, 65825) c5(l); #c1(ANKRD2G) c2(NP_055730) c3(541) c4(26655, 39712, 52769, 13598, 65826) c5(Wn, aA, eN, J, iv); #c1(ANKRD28) c2(NP_056014) c3(542) c4(26656, 39713, 52770, 13599, 65827) c5(h); #c1(ANKRD2) c2(NP_001123453) c3(543) c4(26657, 39714, 52771, 13600, 65828) c5(oy, ao, dB, cl, bf, Wo, AM); #c1(ANKRD30A) c2(NP_443723) c3(544) c4(26658, 39715, 52772, 13601, 65829) c5(A, b, Be, T, u, y); #c1(ANKRD3 GB) c2(NP_0794 GG) c3(545) c4(26659, 39716, 52773, 13602, 65830) c5(ck, b, eu, w, U, e, O, d, co, aX, pp, hV, q, y, fy, bm, V, T, jC, fp, nV, u, aA); #c1(ANKRD3G) c2(NP_001157787) c3(54) c4(20060, 39717, 52774, 13603, 65831) c5(Wa, dA); #c1(ANKRD37) c2(NP_859077) c3(547) c4(26661, 39718, 52775, 13604, 65832) c5(r0); #c1(ANKRD44) c2(NP_001182073) c3(548) c4(26662, 39719, 52776, 13605, 65833) c5(Eo, Wp); #c1(ANKRD45) c2(XP_011507772) c3(549) c4(26663, 39720, 52777, 13000, 65834) c5(aW); #c1(ANKRD4G) c2(NP_001257308) c3(550) c4(26664, 39721, 52778, 13607, 65835) c5(b); #c1(ANKRD50) c2(NP_001161354) c3(551) c4(26665, 39722, 52779, 13608, 65836) c5(dA); #c1(ANKRD55) c2(NP_078945) c3(552) c4(26666, 39723, 52780, 13609, 65837) c5(A, I, aC, di, NB, aV); #c1(ANKRD9) c2(NP_001229738) c3(553) c4(2667, 39724, 52781, 13610, 65838) c5(bq, fy, bb); #c1(ANKRD7) c2(NP_062618) c3(554) c4(26668, 39725, 52782, 13611, 65839) c5(Eo, bw, at, td, dA); #c1(ANKS1A) c2(NP_056060) c3(555) c4(26669, 39726, 52783, 13612, 65840) c5(m, at); #c1(ANKS1B) c2(NP_001190995) c3(556) c4(26670, 39727, 52784, 13613, 65841) c5(Ge, V, dA, t, Gf, J, ct, jV, bq, on, bf, Fg, ap); #c1(ANKS4B) c2(NP_665872) c3(557) c4(26671, 39728, 52785, 13614, 65842) c5(PE, PD, PC); #c1(ANKS6) c2(NP_775822) c3(558) c4(26672, 39729, 52786, 13615, 65843) c5(bP, Wq, vU, Nq, Ns, fD, CI, bh); #c1(ANLN) c2(NP_001271230) c3(559) c4(26673, 39730, 52787, 13616, 65844) c5(fy, co, kF, q, dA); #c1(AND10) c2(NP_001191760) c3(560) c4(26674, 39731, 52788, 13617, 65845) c5(bb, kS, Wr); #c1(AND1) c2(NP_060513) c3(561) c4(26675, 39732, 52789, 13618, 65846) c5(Wu, jl, wh, cy, LI, b, jx, F, Ws, QV, Wt, by, T, oJ, pu, fM, iK, bu, u, y, bk); #c1(AND2) c2(NP_001265525) c3(562) c4(26679, 39733, 52790, 13619, 65847) c5(wX, qC, Wv); #c1(AND3) c2(NP_113606) c3(563) c4(26677, 39734, 52791, 13620, 65848) c5(at, bA, Ww, dA, GJ, WA, bM, aA, Wy, Wz, Wx); #c1(AND4) c2(NP_001273545) c3(564) c4(26678, 39735, 52792, 13621, 65849) c5(IV, cQ, eG, dA); #c1(AND5) c2(NP_998764) c3(565) c4(26679, 39736, 52793, 13622, 65850) c5(WG, AA, WE, Rz, FR, WB, kG, Ws, Iv, WF, mR, cK, WD, oD, aT, WC, aK, xl); #c1(AND9) c2(NP_001020527) c3(566) c4(26680, 39737, 52794, 13623, 65851) c5(nl, jX, eO); #c1(AND7) c2(NP_001001666) c3(567) c4(26681, 39738, 52795, 13624, 65852) c5(A, ar, B, b); #c1(ANP32A) c2(NP_006296) c3(568) c4(26682, 39739, 52796, 13625, 65853) c5(Lc, Kx, b, Be, bm, B, q, bp, ag, A, T, u, y); #c1(ANP32B) c2(NP_006392) c3(569) c4(26683, 39740, 52797, 13626, 65854) c5(WH, b, w, U, e, O, WI, d, m, cy, fq, cs, fH, aV, V, aC, gm, fO, by, W, P, lo, vM, fJ, jU, dS, fc, cT, bq, at); #c1(ANP32D) c2(NP_036536) c3(570) c4(26684, 39741, 52798, 13627, 65855) c5(A, T, B); #c1(ANPEP) c2(NP_001141) c3(571) c4(26685, 39742, 52799, 13628, 65856) c5(bP, dx, jK, A, jT, b, fr, z, eu, ig, oR, cO, cA, bT, oU, xl, gB, dv, aX, WK, jd, t, h, hV, yh, q, jV, WO, ar, y, iv, WN, av, fy, u, dh, n, cj, Hb, pE, FK, aC, du, fO, J, gL, ad, dU, WM, T, WL, di, ft, jG, jU, pL, jE, nV, cs, bm, G, B, sh, WJ, cT, jy, fl, bM, aA, bp, ci, WP, II); #c1(ANTXR1) c2(NP_060623) c3(572) c4(26686, 39743, 52800, 13629, 65857) c5(dx, KC, nU, b, WW, fj, dv, w, Fh, bw, U, iR, A, e, aW, d, co, aX, WU, f, cs, bu, WT, wU, y, WX, av, u, qw, V, Eg, WD, nz, du, gL, ad, dU, P, X, pt, by, ss, cq, WZ, kJ, jT, WV, hT, nJ, WY, cT, fl, WR, bq, oM, WS, at, kD); #c1(ANTXR2) c2(NP_001139266) c3(573) c4(26687, 39744, 52801, 13630, 65858) c5(b, sE, jz, pD, lp, di, iL, y, cp, jT, h, bu, jQ, u, iT, Xa, nl, Eg, qC, by, dU, II, Xb, re); #c1(ANXA10) c2(NP_009124) c3(574) c4(26688, 39745, 52802, 13631, 65859) c5(by, aw, py, Xc, q, bu, W, Ce, T, cs, ar, U, ad); #c1(ANXA11) c2(NP_001265336) c3(575) c4(26689, 39746, 52803, 13632, 65860) c5(ax, X, gV, ig, sJ, av, aE, dH); #c1(ANXA13) c2(NP_001003954) c3(576) c4(26690, 39747, 52804, 13633, 65861) c5(b, A, bb, kE, ae, bw); #c1(ANXA1) c2(XP_011516910) c3(577) c4(26691, 39748, 52805, 13634, 65862) c5(gK, dB, w, hM, cQ, e, xl, iy, Xi, jq, aC, bK, gm, bp, ft, nV, Xg, fx, jT, Dx, jh, bk, i, ch, rn, Dr, GD, bw, xw, y, tp, co, B, bu, k, O, gg, yJ, fi, SA, ae, dA, Bs, NP, v, Fr, aH, py, fw, Xk, ji, Xe, aG, gz, b, Pv, Xj, vY, z, d, Ag, bb, Dx, hV, q, ar, iR, dh, o, fh, il, LR, aZ, et, jU, jH, KK, u, hT, aE, Xf, zD, A, eZ, Xd, fr, BY, Xh, di, jR, iL, oy, m, aX, I, h, gT, ik, rR, fU, cV, Fs, J, GB, P, T, Ez, AP, ii, lc, fP, Af, Di, eG, gl); #c1(ANXA2) c2(NP_001002858) c3(578) c4(26692, 39749, 52806, 13635, 65863) c5(dx, by, ml, aw, dD, dB, sJ, w, cO, vp, O, e, xl, cp, M, dv, cy, kJ, t, jM, gl, g, aC, du, Xn, bp, ft, qt, ag, qP, dX, ch, pJ, X, eu, kY, bf, bw, ai, y, co, fm, ml, f, vQ, bu, B, cs, av, fy, bm, yJ, ae, cd, fv, hd, Xe, b, ia, jL, z, d, Ag, zJ, q, jV, VM, pB, ar, u, da, bc, ad, G, iR, ex, Bm, Xm, bL, A, k, fr, pR, UA, XI, mW, iL, wf, DK, m, aX, h, F, cU, ik, n, fU, cV, J, jo, T, fO, gY, aM, MF, at, ql, eN, eG, DM); #c1(ANXA2R) c2(NP_001014301) c3(579) c4(26693, 39750, 52807, 13636, 65864) c5(A, fO); #c1(ANXA3) c2(NP_005130) c3(580) c4(26694, 39751, 52808, 13637, 65865) c5(m, A, b, X, iu, or, bu, W, aC, av, by, u, y); #c1(ANXA4) c2(NP_001307627) c3(581) c4(26695, 39752, 52809, 13638, 65866) c5(Xq, en, ID, b, gG, dB, A, Ag, co, h, q, bu, ar, Xp, av, bm, dh, ae, Xo, by, T, ya, Ht, Af); #c1(ANXA5) c2(NP_001145) c3(582) c4(26696, 39753, 52810, 13639, 65867) c5(dx, f, aw, gG, w, cO, e, O, gO, dv, t, Jl, aC, p, sH, du, gm, fO, hR, gt, pP, cT, bk, i, bg, GO, fl, X, kB, pX, kY, JE, U, y, co, fm, eX, bu, Xs, av, bm, V, Xr, P, gA, JO, fK, ji, fD, pv, b, pi, d, jh, re, q, ar, ff, u, dh, I, be, G, hO, eO, aE, I, zD, fr, iL, aX, h, F, cO, rR, ma, gV, dO, jo, T, Pk, fM, jT, gl, lc, at); #c1(ANXA6) c2(NP_001146) c3(583) c4(26697, 39754, 52811, 13640, 65868) c5(en, aw, b, mW, sJ, A, cO, Xv, e, y, d, m, iy, t, h, B, F, cy, O, VM, cs, jG, u, gl, da, I, Xu, gV, ad, G, aX, Xw, jE, bm, yC, jk, Xt); #c1(ANXA7) c2(NP_001147) c3(584) c4(26698, 39755, 52812, 13641, 65869) c5(g, 80, jE, A, V, b. Mi, B, g, bu, cT, w, ar, O, bm, O, by, u, jG, y); #c1(ANXA8) c2(NP_001035173) c3(585) c4(26699, 39756, 52813, 13642, 65870) c5(d, b, lb, h, iv, J, jV, ag, T, Xx, ar, jT, u, e); #c1(ANXA8LI) c2(NP_001092315) c3(586) c4(26700, 39757, 52814, 13643, 65871) c5(d, b, lb, h, iv, J, jV, ag, T, Xx, ar, jT, e); #c1(AOAH) c2(NP_00H70977) c3(587) c4(26701, 39758, 52815, 13644, 65872) c5(oy, fl, cy, aF, xg, di, bj); #c1(AOC1) c2(XP_011514310) c3(588) c4(26702, 39759, 52816, 13645, 65873) c5(oC, b, EE, Kc, NH, bj, y, Xy, ak, u. Eg, cy, fx, jH, rQ, dP, NG, ch, tW, i, Xz, di); #c1(AOC2) c2(NP_001149) c3(589) c4(26703, 39760, 52817, 13646, 65874) c5(bL, I, em, gd, di, bf, aM, aE, oT); #c1(AOC3) c2(NP_003725) c3(590) c4(26704, 3976I, 52818, 13647, 65875) c5(bL, bW, di, sF, z, GV, bf, aW, we, aX, 08, aE, wR, em, ma, I, be, et, aM, ch, vH, gd, IN, aA, gl, Xe, rn, oT); #c1(AOX1) c2(NP_00H50) c3(591) c4(26705, 39762, 52819, 13648, 65876) c5(em. A, XA, T, fP, cp); #c1(APIAR) c2(NP_001121898) c3(592) c4(26706, 39763, 52820, 13649, 65877) c5(fl); #c1(APIBI) c2(NP_001159491) c3(593) c4(26707, 39764, 52821, 13650, 65878) c5(jd, gE); #c1(APIG1) c2(NP_001025178) c3(594) c4(26708, 39765, 52822, 13651, 65879) c5(vQ); #c1(APIM1) c2(NP_001123996) c3(595) c4(26709, 39766, 52823, 13652, 65880) c5(bj); #c1(APIM2) c2(NP_005489) c3(596) c4(26710, 39767, 52824, 13653, 6588I) c5(Uq, dB, sS); #c1(APIS1) c2(NP_001274) c3(597) c4(26711, 39768, 52825, 13654, 65882) c5(XB, XC, nO, ep); #c1(APIS2) c2(NP_001259000) c3(598) c4(26712, 39769, 52826, 13655, 65883) c5(XE, u, nz, nO, cz, XD, vt); #c1(APIS3) c2(NP_001034658) c3(599) c4(26713, 39770, 52827, 13656, 65884) c5(mk, XF, bg); #c1(AP2AI) c2(NP_055018) c3(600) c4(26714, 39771, 52828, 13657, 65885) c5(d, aX, b, kJ, h, eE, ag, XG, T, cl, u, e, y, JY); #c1(AP2BI) c2(NP_001025177) c3(601) c4(26715, 39772, 52829, 13658, 65886) c5(aY, jd, XH, dc, gZ, cM); #c1(AP2MI) c2(NP_001020376) c3(602) c4(26716, 39773, 52830, 13659, 65887) c5(d, sS, fD, gE, QJ, e); #c1(AP2S1) c2(NP_004060) c3(603) c4(26717, 39774, 52831, 13660, 65888) c5(TU, XJ, XI, Pm, HC); #c1(AP3B1) c2(NP_001258698) c3(604) c4(26718, 39775, 52832, 13661, 65889) c5(IY, ic, eO, O, bb, pp, XQ, g, XK, XM, hN, TW, bm, fh, V, aX, P, aZ, bq, cl, dL, gg, XR, iw, Lc, XL, IZ, pS, fN, XP, XO, XN, at, ap); #c1(AP3D1) c2(NP_001248755) c3(605) c4(26719, 39776, 52833, 13662, 65890) c5(IY, bb, IZ, dA, XS, gL, XK); #c1(AP3M2) c2(NP_006794) c3(606) c4(26720, 39777, 52834, 13663, 65891) c5(hS); #c1(AP3S1) c2(NP_001275) c3(607) c4(26721, 39778, 52835, 13664, 65892) c5(l); #c1(AP3S2) c2(NP_005820) c3(608) c4(26722, 39779, 52836, 13665, 65893) c5(l, eO); #c1(AP4B1) c2(XP_011538826) c3(609) c4(26723, 39780, 52837, 13666, 65894) c5(n0, aw, b, gn, aN, Ip, hS, w, XW, e, y, d, co, XZ, f, ar, B, n, u, aE, Yb, ff, fU, XU, cV, p, Fs, j, dt, iB, T, II, XT, x, Jw, fx, jT, XY, st, Ya, ag, i, XX, XV, ci, ap); #c1(AP4E1) c2(NP_031373) c3(610) c4(26724, 39781, 52838, 13667, 65895) c5(WW, nO, pi, Yc, bN); #c1(AP4M1) c2(NP_004713) c3(611) c4(26725, 39782, 52839, 13668, 65896) c5(WW, nO, Yd, pi); #c1(AP4S1) c2(NP_001121598) C3(612) c4(26726, 39783, 52840, 13669, 65897) c5(Ye); #c1(AP5M1) c2(NP_060699) C3(613) c4(26727, 39784, 52841, 13670, 65898) c5(h, gR, iv); #c1(AP5Z1) c2(NP_055670) C3(614) c4(26728, 39785, 52842, 13671, 65899) c5(m, gw, b, k, t, Fs, Yf, bN, G, w, Fh); #c1(APAF1) c2(NP_001151) c3(615) c4(26729, 39786, 52843, 13672, 65900) c5(Yj, IJ, A, aw, b, cY, pR, dB, pD, wy, cc, w, gE, cA, U, G, O, E, co, aX, Yh, t, oB, f, IN, bu, M, X, ar, B, iv, av, fy, iR, ff, g, ma, V, cV, ft, cs, v, fO, J, W, vS, T, fx, ad, AP, jG, jT, fr, Yg, DO, jo, cT, Af, i, I, Yi, fh, h); #c1(APBA1) c2(XP_011516919) c3(616) c4(26730, 39787, 52844, 13673, 65901) c5(jH, V, W, eB, ar, fM, et, O, o); #c1(APBA2) c2(XP_006725106) c3(617) c4(26731, 39788, 52845, 13674, 65902) c5(by, rQ, b, aN, W, hS, cz, vu, T, zb, et, ar, kN, bu, aK, fM, C); #c1(APBA3) c2(NP_004877) c3(618) c4(26732, 39789, 52846, 13675, 65903) c5(do, o); #c1(APBB1) c2(NP_001244248) C3(619) c4(26733, 39790, 52847, 13676, 65904) c5(Yk, lb, Ik, v, aN, o, u, y); #c1(APBB11P) c2(XP_006717514) c3(620) c4(26734, 39791, 52848, 13677, 65905) c5(A, aX, B, eu, aW, o); #c1(APBB2) c2(NP_001159522) c3(621) c4(26735, 39792, 52849, 13678, 65906) c5(do, gk, O, aN); #c1(APBB3) c2(NP_006042) c3(622) c4(26736, 39793, 52850, 13679, 65907) c5(mz. A, bm, B, Yl, o, u, y); #c1(APC2) c2(XP_005259532) c3(623) c4(26737, 39794, 52851, 13680, 65908) c5(b, X, f, fP, et, ad, ar, cs, HE, av, ji, u); #c1(APCDD1) c2(NP_694545) c3(624) c4(26738, 39795, 52852, 13681, 65909) c5(bb, Ym, b, Dv, J, ad, pr, cs); #c1(APCDD1L) c2(NP_001291716) c3(625) c4(26739, 39796, 52853, 13682, 65910) c5(o); #c1(APC) c2(NP_001120982) c3(626) c4(26740, 39797, 52854, 13683, 65911) c5(YZ, YV, B, aw, dN, Yq, gG, dB, Zf, eH, eW, w, YB, bf, VX, fx, xl, 80, jT, iy, Zc, Yt, e, Zj, sZ, YP, R, g, fe, aC, nl, ft, YW, EC, bp, gY, Ce, od, x, YT, Yn, YY, Yp, MS, mF, YL Yw, DO, os, ag, cT, i, YA, Yx, YH, X, iP, jz, wy, ig. Ye, iG, IW, bw, U, Oh, y, YG, co, yE, pz, f, LI, bu, cs, av, fy, bm, iT, d, jB, YD, V, jh, Zg, gv, MW, YS, aR, Ys, Qt, tj, Yu, YE, IN, YU, JY, YM, W, Fz, py, jR, Le, jd, iA, gh, hV, Ze, b, aF, Qy, VP, YO, Bh, ic, Og, jC, jy, vn, YN, Mr, Zi, yK, Ag, bb, jF, Be, re, nU, q, ra, ar, ff, Yr, fv, u, aE, jj, YL, il, gL, Mi, be, ad, YK, Za, YC, et, Yy, Ut, jU, Yz, jH, YE, nV, rm, ih, Ly, dn, fl, I, Mp, rQ, af. A, fr, gw, gn, gN, BY, og, hi, C, iL, hP, yw, eh, jx, Zh, MT, aX, or, jk, cU, ik, n, cB, jQ, Xc, fU, hW, bo, Be, YR, Fs, QV, dt, T, II, Kv, Oi, Zd, cz, fM, aM, gp, jp, YQ, Zb, YX, by, zU, fP, YJ, Yv, bh, at); #c1(APCS) c2(NP_001630) c3(627) c4(26741, 39798, 52855, 13684, G5912) c5(dx, Zm, jK, en, b, WH, aF, OV, mW, aN, Zs, Jj, id, gD, iL, cO, bf, al, aK, LP, m, Zg, pp, yX, g, ap, Zn, gl, Zr, Dp, gb, du, gm, gL, J, dt, II, jT, pi, aA, aM, at, hU, pS, bm, Zk, ZI, pD, iV, en, yE, bg, al Zn, Zp); #c1(APEH) c2(NP_001631) c3(628) c4(26742, 39799, 52856, 13685, 65913) c5(jH, nV, b, cV, dB, fO, co, Zt, u); #c1(APEX1) c2(XP_005267638) c3(629) c4(26743, 39800, 52857, 13686, 65914) c5(dx, B, pV, Ob, bx, jE, Zy, dB, w, YB, aw, VX, e, O, cp, cU, dv, am, tE, fH, Zv, g, sH, du, EC, bp, ft, fx, hR, wh, M, DO, os, ag, i, bg, bT, Kt, Zx, Lg, wy, bw, U, y, tp, co, ip, wP, f, bu, JX, cs, av, fy, bm, iT, V, Bs, v, Qz, bt, iA, Lx, f J, JY, GB, OG, ji, iu, ck, b, dk, au, ic, z, bS, d, jh, bb, ZB, jd, re, g, X, se, ar, u, Vx, o, fh, Pz, ZA, il, wV, gL, ad, Sg, ZD, aZ, et, et, jH, an, nV, RU, GM, gd, Zu, I, xf, GK, A, fr, Lv, gN, di, iK, Zz, c, gs, aX, Zw, h, F, fa, az, Vr, iZ, ik, oJ, cB, gB, aV, ma, si, ZC, J, W, P, T, fO, by, XH, Sv, at, eG); #c1(APEX2) c2(NP_055296) c3(630) c4(26744, 39801, 52858, 13687, G5915) c5(aV, ag, v); #c1(APH1B) c2(NP_001139118) c3(631) c4(26745, 39802, 52859, 13688, G5916) c5(P, at, o, dS); #c1(API5) c2(NP_001136402) c3(632) c4(26746, 39803, 52860, 13689, 65917) c5(d, m, jE, b, re, q, ar, fy, bm, e, iT); #c1(APIP) c2(NP_057041) c3(633) c4(26747, 39804, 52861, 13690, 65918) c5(oy, fy, b); #c1(APLN) c2(NP_059109) c3(634) c4(26748, 39805, 52862, 13691, 65919) c5(g, bf, I, b, sH, mR, ar, bh, T, jU, cO, di, aA, at, O, aM); #c1(APLNR) c2(NP_005152) c3(635) c4(26749, 39806, 52863, 13692, 65920) c5(dx, ml, sO, cO, ZE, di, IW, bf, O, qs, dv, bb, f, mR, g, wK, I, sH, du, JT, dU, P, aM, fc, mA, we, aA, at); #c1(APLP1) c2(NP_001019978) c3(636) c4(26750, 39807, 52864, 13693, 65921) c5(qp, wB, cV, f, v, aN, Yv, aK); #c1(APLP2) c2(NP_001135748) c3(637) c4(26751, 39808, 52865, 13694, 65922) c5(qW, at, Ra, b, cV, dL, f, aN, ag, w, si, HS, Yv, fN, O, es, aK, fu, o); #c1(APOA1BP) c2(NP_658985) c3(638) c4(26752, 39809, 52866, 13695, 65923) c5(dx, du, at); #c1(APOA2) c2(NP_001634) c3(639) c4(26753, 39810, 52867, 13696, 65924) c5(dx, cG, dE, ZG, eR, eH, PM, gE, bf, ey, ZH, oy, dv, jl, eX, g, om, aM, I, du, cx, dK, Fy, ZF, gF, aA, Ha, ii, dS, eU, eT, Y, rS, i, I, bg, al at, C); #c1(APOA4) c2(NP_000473) c3(640) c4(26754, 39811, 52868, 13697, 65925) c5(dx, eX, Kt, b, dD, eR, eH, au, bf, aK, cM, gO, oy, az, dv, bb, ob, ZI, f, q, ap, dl, nm, y, u, aE, wY, fk, be, dn, I, du, cx, dK, bd, Fy, jl, et, jU, aM, jH, an, dO, gt, dS, aY, bm, Ic, ZI, vH, RT, fP, i, dc, I, bg, aA, at, gl); #c1(APOA5) c2(NP_001160070) c3(641) c4(26755, 39812, 52869, 13698, 65926) c5(dx, bL, id, wm, b, dD, gE, eR, eH, A, hM, eO, bf, eP, aO, dv, bb, bn, f, q, B, ev, bm, o, fh, em, I, du, cx, dK, ZK, eX, bq, gF, dL, aM, P, dO, aY, fN, Fy, fw, RT, gA, ZJ, ZL, fD, di, aA, at, ap); #c1(APOBEC1) c2(NP_001291495) c3(642) c4(26756, 39813, 52870, 13699, 65927) c5(dx, dD, eH, au, eE, O, hP, y, dv, g, az, cs, u, EM, sB, V, du, J, ad, W, P, T, Qt, x, by, bm, fw, aA); #c1(APOBEC2) c2(NP_006780) c3(643) c4(26757, 39814, 52871, 13700, 65928) c5(BS, pp, BT, J, bp, g, fO, iv, bm, ap); #c1(APOBEC3A_B) c2(XP_011545347) c3(644) c4(26758, 39815, 52872, 13701, 65929) c5(b, X, he, P, ZM, yA, u, y); #c1(APOBEC3B) c2(NP_001257340) c3(645) c4(26759, 39816, 52873, 13702, 65930) c5(fl, iG, b, u, X, iL, eV, y, d, aX, ip, h, hg, e, q, bu, av, fy, bm, jZ, iT, ae, J, by, P, jT, jE, ag, ag, i, ji); #c1(APOBEC3C) c2(NP_055323) c3(646) c4(26710, 39817, 52874, 13703, G5931) c5(P, he, gL, J); #c1(APOBEC3F) c2(NP_001006667) c3(647) c4(26761, 39818, 52875, 13704, 65932) c5(Kt, J, gL, P, di, iL); #c1(APOBEC36) c2(NP_068594) c3(648) c4(26762, 39819, 52876, 13705, 65933) c5(P, jE, jD, Kt, vQ, h, hg, q, gL, J, hG, II, iL, U, jT, bm, jZ, V); #c1(APOBEC3H) c2(NP_001159474) c3(649) c4(26713, 39820, 52877, 13706, 65934) c5(P, gL); #c1(APOB) c2(NP_000375) c3(650) c4(26764, 39821, 52878, 13707, 65935) c5(dx, f, BF, dD, aN, eH, xb, tH, bf, aK, dv, b, t, dI, nm, ZV, ZO, EM, mz, aag, bm, aC, p, nW, ZY, is, qt, hR, dL, kl, su, gs, aai, dS, eU, Ic, os, tO, Wp, aah, dX, i, eT, hM, aA, G J, ZT, ug, id, dE, ZG, ig, ix, ZM, et, II, y, un, ak, bu, aaj, mm, pP, DU, V, gv, Fy, eX, hg, IL, dO, aac, aY, fS, fw, vH, dF, ap, wm, am, fN, sH, ia, eR, wn, vY, au, cK, aah, fD, aO, bb, Iz, ZR, sO, g, dW, HL, u, dh, o, fh, da, vD, I, fz, dK, ZS, aaa, aae, et, Ha, an, RT, ch, aad, vT, aaf, vP, ZL, th, I, bL, gU, ka, ZP, gE, ZW, ZX, jc, NT, di, iL, eO, al, aW, oy, gs, jl, az, Dd, ev, ZO, tK, fk, du, bd, gV, dt, P, T, gL, gF, ac, aM, ii, ZN, Ic, fP, IN, bh, at, ZQ, oT); #c1(APOBR) c2(NP_061160) c3(651) c4(26715, 39822, 52879, 13708, 65936) c5(dx, dv, cy, dO, du, aA); #c1(APOC1) c2(NP_001636) c3(652) c4(26766, 39823, 52880, 13709, 65937) c5(dx, jK, gk, lr, bS, aF, dB, eH, au, di, gE, bw, ua, ZH, kJ, fg, eX, az, nm, ff, aV, aE, o, aak, aal, I, gL, el, du, gL, gF, dL, fN, ag, fl, ZL, aA, at, ap); #c1(APOC2) c2(NP_000474) c3(653) c4(26767, 39824, 52881, 13710, 65938) c5(aan, dx, eX, wm, b, X, eR, eH, bn, gE, O, aae, aap, tF, f, q, nm, ar, av, aV, bm, rX, o, mz, aam, I, el, du, aag, dK, dt, dv, ji, et, gt, ZJ, aah, ZL, mD, at, ZT, ap); #c1(APOC3) c2(NP_000031) c3(654) c4(26768, 39825, 52882, 13711, 65939) c5(dx, bL, gE, wm, b, dD, z, ZG, eR, eH, MG, au, hM, iL, aau, bf, al, ey, ZH, oy, az, o, bb, ob, GW, ml, eX, q, dl, aW, et, aM, u, dh, aar, ZL, aE, Tl,
jB, V, I, sH, du, cx, dK, Fy, dv, bp, eg, hg, Hh, eg, hR, dL, Ha, tS, an, dO, ii, bm, Ic, P, tO, aas, aat, fD, fN, di, aA, at, dF, y, ap); #c1(APOC4) c2(NP_001637) c3(655) c4(26719, 39826, 52883, 13712, 65940) c5(l, fN, bm, eX, q, om, gE, at, dL, ap); #c1(APOD) c2(NP_001638) c3(656) c4(26770, 39827, 52884, 13713, 65941) c5(gk, b, fr, aav, HG, O, dk, A, cO, U, bj, y, bb, Si, PA, q, B, hZ, aV, u, rX, o, hW, V, I, cV, bK, v, VL, ft, W, T, gF, dL, Ot, tm, f, fN, HN, xJ, qP, PS, aA, at); #c1(APOE) c2(NP_001289617) c3(657) c4(26771, 39828, 52885, 13714, 65942) c5(aba, abC, dD, dB, abd, Ip, hM, aaV, ua, cp, jD, acL, nv, dl, kz, mR, wY, xl, abi, mz, aag, aC, abk, cs, ee, aax, IH, Wp, acG, aL, abv, eU, abn, tO, acw, xr, aaS, abl, fD, acM, hg, aA, cd, ug, X, vD, abY, ZG, ul, dV, acr, bw, acf, ho, abH, cM, uV, sr, Dg, ak, e, av, acF, is, wK, V, ae, kp, Fy, J, f J, xd, acd, aY, abs, ji, abw, vL, Zo, bn, acA, abn, vY, qa, Pn, abg, pi, Ag, acn, HW, tg, Km, DY, dh, da, sX, be, gL, ad, xk, aaB, Ql, abz, aaK, uf, an, RT, vT, eo, th, aaT, aeg, uE, gD, eZ, vd, ka, acH, gn, vZ, iL, gE, m, xT, cr, or, wG, abh, p, ev, te, dj, abU, an, bd, My, acx, Ic, abJ, ME, abN, aal, fP, aaC, aaX, tM, dM, BF, tC, abF, wj, bf, eP, aK, at, rh, aca, Oz, jm, PV, oN, nl, du, yO, gm, bp, MO, eR, cV, x, Ew, gt, dS, fc, mE, ZT, bP, Zm, fl, bS, aaL, He, dE, rd, pX, ix, abL, Ra, cA, Iw, O, co, f, bu, tv, aaZ, ky, aah, xE, gv, wt, Hh, nb, hr, abE, abt, abZ, Ig, GC, aaO, yc, aaG, z, abp, d, bb, g, dW, sR, ff, HL, rX, o, fh, kF, ob, kt, dK, Rg, abG, ch, na, aaM, Ol, HV, sF, lb, MZ, gU, ZP, Ik, abr, HS, eO, al, aW, Oh, aci, Ed, abP, ag, hW, ez, nQ, sj, sC, dt, II, by, tf, DG, acB, aeg, vW, eB, Oi, iB, hM, dx, KS, abu, aw, dN, aaY, abm, tX, wd, abR, aaU, acD, abl, kX, aay, g, jH, bK, hR, eH, aaz, acl, cT, xb, dX, eT, eX, aaA, nX, Dv, hW, ai, a aw, ZH, dg, abM, ml, B, k, aaR, oD, OA, pP, Gr, fl, v, cx, Js, xF, hw, dO, ack, cf, acj, fw, vH, abD, on, abB, ach, acV, b, aF, AA, au, abx, vf, NJ, abb. Sc, Wy, FD, KL, xs, Mw, et, ZO, PL, hU, aaN, hT, HN, fu, abO, vP, ZL, acb, Gn, acE, ds, wf, qs, abe, sG, fa, Aq, tF, iZ, Ld, abQ, GS, W, acl, jl, aM, eJ, Y, abc, acK, abX, abf, aas, ap, eG, Gl, IK, Gm, aN, eC, w, cO, abj, gO, ace, dv, cy, qc, eQ, Zl, sO, tE, ju, acy, Oy, Ox, sH, gJ, Ij, tz, aaD, jT, eN, bg, abS, nh, acz, fN, acs, os, i, ace, gk, td, Kt, hS, fH, IW, xw, abK, y, ed, ip, un, acu, vQ, aaF, mm, bm, em, jB, fz, abT, dc, Xr, acc, pi, aaa, abW, er, fL, bT, gA, fK, aaW, nO, wm, Dm, Ey, id, yO, sO, abg, ey, gZ, eV, aO, yK, Fp, Iz, bX, aaE, ar, HE, u, wR, aaQ, I, el, acv, hv, acC, ZS, dZ, Nh, acJ, Wz, yG, aaJ, tW, Bu, he, aE, ih, ue, HT, xX, I, bL, A, acm, aaP, UA, a By, et, di, act, bj, oy, aX, ty, xJ, op, gr, az, Vr, a V, aaH, si, abA, hZ, xf, P, j, aj, gF, cz, ac, acp, wL, IN, bh, al oT); #c1(APOF) c2(NP_001629) c3(658) c4(26772, 39829, 52886, 13715, 65943) c5(dD, vQ, eH, aW, at, o); #c1(APOH) c2(NP_000033) c3(659) c4(26773, 39830, 52887, 13716, 65944) c5(dx, bL, eX, kE, dN, gn, mW, vY, ix, di, fw, YT, bf, m, jl, dv, aX, fm, f, g, jV, acO, kX, bm, gl, du, Ej, gL, eR, bg, tj, bb, Pk, aM, jH, acN, Ht, cT, fD, bh, eN, ap); #c1(APOL1) c2(NP_001130013) c3(660) c4(26774, 39831, 52888, 13717, 65945) c5(bP, dx, dM, wm, b, yu, dB, fl, di, bf, ey, gO, m, qs, dv, GW, wd, Ee, te, I, Nc, du, bd, dK, Yl, P, II, et, aM, gt, acQ, acP, fD, at, ap); #c1(APOL2) c2(NP_GG3612) c3(611) c4(26775, 39832, 52889, 13718, 65946) c5(acT, acS, dd, jN, acR); #c1(APOL3) c2(NP_663615) c3(662) c4(26776, 39833, 52890, 13719, 65947) c5(A, B, b); #c1(APOL4) c2(NP_085146) c3(663) c4(26777, 39834, 52891, 13720, 65948) c5(oy, fD); #c1(APOL6) c2(NP_085144) c3(664) c4(26778, 39835, 52892, 13721, 65949) c5(en, ap); #c1(APOLD1) c2(NP_001123887) c3(665) c4(26779, 39836, 52893, 13722, 65950) c5(ar); #c1(APOM) c2(NP_001243098) c3(666) c4(26780, 39837, 52894, 13723, 65951) c5(dx, ma, I, vQ, aC, du, q, gL, ap, dv, o, ji, bf, ey, at, aE, aO, aM); #c1(APOO) c2(NP_077027) c3(667)

c4(26781, 39838, 52895, 13724, 65952) c5(cK, aA, o, Eg); #c1(APOPT1) c2(NP_115750) c3(668) c4(26782, 39839, 52896, 13725, 65953) c5(acU, kW); #c1(APPBP2) c2(NP_006371) c3(669) c4(26783, 39840, 52897, 13726, 65954) c5(A, IO, di, cO, u, y); #c1(APP) c2(NP_000475) c3(670) c4(26784, 39841, 52898, 13727, 65955) c5(dx, by, f, Nh, aN, IH, w, hM, bV, bf, aK, bQ, iy, am, oN, mz, bJ, aC, bK, du, ade, bN, ee, aax, Ce, ada, x, ca, aL, Vb, bY, aaS, GF, aA, aaA, bP, gk, bS, He, wy, bW, ai, xw, bF, bG, y, bC, DG, adc, ak, bu, xb, oD, OA, bm, adf, v, cd, dv, eX, bB, nh, fL, PY, bT, add, bH, acX, ap, bA, kE, b, aF, Dm, bg, wn, bb, eZ, bX, q, acV, u, aE, o, da, bU, acW, gL, cz, ew, sD, jU, an, KK, hT, he, ee, ih, fl, bL, bE, acZ, EE, di, HS, bZ, bj, aW, aX, eB, h, xJ, tF, eg, ag, cV, hZ, J, bR, P, T, Pk, aM, Lc, ii, hi, acY, adb, aal, bM, al at); #c1(APPL1) c2(NP_036228) c3(671) c4(26785, 39842, 52899, 13728, 65956) c5(dx, dv, dN, I, X, fN, du, MP, aA, bf, av, dL, ey, aM); #c1(APPL2) c2(NP_001238833) c3(672) c4(26786, 39843, 52900, 13729, 65957) c5(gW, fl, fN, w. A, IV, dL, O); #c1(APRT) c2(NP_000476) c3(673) c4(26787, 39844, 52901, 13730, 65958) c5(dx, by, B, adn, dN, EM, dB, HC, w, adt, cO, bf, adr, O, gO, dv, cy, qc, t, ju, jC, xc, ado, lb, du, gJ, gm, ft, Kh, KK, od, jT, dL, av, EZ, ads, fN, HR, ag, cT, bk, dc, aA, jl, bP, PG, Kt, adm, iF, X, iP, jz, mk, adp, IW, cA, U, cM, co, sT, pp, cK, f, bu, cs, MR, mm, fy, bm, iT, zO, em, V, la, eX, eg, Hh, W, dy, aY, cf, fw, ji, b, MS, oi, wC, Er, ey, jh, bb, kW, adv, re, hV, q, jV, mL, DZ, ar, aM, u, aE, adj, da, kE, I, Dg, Fb, ad, G, HE, Lt, an, nV, ch, ih, gd, ue, adg, o, Sd, adg. A, fr, iL, gE, iy, BM, adk, fg, M, y, cB, ady, jQ, jZ, cV, adh, J, dt, adx, ll, adw, aX, nP, cz, sK, adu, adi, fP, kA, OA, adl, at); #c1(APTX) c2(NP_001182177) c3(674) c4(26788, 39845, 52902, 13731, 65959) c5(A, aw, dD, adB, w, KQ, bw, kV, kW, adD, h, f, sL, EW, adE, KV, DU, GS, bK, adC, v, SE, Lk, KX, kS, ac, eg, adA, Y, adz, cH, qP, EX, bM, EV); #c1(AQPI0) c2(NP_536354) c3(675) c4(26789, 39846, 52903, 13732, 65960) c5(bb, ap, bg, at, o, fh); #c1(AQP1) c2(NP_001171989) c3(676) c4(26790, 39847, 52904, 13733, 65961) c5(dx, da, adG, rb, b, zH, X, adH, yz, vB, bg, hS, w, di, dV, O, bf, U, A, e, xl, d, Ag, co, aX, jd, adl, f, qr, cU, dZ, ar, y, cs, adL, kX, iP, fy, u, o, g, aaQ, vR, Ex, RX, aC, gG, k, du, dB, Qz, gv, adK, dv, l bh, iA, ad, et, eJ, Rz, ii, dk, ch, mE, B, ej, cT, oi, Af, adJ, adF, vt, gf, rn); #c1(AQP2) c2(NP_000477) c3(677) c4(26791, 39848, 52905, 13734, 65962) c5(HD, yz, di, cO, adR, nU, adO, cU, adQ, adP, fY, em, Ex, I, sH, adM, cK, et, ch, RE, tO, na, adN, fD, bh, eG); #c1(AQP3) c2(NP_004916) c3(678) c4(26792, 39849, 52906, 13735, 65963) c5(hV, pV, b, X, LM, mk, A, hM, ic, nT, vI, adr, ey, y, d, tp, aX, ae, fq, f, e, bu, ik, B, qB, ar, pq, u, fY, fh, SA, fU, Fx, adS, yz, T, Bg, bt, fy, nP, by, yA, JY, jH, nV, Ht, cX, adN, i, ji, aA, rb); #c1(AQP4) c2(NP_001641) c3(679) c4(26793, 39850, 52907, 13736, 65964) c5(Dr, mZ, WE, hV, tu, Ob, k, adX, adW, eu, mE, bg, hS, adZ, w, id, di, wf, adY, adT, aK, xl, c, Fp, bb, oj, sG, ml, f, sR, adI, iZ, ky, O, hZ, IL, bf, adV, aV, aq, dh, fh, g, aaQ, ma, kG, VD, bK, sB, Fx, Qz, cz, ME, aea, adU, ar, fy, pw, nP, HG, hw, Bi, eJ, ao, nV, Rz, dk, ch, ach, er, IJ, HM, jd, iu, iB, adF, vt, bT, rn); #c1(AQP5) c2(NP_001642) c3(680) c4(26794, 39851, 52908, 13737, 65965) c5(b, X, aF, U, ba, e, y, d, jh, co, js, jd, f, wN, aeb, cs, av, fy, u, fh, V, ad, jG, aec, mE, cX, I, at, rb); #c1(AQPG) c2(NP_001643) c3(681) c4(26795, 39852, 52909, 13738, 65966) c5(qu, rV, aed, Qz); #c1(AQP7) c2(NP_001161) c3(682) c4(26796, 39853, 52910, 13739, 65967) c5(g, gK, bQ, aX, I, mz, KA, nG, jV, rd, w, di, aee, ey, aA, O); #c1(AQP8) c2(NP_001160) c3(683) c4(26797, 39854, 52911, 13740, 65968) c5(jH, bQ, kF, re, vR, fh); #c1(AQP9) c2(NP_066190) c3(684) c4(26798, 39855, 52912, 13741, 65969) c5(q, w, kF, ey, O, co, aX, h, aef, jV, M, aee, jG, bm, g, mz, vR, Pz, I, J, vF, bQ, er, ie, nG, HM, aA); #c1(ARAF) c2(NP_001243126) c3(685) c4(26799, 39856, 52913, 13742, 65970) c5(aX, b, Pa, q, cz, QE, ar, ji, u, Lt); #c1(ARAPI) c2(NP_001035207) c3(686) c4(26800, 39857, 52914, 13743, 65971) c5(aC, u, l, y); #c1(ARAP3) c2(NP_071926) c3(687) c4(26801, 39858, 52915, 13744, 65972) c5(by, at, P, b, Eg); #c1(ARC) c2(NP_056008) c3(688) c4(26802, 39859, 52916, 13745, 65973) c5(dB, dd, U, hF, f, mR, ff, cs, o, gD, V, aeh, aC, ad, jo, aX, xM, aeg, P, tl, bg, aT, at); #c1(ARCN1) c2(NP_001135753) c3(689) c4(26803, 39860, 52917, 13746, 65974) c5(dx, en, aw, b, TQ, aem, IW, ael, dv, di, cO, gZ, cM, aek, co, cy, aej, gd, et, f, dQ, O, bl, gg, cc, Yk, JP, aP, du, po, DT, IR, IX, ti, aZ, bi, pi, iU, at, zE, dP, aei, Ob, aY, lS, bk, dn, dc, I, ap, oT); #c1(AREG) c2(NP_001648) c3(690) c4(26804, 39861, 52918, 13747, 65975) c5(Dr, jp, by, A, aZ, b, zH, X, kN, mk, w, U, hP, e, y, d, Ag, bQ, cy, pp, nY, B, F, q, vQ, bu, gX, ar, O, cs, fM, fP, av, fy, u, da, fe, V, Be, jU, bp, gv, W, as, P, ti, T, fO, bt, ji, Fr, ad, gg, qe, aen, jE, Lc, ip, bm, kJ, xe, ag, TQ, Af, aC, bh, yA, at, eG); #c1(ARF1) c2(NP_001019398) c3(691) c4(26805, 39862, 52919, 13748, 65976) c5(b, P, bu, gA, o, rB, gE, by, u, y); #c1(ARF3) c2(NP_001650) c3(692) c4(26806, 39863, 52920, 13749, 65977) c5(b, cV, el, f, wy, u, y, aeo); #c1(ARF4) c2(NP_001651) c3(693) c4(26807, 39864, 52921, 13750, 65978) c5(w, f, u, y, b); #c1(ARF6) c2(NP_001654) c3(694) c4(26808, 39865, 52922, 13751, 65979) c5(P, BO, V, aX, aeq, b, pS, bm, q, eZ, gA, O, u, dh, y, aep); #c1(ARFGAP1) c2(NP_001268411) c3(695) c4(26809, 39866, 52923, 13752, 65980) c5(bK, V); #c1 (ARFGAP2) c2(NP_001229761) c3(696) c4(26810, 39867, 52924, 13753, 65981) c5(bu); #c1(ARFGAP3) c2(NP_001135765) c3(697) c4(26811, 39868, 52925, 13754, 65982) c5(A, V, B); #c1(ARFGEF1) c2(NP_006412) c3(698) c4(26812, 39869, 52926, 13755, 65983) c5(fl, cy, b, aer, u, y, aes); #c1(ARFGEF2) c2(NP_006411) c3(699) c4(26813, 39870, 52927, 13756, 65984) c5(aev, fl, ak, aet, QZ, rw, aeu, fR, dI, aew); #c1(ARFGEF3) c2(NP_065073) c3(700) c4(26814, 39871, 52928, 13757, 65985) c5(u, y); #c1(ARFIP1) c2(NP_001020766) c3(701) c4(26815, 39872, 52929, 13758, 65986) c5(p, fs); #c1(ARFRP1) c2(NP_001128230) c3(702) c4(26816, 39873, 52930, 13759, 65987) c5(BS, f, pp, BT, q, fO, J, iv, bm); #c1 (ARG1) c2(NP_000036) c3(703) c4(26817, 39874, 52931, 13760, 65988) c5(dx, gK, A, gE, b, IW, dB, gN, adJ, di, z, gG, cy, gB, dv, LL, dN, DM, B, q, bu, ik, fy, VM, aD, oD, gg, du, dh, NO, da, em, jB, ma, iI, aC, LR, aez, Fk, aX, ge, aH, at, ch, aey, bY, DI, aex, aeA, sc, bq, aA, aG, rn, ap); #c1(ARGLU1) c2(NP_060481) c3(704) c4(2681B, 39875, 52932, 13761, 65989) c5(aY, bf, u, y); #c1(ARHGAP10) c2(NP_078881) c3(705) c4(26819, 39876, 52933, 13762, 65990) c5(oy, u, y, Fg); #c1(ARHGAP11A) c2(NP_001273408) c3(706) c4(26820, 39877, 52934, 13763, 65991) c5(aA, f, fl, b, ad); #c1(ARHGAP11B) c2(NP_001034930) c3(707) c4(26821, 39878, 52935, 13764, 65992) c5(bb); #c1(ARHGAP15) c2(NP_060930) c3(708) c4(26822, 39879, 52936, 13765, 65993) c5(f, cO); #c1(ARHGAP18) c2(NP_277050) c3(709) c4(26823, 39880, 52937, 13766, 65994) c5(ao, LK, yX, f, i, fx, o); #c1(ARHGAP1) c2(XP_011518397) c3(710) c4(26824, 39881, 52938, 13767, 65995) c5(jE, f, b, ag, bm, nz, nU, q, yz, Lm, A, di, B, ji, u, y); #c1(ARHGAP20) c2(NP_001245344) c3(711) c4(26825, 39882, 52939, 13768, 65996) c5(cT); #c1(ARHGAP21) c2(XP_005252599) c3(712) c4(26826, 39883, 52940, 13769, 65997) c5(w, u, y); #c1(ARHGAP22) c2(NP_001242953) c3(713) c4(26827, 39884, 52941, 13770, 65998) c5(oy, fl, GF, wf, bf, aM); #c1(ARHGAP23) c2(NP_001186346) c3(714) c4(26828, 39885, 52942, 13771, 65999) c5(kF); #c1(ARHGAP24) c2(NP_112595) c3(715) c4(26829, 39886, 52943, 13772, 66000) c5(dx, B, aw, aeB, gG, dB, HG, w, adr, e, O, M, dv, t, bx, ji, et, Fg, g, iv, gm, fO, ft, fx, jT, fp, pb, fc, ie, ag, cT, i, pt, Mq, X, jf, aeD, U, y, yV, co, f, bu, cs, av, fy, bm, iT, is, V, gv, iA, JY, GQ, dP, jR, qO, oM, ci, b, bL, jq, d, jh, jd, re, hV, q, jV, jF, ar, ff, hb, jG, u, o, il, ad, G, aeC, wd, nV, hX, cX, KC, A, k, fr, jc, iL, gE, hP, MT, aX, qn, F, cU, ik, n, cB, aV, te, HI, du, cV, YR, Fs, J, W, jo, T, Oi, jI, by, bh, h, rb); #c1(ARHGAP25) c2(NP_001007232) c3(716) c4(26830, 39887, 52944, 13773, 66001) c5(Fg); #c1(ARHGAP26) c2(NP_001129080) c3(717) c4(26831, 39888, 52945, 13774, 66002) c5(b, l, cV, h, nU, jL, J, M, pJ, jG, ci, n); #c1(ARHGAP27) c2(NP_777579) c3(718) c4(26832, 39889, 52946, 13775, 66003) c5(av); #c1(ARHGAP28) c2(NP_001010000) c3(719) c4(26833, 39890, 52947, 13776, 66004) c5(at, eG); #c1(ARHGAP30) c2(NP_001020769) c3(720) c4(26834, 39891, 52948, 13777, 66005) c5(kF); #c1(ARHGAP31) c2(NP_065805) c3(721) c4(26835, 39892, 52949, 13778, 66006) c5(aeE, ig, at, u, y); #c1(ARHGAP32) C2(NP_001136157) c3(722) c4(26836, 39893, 52950, 13779, 66007) c5(f); #c1(ARHGAP35) c2(NP_004482) c3(723) c4(26837, 39894, 52951, 13780, 66008) c5(aX, V, be, Fs, T, U, O); #c1 (ARHGAP42) c2(NP_689645) c3(724) c4(26838, 39895, 52952, 13781, 66009) c5(oy, at, di); #c1(ARHGAP4) c2(NP_001158213) c3(725) c4(26839, 39896, 52953, 13782, 66010) c5(P, adM, at, yz); #c1(ARHGAP5) c2(NP_001164) c3(726) c4(26840, 39897, 52954, 13783, 66011) c5(co, q, bp); #c1(ARHGAP6) c2(NP_001274171) c3(727) c4(26841, 39898, 52955, 13784, 66012) c5(aeF, Ur, di); #c1(ARHGAP9) c2(NP_001073625) c3(728) c4(26842, 39899, 52956, 13785, 66013) c5(aeG, mQ, IK, dN); #c1 (ARHGDIA) c2(NP_001288171) c3(729) c4(26843, 39900, 52957, 13786, 66014) c5(jH, aw, Fs, bd, aeJ, P, w, T, y, di, aeI, u, aeH); #c1(ARHGDIB) c2(XP_011518968) c3(730) c4(26844, 39901, 52958, 13787, 66015) c5(A, b, bu, P, fx, i, I, fH, aeI, by, U, fJ); #c1(ARHGEF10) c2(NP_055444) c3(731) c4(26845, 39902, 52959, 13788, 66016) c5(aeK, Fg, aeL, cG); #c1(ARHGEF10L) c2(XP_011539993) c3(732) c4(26846, 39903, 52960, 13789, 66017) c5(d, aX, ic, aeM, e); #c1(ARHGEF11) c2(NP_055599) c3(733) c4(26847, 39904, 52961, 13790, 66018) c5(mz, co, b, l, u, bp, sF, gF, et); #c1(ARHGEF12) c2(NP_001185594) c3(734) c4(26848, 39905, 52962, 13791, 66019) c5(d, A, V, I, h, B, J, eX, U, u, e, y); #c1(ARHGEF15) c2(NP_776089) c3(735) c4(26849, 39906, 52963, 13792, 66020) c5(hS); #c1(ARHGEF16) c2(XP_011539555) c3(736) c4(26850, 39907, 52964, 13793, 66021) c5(Fs); #c1(ARHGEF17) c2(NP_055601) c3(737) c4(26851, 39908, 52965, 13794, 66022) c5(cs, aX, ad); #c1(ARHGEF1) c2(NP_945328) c3(738) c4(26852, 39909, 52966, 13795, 66023) c5(aeO, QN, b, h, f, aeN, J, ar, cB, jG, u, y); #c1(ARHGEF25) c2(NP_001104740) c3(739) c4(26853, 39910, 52967, 13796, 66024) c5(BO, aeP, di, cl, u, y); #c1(ARHGEF26) c2(NP_001238892) c3(740) c4(26854, 39911, 52968, 13797, 66025) c5(dx, dv, du, w, B, A, O); #c1(ARHGEF28) c2(NP_001073948) c3(741) c4(26855, 39912, 52969, 13798, 66026) c5(oy, d, ao, co, cy, jH, kS, du, PY, q, m, dv, di, Bm, dx, cO, bq, OA, pi, B, jU); #c1(ARHGEF2) c2(NP_001155855) c3(742) c4(26856, 39913, 52970, 13799, 66027) c5(f, JH, b, cG, aE, hS, m, A, O, bw, U, y, aeQ, co, aX, yQ, fq, h, nU, q, dQ, cM, aD, ar, aV, u, aeS, da, V, ae, cV, aC, nW, J, ct, cz, dt, P, zi, HE, cy, aeT, fc, B, aeR, gd, gA, fP, la, aeu); #c1(ARHGEF38) c2(NP_001229658) c3(743) c4(26857, 39914, 52971, 13800, 66028) c5(l, di); #c1(ARHGEF3) c2(NP_001122087) c3(744) c4(26858, 39915, 52972, 13801, 66029) c5(aC, aeU, cp, yU, dA); #c1(ARHGEF4) c2(NP_056135) c3(745) c4(26859, 39916, 52973, 13802, 66030) c5(W, b); #c1(ARHGEF5) c2(NP_005426) c3(746) c4(26860, 39917, 52974, 13803, 66031) c5(A, sJ, C, z, O, m, cy, fq, q, aD, jG, aV, aq, aC, be, v, P, od, ll, aeV, cq, dP, u, Fo, uH, gd); #c1(ARHGEF6) c2(NP_004831) c3(747) c4(26861, 39918, 52975, 13804, 66032) c5(nz, nU, lW, O, aeW); #c1(ARHGEF7) c2(NP_001106983) c3(748) c4(26862, 39919, 52976, 13805, 66033) c5(bt, by, f, dB, w, O, BO, bQ, g, aC, nx, nW, aB, fO, jE, ag, cT, bq, afd, cY, hS, yn, xw, y, uj, ak, bu, B, cs, av, fy, bm, fY, afc, v, eX, afa, eF, py, fw, fG, nE, UT, hc, afb, b, GL, aeQ, bb, nU, q, X, pn, dQ, ar, u, dh, fs, UK, LR, ad, rw, jH, tW, he, gd, zO, fl, I, A, k, aeX, MT, aX, LI, h, aeY, gT, nz, dj, hW, cV, ui, bd, P, T, cz, lc, abX, at, KA, aeZ); #c1(ARHGEF9) c2(NP_001166950) c3(749) c4(26863, 39920, 52977, 13806, 66034) c5(KK, IB, afe, nz, nU, q, hS, IV); #c1(AR) c2(NP_000035) c3(750) c4(26864, 39921, 52978, 13807, 66035) c5(agr, mI, dB, lr, aeC, cp, PP, UZ, kz, mR, fe, aC, ao, jE, qN, ag, pH, bq, aA, age, eu, afR, afD, UW, Lr, xI, agb, kV, cM, eX, afZ, e, jS, vo, av, fy, fi, V, nl, afB, afJ, afv, aY, agk, ji, afE, KN, qa, afQ, afS, Bc, Kz, aJ, dh, il, Mi, ad, lG, fH, agi, wV, nV, mA, zX, afq, Qu, iL, gE, jw, afs, m, Nl, oJ, dj, be, J, IP, Ap, PS, afw, dx, bf, O, yg, bQ, DE, kT, afF, IV, afi, afM, og, nl, du, agh, bp, x, Lw, wh, dS, KR, hx, fl, Hk, afY, iP, oH, mk, afo, kY, cA, U, co, pw, sT, f, bu, iJ, afL, afU, ny, pJ, SR, Le, pv, am, wn, oR, zL, d, bb, QE, jd, PA, q, ra, zm, hb, qT, iR, rX, o, fh, kF, Kx, afW, dT, zk, rw, ct, afj, ch, xU, tb, fl, afX, aft, FL, hA, afO, afy, qL, pN, ax, dt, UT, agg, agp, afP, zp, pM, DP, aw, N, DT, ps, Bl, Gm, Kg, JZ, kX, g, bK, Qf, fO, agq, BW, fx, hR, bY, afN, fE, aer, NH, bW, agn, pp, B, Up, iv, oD, OA, iT, nu, cx, afn, v, Qz, Fr, iA, afz, nc, in, agd, fn, b, Of, AA, au, GE, aga, re, nU, afl, fJ, FD, NT, wp, UK, KL, cz, et, Lt, US, hX, Bg, ex, yy, agf, afG, Gn, gw, mW, lv, eM, wf, eb, LS, sG, cU, ik, afp, PT, sH, Yb, afx, Be, vF, W, aX, aM, agl, NG, acK, aas, afV, X, at, eG, h, afm, afg, sJ, w, dv, NR, Si, Lm, Dc, PH, gI, cB, afu, Ls, nz, afh, Lb, jT, mO, dH, xO, os, agm, i, dc, LD, wy, y, jb, ip, cV, afH, cc, cs, RA, afA, bm, Ag, afK, IT, afr, cK, iY, afk, qO, T, hV, yU, gZ, jD, aO, ago, jV, lt, ar, jG, u, QL, tg, l, eI, by, yG, KK, afT, aE, ih, wP, aff, A, Lv, BY, agj, di, c, jl, ja, az, afl, si, afC, adh, IF, BC, P, Oi, pF, sK, YQ, ck, agc, bh); #c1(ARID1B) c2(NP_059989) c3(751) c4(26865, 39922, 52979, 13808, 66036) c5(agu, mP, agv, b, cV, WW, agt, nU, q, cz, ag, di, AI, ags, dh); #c1(ARID2) c2(NP_689854) c3(752) c4(26866, 39923, 52980, 13809, 66037) c5(jE, aX, q, aer, gE, fy, bm, aes); #c1(ARID3A) c2(NP_005215) c3(753) c4(26867, 39924, 52981, 13810, 66038) c5(LR, J, MS, di, gg, aE); #c1(ARID3B) c2(NP_006456) c3(754) c4(26868, 39925, 52982, 13811, 66039) c5(X, av, cB, cV); #c1(ARID4A) c2(NP_002883) c3(755) c4(26869, 39926, 52983, 13812, 66040) c5(V, h, f, J, Mr, agw, O, cB, U, u, y); #c1(ARID4B) c2(NP_057458) c3(756) c4(26870, 39927, 52984, 13813, 66041) c5(ao, bQ, agx, jE, b, X, bm, q, w, O, cB, sc, rb, av, u, aA, y); #c1(ARID5B) c2(NP_001231567) c3(757) c4(26871, 39928, 52985, 13814, 66042) c5(dx, em, dv, l, m, aC, t, h, du, ie, J, WZ, G, agy, at, iu, rb, Bz); #c1(ARIH1) c2(NP_005735) c3(758) c4(26872, 39929, 52986, 13815, 66043) c5(qj, bj, A, dQ, B); #c1(ARL11) c2(NP_612459) c3(759) c4(26873, 39930, 52987, 13816, 66044) c5(GD, co, aX, V, b, X, B, ie, bp, GB, cT, A, T, y, qO, U, u, av, Up, rR); #c1(ARLI3A) c2(NP_001155963) c3(760) c4(26874, 39931, 52988, 13817, 66045) c5(r); #c1(ARL13B) c2(NP_001167621) c3(761) c4(26875, 39932, 52989, 13818, 66046) c5(Nw, agz); #c1(ARL14EP) c2(NP_689529) c3(762) c4(26876, 39933, 52990, 13819, 66047) c5(nU, ho); #c1(ARL14) c2(NP_079323) c3(763) c4(26877, 39934, 52991, 13820, 66048) c5(hT); #c1(ARL15) c2(NP_061960) c3(764) c4(26878, 39935, 52992, 13821, 66049) c5(I, aC, bg, aA, at, aW); #c1(ARL1) c2(NP_001168) c3(765) c4(26879, 39936, 52993, 13822, 66050) c5(bm); #c1(ARL2BP) c2(NP_036238) c3(766) c4(26880, 39937, 52994, 13823, 66051) c5(BO, b, f, by, ag, P, agA, T, fH, fJ); #c1(ARL2) c2(NP_001186674) c3(767) c4(26881, 39938, 52995, 13824, 66052) c5(aX, b, f, ag, ar, u, y); #c1(ARL3) c2(NP_004302) c3(768) c4(26882, 39939, 52996, 13825, 66053) c5(at); #c1(ARL4A) c2(NP_001182325) c3(769) c4(26883, 39940, 52997, 13826, 66054) c5(O); #c1(ARL4C) c2(NP_001269360) c3(770) c4(26884, 39941, 52998, 13827, 66055) c5(aY, ar, dc, ot, ik, jG, cM); #c1(ARL4D) c2(NP_001652) c3(771) c4(26885, 39942, 52999, 13828, 66056) c5(g, O, TD); #c1(ARL5A) c2(NP_001032251) c3(772) c4(26886, 39943, 53000, 13829, 66057) c5(U, V); #c1(ARL5B) c2(NP_848930) c3(773) c4(26887, 39944, 53001, 13830, 66058) c5(aX, o); #c1(ARL6) c2(NP_816931) c3(774) c4(26888, 39945, 53002, 13831, 66059) c5(am, ml, agC, TD, agB, aA); #c1(ARL6IP1) c2(NP_055976) c3(775) c4(26889, 39946, 53003, 13832, 66060) c5(agD, dv, aX, re, P, co, A, iT); #c1(ARL6IP5) c2(NP_006398) c3(776) c4(26890, 39947, 53004, 13833, 66061) c5(d, jh, fl, aX, V, b, J, bu, i, fx, by, e); #c1(ARMC10) c2(NP_001154481) c3(777) c4(26891, 39948, 53005, 13834, 66062) c5(bm, g); #c1(ARMC1) c2(NP_001273631) c3(778) c4(26892, 39949, 53006, 13835, 66063) c5(fl); #c1(ARMC2) c2(NP_115507) c3(779) c4(26893, 39950, 53007, 13836, 66064) c5(bf, A); #c1(ARMC3) c2(NP_001269674) c3(780) c4(26894, 39951, 53008, 13837, 66065) c5(cU, ag, iA, ck, b); #c1(ARMC4) c2(NP_001276950) c3(781) c4(26895, 39952, 53009, 13838, 66066) c5(MW, agE, Pu, CI); #c1(ARMC5) c2(NP_001098717) c3(782) c4(26896, 39953, 53010, 13839, 66067) c5(agF, Jq); #c1(ARMC8) c2(NP_001253970) c3(783) c4(26897, 39954, 53011, 13840, 66068) c5(co, fy, b); #c1(ARMC9) c2(NP_001258395) c3(784) c4(26898, 39955, 53012, 13841, 66069) c5(agG, aeQ, Pu, Ir, ae, b, agH, MW, dB, P, HQ, ix, agI, y, agJ, u, lU, aW, jx); #c1(ARMCX1) c2(NP_057692) c3(785) c4(26899, 39956, 53013, 13842, 66070) c5(U); #c1(ARMS2) c2(NP_001093137) c3(786) c4(26900, 39957, 53014, 13843, 66071) c5(aba, dx, agK, UA, agL, A, di, dW, cO, GV, aW, agM, oB, nv, fP, Uy, o, l, du, pk, agN, dX, aco, bq, at, ml); #c1(ARMT1) c2(NP_001273491) c3(787) c4(26901, 39958, 53015, 13844, 66072) c5(fl, bb); #c1(ARNT2) c2(NP_055677) c3(788) c4(26902, 39959, 53016, 13845, 66073) c5(rQ, b, cV, ak, cz, Fg, agO, cO, bq, PH, u, aA, y); #c1(ARNT) c2(XP_011507849) c3(789) c4(26903, 39960, 53017, 13846, 66074) c5(A, aw, b, X, bj, y, aX, t, Nl, f, q, bu, B, Xx, av, u, dh, oP, mz, l, oJ, jE, by, jU, wh, pS, bm, cf, mA, yE, cT, i, l, bh, eG, h); #c1(ARNTL2) c2(NP_001234931) c3(790) c4(26904, 39961, 53018, 13847, 66075) c5(eX, Gt, aY, agP, ak, cs, ad, fl, Gl, Rj, U, u, y, V); #c1(ARNTL) c2(NP_001025443) c3(791) c4(26905, 39962, 53019, 13848, 66076) c5(oC, A, b, CJ, O, w, di, cO, bf, U, OH, cM, yg, co, aX, am, ip, ra, ak, q, M, NJ, y, jG, u, og, V, I, cV, fl, J, T, eX, ny, Nh, IH, fx, aM, BX, aY, agQ, mA, B, oi, i, dc, aA, at); #c1(ARPC1A) c2(NP_001177925) c3(792) c4(26906, 39963, 53020, 13849, 66077) c5(bw, ag); #c1(ARPC1B) c2(NP_005711) c3(793) c4(26907, 39964, 53021, 13850, 66078) c5(by, aX, bu); #c1(ARPC2) c2(NP_005722) c3(794) c4(26908, 39965, 53022, 13851, 66079) c5(hS, fP, jH); #c1(ARPC3) c2(NP_001265485) c3(795) c4(26909, 39966, 53023, 13852, 66080) c5(agR); #c1(ARPC5) c2(NP_001257368) c3(796) c4(26910, 39967, 53024, 13853, 66081) c5(QJ, F, cl, b); #c1(ARPIN) c2(NP_872422) c3(797) c4(26911, 39968, 53025, 13854, 66082) c5(nu); #c1(ARPP21) C2(NP_001020240) c3(798) c4(26912, 39969, 53026, 13855, 66083) c5(nW, u, ae, y); #c1(ARR3) c2(NP_004303) c3(799) c4(26913, 39970, 53027, 13856, 66084) c5(A, MZ, b, X, eu, agS, hM, O, U, y, aX, pp, Qe, h, B, q, jF, hN, mR, Pm, hb, av, u, o, V, cV, fl, J, fO, W, T, ll, fx, jT, iw, qt, lc, cT, i, cB, aA); #c1(ARRB1) c2(NP_004032) c3(800) c4(26914, 39971, 53028, 13857, 66085) c5(GL, X, w, cO, O, co, cl, Km, av, fy, bm, aC, be, bp, W, jT, jU, jE, u, xU, yE, y, gI); #c1(ARRB2) c2(NP_001244258) c3(801) c4(26915, 39972, 53029, 13858, 66086) c5(lb, A, b, GL, ea, cO, y, fl, ml, f, ar, B, jG, bm, dj, l, be, xq, Hh, jT, jE, gt, u, ih, yE, bk, HV, gI); #c1(ARRDC2) C2(NP_001020775) c3(802) c4(26916, 39973, 53030, 13859, 66087) c5(at); #c1(ARRDC3) c2(NP_065852) c3(803) c4(26917, 39974, 53031, 13860, 66088) c5(aA, u, y, b); #c1(ARRDC4) c2(NP_899232) c3(804) c4(2691B, 39975, 53032, 13861, 66089) c5(agT, aA, at, SS, b); #c1(ARSA) c2(NP_001078895) c3(805) c4(26919, 39976, 53033, 13862, 66090) c5(agW, b, cY, eu, Rs, hM, cA, bf, U, jv, co, bb, ahc, ahb, f, ahd, uB, v, zp, ac, cs, agX, aq, ov, o, em, hW, V, bK, LG, aha, ZS, agZ, ad, Ce, bq, cy, yH, gY, agY, aM, jH, Al, aV, Ba, zI, ahf, agU, zk, fP, ahe, agV, Oi, at, Kq, jU); #c1(ARSB) c2(NP_000037) c3(806) c4(26920, 39977, 53034, 13863, 66091) c5(oy, em, bk, LG, dt, adp, Rs, ahg, jG, at, kA); #c1(ARSD) c2(NP_001660) c3(807) c4(26921, 39978, 53035, 13864, 66092) c5(ak, GL, gw, hS, K, rV, aho, Ld, ahi, bb, yQ, ahl, ahj, nU, jV, ahh, cM, cr, bK, qu, ahn, ahk, nI, nz, xJ, Wh, P, KK, afb, ahp, QZ, iy, cz, adx, rQ, aY, ahq, he, ih, acw, dc, ahm, at, gf); #c1(ARSE) c2(NP_001269557) c3(808) c4(26922, 39979, 53036, 13865, 66093) c5(ck, Lv, aht, ahr, ff, ahs); #c1(ARSF) c2(NP_004033) c3(809) c4(26923, 39980, 53037, 13866, 66094) c5(d, lp, en, b, cV, lk, jo, bp, oH, ahu, kz, ll, jG, fy, u, e, y, ff); #c1(ARSG) c2(NP_055775) c3(810) c4(26924, 39981, 53038, 13867, 66095) c5(ao, di, cO); #c1(ARSH) c2(NP_001011719) c3(811) c4(26925, 39982, 53039, 13868, 66096) c5(b, cV, agP, ahf, aht, T); #c1(ARSI) c2(NP_001012301) c3(812) c4(26926, 39983, 53040, 13869, 66097) c5(ih, wX, Ce, tR); #c1(ARSJ) c2(NP_078866) c3(813) c4(26927, 39984, 53041, 13870, 66098) c5(oy, bb); #c1(ARSK) c2(NP_937793) c3(814) c4(26928, 39985, 53042, 13871, 66099) c5(LG); #c1(ART1) c2(NP_004305) c3(815) c4(26929, 39986, 53043, 13872, 66100) c5(d, ag, aX, e); #c1(ART3) c2(NP_001123488) c3(816) c4(26930, 39987, 53044, 13873, 66101) c5(wn); #c1(ART4) c2(NP_066549) c3(817) c4(26931, 39988, 53045, 13874, 66102) c5(by, jT, b, J, q, cT, kY, av, bu); #c1(ARVCF) c2(XP_005261300) c3(818) c4(26932, 39989, 53046, 13875, 66103) c5(A, bb, hy, dA, B, jJ, i, cO, et, ac); #c1(ARX) c2(NP_620689) c3(819) c4(26933, 39990, 53047, 13876, 66104) c5(ahv, ahE, ahC, Xd, hS, FT, dI, nU, bK, afA, ahy, I, FR, nx, nz, ahB, ahz, yH, cz, Q, ahA, IC, xM, ahD, bM, vt, ahw, ahx); #c1(AS3MT) c2(NP_065733) c3(820) c4(26934, 39991, 53048, 13877, 66105) c5(dx, du, dO, Pz, ahF, b, at, f, eH, mk, dv, ic, i, bf, fx, ap, aM); #c1(ASAHI) c2(NP_001120977) c3(821) c4(26935, 39992, 53049, 13878, 66106) c5(Dr, nU, b, cY, Sc, ahd, A, ahK, adt, hP, cM, zp, co, aX, Bi, f, q, FN, kz, y, Pm, ahH, u, ahG, Fb, dc, LG, J, dt, nV, mF, hV, ahJ, EZ, ym, aY, bm, mB, B, ep, ag, adi, zk, ahl, afw, aA); #c1(ASAH2) c2(NP_001137446) c3(822) c4(26936, 39993, 53050, 13879, 66107) c5(oy, Jp, fP, bk, z, ds, Fg); #c1(ASAP1) c2(NP_060952) c3(823) c4(26937, 39994, 53051, 13880, 66108) c5(vq, A, b, eu, w, cO, bf, zY, U, y, eK, B, F, jC, aV, u, zW, V, J, aX, bk, aA, jI, wT); #c1(ASAP2) c2(NP_001128663) c3(824) c4(26938, 39995, 53052, 13881, 66109) c5(vq, jl, eK, V, J, zY, eu, w, bk, cO, bf, aA, aV, zW, wT); #c1(ASB10) c2(NP_001135931) c3(825) c4(26939, 39996, 53053, 13882, 66110) c5(ez, er, qr, dZ, dV, ahL); #c1(ASB13) c2(NP_078977) c3(826) c4(26940, 39997, 53054, 13883, 66111) c5(do); #c1(ASB15) c2(XP_005250203) c3(827) c4(26941, 39998, 53055, 13884, 66112) c5(dB); #c1(ASB18) c2(NP_997721) c3(828) c4(26942, 39999, 53056, 13885, 66113) c5(dA); #c1(ASB1) c2(NP_001035535) c3(829) c4(26943, 40000, 53057, 13886, 66114) c5(ak, ix); #c1(ASB2) c2(NP_057234) c3(830) c4(26944, 40001, 53058, 13887, 66115) c5(lb, M, at, J, jV); #c1(ASB6) c2(NP_060343) c3(831) c4(26945, 40002, 53059, 13888, 66116) c5(di); #c1(ASB7) c2(NP_078984) c3(832) c4(26946, 40003, 53060, 13889, 66117) c5(at); #c1(ASCC1) c2(NP_001185727) c3(833) c4(26947, 40004, 53061, 13890, 66118) c5(ak, afa, b, k, cY, fw, fs, O, y, aX, ag, h, f, aeY, bu, afb, X, pn, dQ, B, cs, av, fy, u, dh, fY, afc, hW, UK, aC, LR, aB, ad, P, UT, bt, rw, by, GL, jH, eF, py, tW, lc, abX, he, fG, gd, zO, cV, fI, l, bg, Mp, at, hc, aeZ); #c1(ASCC2) c2(NP_001229835) c3(834) c4(26948, 40005, 53062, 13891, 66119) c5(A, B, re, ahM, jz, fO, ad, lv, jT, jQ); #c1(ASCC3) c2(NP_001271200) c3(835) c4(26949, 40006, 53063, 13892, 66120) c5(ahN, fl, bb, V, b, dA, Ks, nU, gm, U); #c1(ASCL1) c2(NP_004307) c3(836) c4(26950, 40007, 53064, 13893, 66121) c5(hV, ahU, b, k, ahP, ahS, hS, ahV, A, jR, yF, bj, e, y, d, co, aX, nU, ar, O, fy, u, OT, fU, cV, bK, Fs, bp, W, ahO, T, bb, nP, qp, ahT, BZ, nV, dk, pS, Bg, OJ, qP, oa, Yv, ji, ahR, ahQ); #c1(ASCL2) c2(NP_005161) c3(837) c4(26951, 40008, 53065, 13894, 66122) c5(cU, by, V, b, q, bu, W, T, x, od, U, Dd, iA); #c1(ASCL4) c2(NP_982260) c3(838) c4(26952, 40009, 53066, 13895, 66123) c5(bf); #c1(ASF1A) c2(NP_054753) c3(839) c4(26953, 40010, 53067, 13896, 66124) c5(aX, ir, be, xU, zM, aC, u, fM); #c1(ASF1B) c2(NP_060624) c3(840) c4(26954, 40011, 53068, 13897, 66125) c5(u, y); #c1(ASH1L) c2(XP_006711513) c3(841) c4(26955, 40012, 53069, 13898, 66126) c5(d, fU, cV, co, rO, e); #c1(ASH2L) c2(NP_001098684) c3(842) c4(26956, 40013, 53070, 13899, 66127) c5(T, ho, u, q, y); #c1(ASIC1) c2(NP_001086) c3(843) c4(26957, 40014, 53071, 13900, 66128) c5(fh, bb, IW, KL, abN, IY, ME, w, di, O, cO, rb, aV, ahX, dh, ahW, Jd); #c1(ASIC2) c2(NP_001085) c3(844) c4(26958, 40015, 53072, 13901, 66129) c5(nX, aV, bb, b, dA, bj, ak, tR, cz, ag, do, w, hM, cV, wX, at, eD, O); #c1(ASIC3) c2(NP_004760) c3(845) c4(26959, 40016, 53073, 13902, 66130) c5(mz, ro, ahY, yp, di, ahZ, aia); #c1(ASIC4) c2(NP_878267) c3(846) c4(26960, 40017, 53074, 13903, 66131) c5(bK, aib, xM); #c1(ASIC5) c2(NP_059115) c3(847) c4(26961, 40018, 53075, 13904, 66132) c5(qs, di, bk, MV, aic); #c1(ASIP) c2(XP_005260469) c3(848) c4(26962, 40019, 53076, 13905, 66133) c5(aw, b, X, aid, aie, au, ic, e, d, aX, t, q, az, av, aE, da, ax, aeM, aC, aB, P, aif, aA, ao, st, DO, G, ay, tI, yA, at); #c1(ASL) c2(NP_000039) c3(849) c4(26963, 40020, 53077, 13906, 66134) c5(jE, nU, gs, b, Kp, f, q, aez, cz, Ns, w, xa, aig, LL, bm, Kq, Nq); #c1(ASMT) c2(NP_001164510) c3(850) c4(26964, 40021, 53078, 13907, 66135) c5(rQ, hW, aY, ak, cz, aih, dB, dc, Nk, cM); #c1(ASMTL) c2(NP_001166945) c3(851) c4(26965, 40022, 53079, 13908, 66136) c5(h); #c1(ASNA1) c2(NP_004308) c3(852) c4(26966, 40023, 53080, 13909, 66137) c5(Ba, hW); #c1(ASNS) c2(NP_001171546) c3(853) c4(26967, 40024, 53081, 13910, 66138) c5(aij, hT, b, X, t, f, q, J, ep, ag, G, aii, Oi, av, bm); #c1(ASPA) c2(XP_006721590) c3(854) c4(26968, 40025, 53082, 13911, 66139) c5(aw, X, au, O, t, aik, az, aC, aim, av, aE, ax, cV, cJ, aB, v, tz, dt, P, ao, ail, G, ay, aA, at); #c1(ASPG) C2(NP_001073933) c3(855) c4(26969, 40026, 53083, 13912, 66140) c5(oy, iw, Ei, bb, b, dP, ain, t, q, J, G, au, di, gR, jT, pq); #c1(ASPH) c2(NP_001158222) c3(856) c4(26970, 40027, 53084, 13913, 66141) c5(aw, b, gG, ot, Mr, aiq, q, bu, cs, bm, aio, cV, acv, ad, aip, T, jE, hq, bY, jR, OJ, ag, IN, ji); #c1(ASPM) c2(NP_001193775) c3(857) c4(26971, 40028, 53085, 13914, 66142) c5(fl, aw, b, X, w, kY, bw, O, aW, kJ, t, nU, q, az, agw, ait, av, u, aE, aij, ax, kF, FR, aC, aB, ais, P, QZ, air, ao, G, HZ, au, ay, aA, at, rb); #c1(ASPN) c2(NP_001180264) c3(858) c4(26972, 40029, 53086, 13915, 66143) c5(nI, aiv, rN, aC, rG, aiu, rV); #c1(ASPRV1) c2(NP_690005) c3(859) c4(26973, 40030, 53087, 13916, 66144) c5(d, fr, f, u, e, y); #c1(ASPSCRI) c2(NP_001238817) c3(860) c4(26974, 40031, 53088, 13917, 66145) c5(aiw, b, I, dB, QV, ar, ff, Vw, T); #c1(ASRGL1) c2(NP_001077395) c3(861) c4(26975, 40032, 53089, 13918, 66146) c5(afE, b, X, wy, eH, bo, ey, y, aev, jT, ag, t, h, nU, q, M, fr, aix, cs, av, u, TV, bm, aC, J, fO, ad, P, od, rO, ft, TW, aiy, TU, lo, G, TX, gj, vt, bT); #c1(ASS1) c2(XP_005272257) c3(862) c4(26976, 40033, 53090, 13919, 66147) c5(gK, A, aw, b, X, aF, dB, w, iG, WA, y, m, jT, LL, ag, aiz, aiB, oB, B, q, bu, fr, aiC, bm, av, u, aiA, fU, be, J, ft, dt, aig, aX, fx, by, pi, jG, gs, pG, ch, hT, Nq, jR, Sk, vH, ni, Ns, oi, i, Vs, h, rn); #c1(ASTN2) c2(NP_001171663) c3(863) c4(26977, 40034, 53091, 13920, 66148) c5(rQ, bb, dA, ak, cz, vW, xq, di, at, fh); #c1(ASUN) c2(NP_060634) c3(864) c4(26978, 40035, 53092, 13921, 66149) c5(wV, wP, Lo, Ca, NB, PX); #c1(ASXL1) c2(NP_001158075) c3(865) c4(26979, 40036, 53093, 13922, 66150) c5(afE, aw, b, zh, eM, pz, Vm, A, NH, jV, pK, aiE, JE, aiF, re, ps, y, yt, co, aX, kT, t, h, B, N, aiD, gT, M, aC, pn, hN, n, iv, Tr, kX, jG, hD, iT, pH, cj, aiH, JI, V, G, hf, J, fO, pF, P, Q, bM, aiG, Tp, oV, wd, pc, pq, iw, jT, NG, u, MP, pj, cT, qP, fg, acb, pJ, ci, pv); #c1(ASXL2) c2(NP_060733) c3(866) c4(26980, 40037, 53094, 13923, 66151) c5(mI, aX, V, B, jz, A, i, hR, u, jQ); #c1(ASXL3) c2(NP_085135) c3(867) c4(26981, 40038, 53095, 13924, 66152) c5(aX, V, cV, AP, ail, QZ, u, y); #c1(ASZ1) c2(NP_570124) c3(868) c4(26982, 40039, 53096, 13925, 66153) c5(at, Nv, eu, vQ, BV, A, II, DY, ap); #c1(ATAD2) c2(NP_054828) c3(869) c4(26983, 40040, 53097, 13926, 66154) c5(qW, MT, A, aw, jE, b, bm, B, q, cU, P, fI, fl, ji, u, y); #c1(ATAD3B) c2(XP_011540545) c3(870) c4(26984, 40041, 53098, 13927, 66155) c5(Fs, u, y, b, k); #c1(ATAD3C) c2(XP_011539310) c3(871) c4(26985, 40042, 53099, 13928, 66156) c5(ji, w); #c1(ATAD5) c2(NP_079133) c3(872) c4(26986, 40043, 53100, 13929, 66157) c5(xJ, or, b, fr, f, ft, dt, xr, ar, iD, pt, oM, mF, aiJ, AP); #c1(ATAT1) c2(NP_001026892) c3(873) c4(26987, 40044, 53101, 13930, 66158) c5(QU, aiK, A, kE, b, k, aE, In, dB, aiM, qa, Ku, O, gZ, G, jD, cM, Ej, m, pp, jd, t, h, f, oE, qL, fv, y, cs, pB, av, fy, u, dh, da, mz, I, Ea, Ib, be, v, gm, Fo, fI, aiL, cV, J, jT, aiN, mO, yG, P, an, gp, UE, aY, Dc, yC, bV, hn, fw, B, ag, dc, aC, ap); #c1(ATCAY) c2(NP_149053) c3(874) c4(26988, 40045, 53102, 13931, 66159) c5(hW, lZ, aK, nU, aiO, aN, dt, T, bK, bM, Nw, kS, EX); #c1(ATE1) c2(NP_001001976) c3(875) c4(26989, 40046, 53103, 13932, 66160) c5(c0); #c1(ATF1) c2(XP_011536689) c3(876) c4(26990, 40047, 53104, 13933, 66161) c5(mI, lO, b, cY, w, aiR, hP, O, aX, aiP, h, f, es, aiQ, u, xc, og, kF, T, nP, DO, adu, QP, X, iE); #c1(ATF2) c2(NP_001243019) c3(877) c4(26991, 40048, 53105, 13934, 66162) c5(B, b, cY, jz, A, ic, bj, e, y, jx, d, co, aX, js, f, F, cM, Kw, jQ, u, o, si, aeM, cV, aC, v, bp, ll, jT, gs, hX, aY, dc, aiS); #c1(ATF3) c2(NP_001035709) c3(878) c4(26992, 40049, 53106, 13935, 66163) c5(bm, en, b, ag, X, aF, dD, sE, jz, DT, w, xf, lv, iG, Lq, bf, U, A, ey, y, gO, d, fe, co, aX, aiT, adr, re, f, Ll, jQ, Kk, e, sR, B, aJ, cs, PH, aV, u, dh, iT, oJ, ma, hW, V, I, cV, ak, bK, aiU, sB, bp, ad, jG, T, eX, ca, cy, fx, jC, yA, ac, aM, wh, fy, ch, SJ, Dj, aE, yy, gd, fP, i, cB, zS, aA, at, cK); #c1(ATF4) c2(NP_001666) c3(879) c4(26993, 40050, 53107, 13936, 66164) c5(ak, SS, aiV, U, y, co, b, ml, f, q, bu, fy, bm, o, hW, V, cV, qL, LR, by, IR, IX, u, ex, IS, l); #c1(ATF5) c2(NP_001277675) c3(880) c4(26994, 40051, 53108, 13937, 66165) c5(ak, b, cV, pS, f, q, gL, J, w, O, u, y); #c1(ATF6B) c2(NP_001129625) c3(881) c4(26995, 40052, 53109, 13938, 66166) c5(m); #c1(ATF6) c2(NP_031374) c3(882) c4(26996, 40053, 53110, 13939, 66167) c5(f, aiW, DT, A, cO, bf, bj, y, aX, ml, q, fP, u, dh, l, cV, lb, BT, fO, cz, IR, IX, Fy, bi, jT, xx, ao, fN, MP, lS, ap); #c1(ATF7) c2(NP_001123532) c3(883) c4(26997, 40054, 53111, 13940, 66168) c5(jT, f); #c1 (ATF7IP) c2(NP_001273444) c3(884) c4(26998, 40055, 53112, 13941, 66169) c5(mZ, ck, b, Lv, jz, dj, lv, zK, Lr, gZ, cM, ajb, pA, h, f, yh, Cu, oJ, oO, aja, jQ, aiZ, hW, rN, l, ajc, bK, v, IJ, II, jT, Lt, wh, nb, aY, P, ih, rS, aiY, bk, dc, Nu, aiX); #c1(ATG10) c2(XP_005248667) c3(885) c4(26996, 40056, 53113, 13942, 66170) c5(U, V, b); #c1(ATG12) c2(NP_001264712) c3(886) c4(27000, 40057, 53114, 13943, 66171) c5(m, V, ajd, mW, P, T, u, gl, y); #c1 (ATGI6L1) c2(NP_060444) c3(887) c4(27001, 40058, 53115, 13944, 66172) c5(aje, jH, lE, aw, Ny, b, rr, f, gY, ig, xr, fP, ll, bt, HK, gz, HW, si, jU); #c1(ATG2B) c2(NP_060506) c3(888) c4(27002, 40059, 53116, 13945, 66173) c5(V); #c1(ATG3) c2(NP_071933) c3(889) c4(27003, 40060, 53117, 13946, 66174) c5(ji, Of, co, si, HW); #c1(ATG4A) c2(NP_443168) c3(890) c4(27004, 40061, 53118, 13947, 66175) c5(X, av, BX, ny, ip); #c1 (ATG4B) c2(NP_037457) c3(891) c4(27005, 40062, 53119, 13948, 66176) c5(jG, g); #c1(ATG4C) c2(XP_011540615) c3(892) c4(27006, 40063, 53120, 13949, 66177) c5(oy, b, dA); #c1(ATG5) c2(NP_001273035) c3(893) c4(27007, 40064, 53121, 13950, 66178) c5(en, aw, b, X, sE, au, ajf, sx, O, m, Fp, aX, pp, kJ, t, f, q, HW, az, B, A, et, hV, av, aV, EW, aE, ax, si, V, aC, nI, aB, P, T, cy, ajd, jG, qe, ao, DO, G, ay, aA, at); #c1(ATG7) c2(NP_001129503) c3(894) c4(27008, 40065, 53122, 13951, 66179) c5(f, b, fr, bg, A, xa, y, co, cy, kJ, B, F, q, jV, HW, ar, fy, u, si, lb, ft, eX, GR, qe, w, ajg); #c1(ATG9A) c2(NP_001070666) c3(895) c4(27009, 40066, 53123, 13952, 66180) c5(BX, ip, X, sE, ny, av, ajf); #c1 (ATIC) c2(NP_004035) c3(896) c4(27010, 40067, 53124, 13953, 66181) c5(lJ, dB, Ko, oi, cM, cp, jI, t, re, f, q, iT, da, ax, V, aC, J, fO, G, jT, dH, aY, ajh, dc, aA, gI); #c1(ATL1) c2(NP_001121185) c3(897) c4(27011, 40068, 53125, 13954, 66182) c5(lK, jz, pI, jQ, bb, ajn, ajj, ajo, aji, LR, dA, ajl, v, QC, bN, ajk, et, ao, PL, aeq, Y, xM, cb, ajm); #c1(ATL2) c2(NP_001129145) c3(898) c4(27012, 40069, 53126, 13955, 66183) c5(jz, lv, jQ); #c1(ATL3) c2(NP_001276977) c3(899) c4(27013, 40070, 53127, 13956, 66184) c5(PL, mb, ajp); #c1(ATM) c2(XP_006718906) c3(900) c4(27014, 40071, 53128, 13957, 66185) c5(pM, dx, pm, dM, aw, Gm, aE, QZ, w, cO, bf, VX, fx, O, gO, M, bQ, cy, ajf, kJ, t, Si, e, wv, iT, FN, mg, cl, et, fH, cq, ajz, R, g, bm, aC, bK, ajy, du, fO, FC, bp, ais, Ce, ajC, x, Vv, jT, pq, pb, Nc, qN, ie, ag, cT, ajq, i, dc, pt, aA, jl, ajG, bT, bP, il, adf, Zx, ajE, jz, LM, oH, adB, kY, ajw, bw, U, cM, co, rY, RD, pp, ajhJ, ajx, Dq, f, cs, bu, gX, k, B, iv, vE, av, fy, pP, EX, aju, em, ajs, V, jh, bx, Nw, v, gv, pr, ad, dv, og, bq, qX, iA, Wh, fJ, W, if, aY, fw, cz, qO, oM, WS, CA, ci, ll, Dr, ck, b, qz, q, dk, Bi, A, ic, z, jy, re, BQ, aO, d, Ag, Fp, ra, jd, oB, hV, ajA, ap, X, ar, as, n, jG, sK, u, nj, ajB, da, jj, aP, l, qL, Fw, gL, eu, G, agm, Nh, ct, Be, kS, po, WZ, adA, nV, fD, kh, Ck, dh, gd, xX, fl, I, fh, fj, C, uk, MZ, qd, fr, Lv, pR, gw, gY, pw, di, lv, gE, ji, aI, hP, aW, jQ, m, qs, aX, Zw, h, F, cU, Cz, ik, y, sV, ajt, fU, cV, an, be, J, gm, dt, P, ajr, T, MK, bh, bi, Pk, ac, aM, qp, jp, js, Hq, Jh, Ic, ajv, by, j, bM, at, eG, ajD, rb); #c1(ATN1) c2(NP_001007027) c3(901) c4(27015, 40072, 53129, 13958, 66186) c5(ml, aw, bx, EM, le, vB, en, bf, pz, e, O, M, Wp, t, AX, jG, ajK, mR, fH, oJ, mz, sE, aC, ol, cs, gm, fO, Lz, qt, fx, jT, ajQ, wh, xO, oQ, sS, ag, cT, i, dc, aA, bT, jS, X, jz, eu, oH, ajL, U, kV, cM, co, rY, pp, ajP, f, IN, B, iv, RA, av, ajR, bm, iT, em, V, ae, cJ, ajl, v, pJ, jC, iA, pi, fJ, dP, iY, aY, Oa, ajM, ajN, ci, fn, b, ajW, KN, ey, ajO, d, CK, re, gz, q, Kz, ajJ, oO, n, yW, u, aE, jE, l, el, KL, ad, G, sf, rw, ajV, ajU, ajS, JI, jU, jH, hU, hX, ex, fl, aU, A, lk, fe, lv, gE, ajT, jx, m, aX, LI, Yh, fq, h, F, cU, zp, y, p, jQ, aq, si, cV, hZ, Oq, Fs, J, P, T, pF, vv, fM, aM, MP, zM, zk, fP); #c1(ATOH1) c2(NP_005163) c3(902) c4(27016, 40073, 53130, 13959, 66187) c5(dx, fi, by, dv, ar, V, b, jH, ajX, du, jR, bu, W, T, Yv, cs, x, ds, U, ad, bg); #c1(ATOH7) c2(NP_660161) c3(903) c4(27017, 40074, 53131, 13960, 66188) c5(A, b, lg, dV, ajZ, y, co, aX, ml, B, q, dZ, ajY, xI, yW, u, n, da, ez, ae, cV, adJ, v, fO, bb, pk, er, cT, aka); #c1(ATOX1) c2(NP_004036) c3(904) c4(2701B, 40075, 53132, 13961, 66189) c5(bL, Ji, b, fd, fK, abb, JE, av); #c1(ATP10A) c2(NP_077816) c3(905) c4(27019, 40076, 53133, 13962, 66190) c5(bb, ez, I, dA, cz, agw, rv); #c1(ATP10B) c2(NP_079429) c3(906) c4(27020, 40077, 53134, 13963, 66191) c5(dA); #c1(ATP10D) c2(NP_065186) c3(907) c4(27021, 40078, 53135, 13964, 66192) c5(akb, bq, at); #c1(ATP11A) c2(NP_056020) c3(908) c4(27022, 40079, 53136, 13965, 66193) c5(ake, co, aX, akd, LR, q, na, cO, fK, kN, u, akc, y); #c1(ATP11AUN) c2(NP_997323) c3(909) c4(27023, 40080, 53137, 13966, 66194) c5(cy); #c1(ATP11B) c2(NP_055431) c3(910) c4(27024, 40081, 53138, 13967, 66195) c5(X, av, b); #c1 (ATP12A) c2(NP_001172014) c3(911) c4(27025, 40082, 53139, 13968, 66196) c5(A, b, bx, aki, hS, NH, akl, bf, ajf, yK, akh, eA, f, F, q, akf, bu, ar, B, bv, akk, MG, sE, by, T, akg, bt, aX, kN, akn, VQ, NG, akj, zM, na, akm, pH, dn, VU, zl); #c1(ATP13A3) c2(NP_078800) c3(912) c4(27026, 40083, 53140, 13969, 66197) c5(T); #c1(ATP13A4) c2(NP_115655) c3(913) c4(27027, 40084, 53141, 13970, 66198) c5(bw, KH, akp, akn); #c1(ATP1A2) c2(NP_000693) c3(914) c4(27028, 40085, 53142, 13971, 66199) c5(vf, ak, aw, akB, hS, aky, di, aks, sG, akv, nU, akp, akt, IM, lq, akr, akq, akw, aku, akA, akz, vW, XX, akx); #c1(ATP1A3) c2(NP_001243142) c3(915) c4(27029, 40086, 53143, 13972, 66200) c5(akE, akC, akH, afx, cO, akF, ak, f, el, akr, WA, akD, bK, bM, Wy, aks, akG, xM); #c1(ATP1A4) c2(NP_001001734) c3(916) c4(27030, 40087, 53144, 13973, 66201) c5(qs, dN, Nc, vD, akl, di, pd); #c1(ATP1B1) c2(NP_001668) c3(917) c4(27031, 40088, 53145, 13974, 66202) c5(qs, h, na, di, Fg, IV, mO, cp); #c1(ATP1B2) c2(NP_001669) c3(918) c4(27032, 40089, 53146, 13975, 66203) c5(jh, b, qP, w, O, i, l, bw, av, u, y); #c1(ATP2A1) c2(NP_001273004) c3(919) c4(27033, 40090, 53147, 13976, 66204) c5(dA, akJ, f, xo, yy, mk, akL, xA, cO, oD, akK, Jm, wC); #c1(ATP2A2) c2(NP_001672) c3(920) c4(27034, 40091, 53148, 13977, 66205) c5(akQ, mI, b, dE, sv, mk, hM, ak, cO, bf, e, d, akP, ahi, cr, f, F, nZ, eE, sK, dj, l, Bs, mc, JT, xi, x, cK, hR, aM, akN, akM, dk, fc, ch, cC, akO, bk, I, di); #c1(ATP2A3) c2(NP_777613) c3(921) c4(27035, 40092, 53149, 13978, 66206) c5(akR, di, bf, ey, e, d, bb, f, F, bu, ar, cs, I, bp, by, W, T, x, ct, ad, aM, ch, cC, dn); #c1(ATP2B1) c2(XP_011536710) c3(922) c4(27036, 40093, 53150, 13979, 66207) c5(oy, qs, fl, el, f, yy, di, cl, at, u, y); #c1(ATP2B2) c2(NP_001001331) c3(923) c4(27037, 40094, 53151, 13980, 66208) c5(qs, bb, fP, akS, ad, akT, di, cs, VP, KT, cz, u, y); #c1(ATP2B3) c2(XP_005274747) c3(924) c4(27038, 40095, 53152, 13981, 66209) c5(qs, Fz, Nc, kS, akU, ad, W, xP, di, cs, akV, u, y); #c1(ATP2B4) c2(NP_001001396) c3(925) c4(27039, 40096, 53153, 13982, 66210) c5(cC, ae, b, cs, ad, bM, di, cO, FW, cz, u, y); #c1(ATP2C1) c2(NP_001001486) c3(926) c4(27040, 40097, 53154, 13983, 66211) c5(dj, en, aX, f, b, qd, akO, ht, eu, akQ, eE, mk, P, co, cs, bf, ji, u, aE, y, aM); #c1(ATP2C2) c2(NP_001273456) c3(927) c4(27041, 40098, 53155, 13984, 66212) c5(ahk, yQ, Wh, vW, u, y); #c1(ATP4A) c2(NP_000695) c3(928) c4(27042, 40099, 53156, 13985, 66213) c5(EO, b, bx, aki, hS, NH, akl, bf, ajf, yK, akh, eA, f, q, akf, bu, bv, akk, MG, akn, sE, by, akg, bt, aX, kN, JY, VQ, NG, akj, zM, na, akm, pH, dn, VU, zI); #c1(ATP4B) c2(NP_000696) c3(929) c4(27043, 40100, 53157, 13986, 66214) c5(by, at, bu, ak, ap); #c1(ATP5A1) c2(NP_001001937) c3(930) c4(27044, 40101, 53158, 13987, 66215) c5(o, A, gs, BX, ip, cE, akW, f, dj, aY, qe, ny, dc, U, aA, cM, V); #c1(ATP5B) c2(NP_001677) c3(931) c4(27045, 40102, 53159, 13988, 66216) c5(akX, di); #c1 (ATP5C1) c2(NP_001001973) c3(932) c4(27046, 40103, 53160, 13989, 66217) c5(U, A, V); #c1(ATP5D) c2(NP_001001975) c3(933) c4(27047, 40104, 53161, 13990, 66218) c5(ar); #c1(ATP5E) c2(NP_008817) c3(934) c4(27048, 40105, 53162, 13991, 66219) c5(ake, ahJ, kW, cJ, hT, jG, akc, ala, T, x, aA, akY, akZ, pq); #c1(ATP5G1) c2(NP_005166) c3(935) c4(27049, 40106, 53163, 13992, 66220) c5(sp); #c1(ATP5G2) c2(NP_001002031) c3(936) c4(27050, 40107, 53164, 13993, 66221) c5(A, dB); #c1 (ATP5G3) c2(NP_001002258) c3(937) c4(27051, 40108, 53165, 13994, 66222) c5(jB, fr, q, dY, cz, W, cl, ahl, ft, u, y); #c1(ATP5H) c2(NP_001003785) c3(938) c4(27052, 40109, 53166, 13995, 66223) c5(ji, q); #c1(ATP5J2) c2(NP_001003713) c3(939) c4(27053, 40110, 53167, 13996, 66224) c5(A); #c1(ATP5J) c2(NP_001003696) c3(940) c4(27054, 40111, 53168, 13997, 66225) c5(ake, A, V, at, di, fD, bq, bf, U, hR, aM); #c1(ATP5L) c2(NP_006467) c3(941) c4(27055, 40112, 53169, 13998, 66226) c5(BX, ny, ip); #c1(ATP5O) c2(NP_001688) c3(942) c4(27056, 40113, 53170, 13999, 66227) c5(A, I); #c1 (ATP6AP1) c2(NP_001174) c3(943) c4(27057, 40114, 53171, 14000, 66228) c5(B, alg, b, Pv, NA, en, Ku, kY, A, e, alb, d, xT, alh, h, f, dQ, Jf, as, jG, alc, iT, acF, sQ, SV, fI, J, fO, alf, P, T, lI, qH, yG, iL, ale, LY, zO, xX, fF, re, ald); #c1(ATP6AP1L) c2(XP_011542025) c3(944) c4(27058, 40115, 53172, 14001, 66229) c5(ao, ali); #c1(ATP6AP2) c2(NP_005756) c3(945) c4(27059, 40116, 53173, 14002, 66230) c5(bP, bL, uk, iL, b, sO, sE, sv, mk, Pp, fl, di, aM, wf, bf, sx, aW, gO, m, sT, AP, all, jV, sP, aC, y, Hs, u, da, l, Ib, Dp, et, su, uf, alk, alj, fP, fD, fq, at, ap); #c1(ATP6V0A1) c2(NP_001123492) c3(946) c4(27060, 40117, 53174, 14003, 66231) c5(dx, ajf, du, I, aY, aF, sE, q, eR, eH, dv, di, hZ, at, bm); #c1(ATP6V0A2) c2(NP_036595) c3(947) c4(27061, 40118, 53175, 14004, 66232) c5(alm, am, aF, sE, dt, hS, w, aln, akg, UB, hZ, Ux, O, ajf, u, y); #c1 (ATP6V0A4) c2(XP_005250451) c3(948) c4(27062, 40119, 53176, 14005, 66233) c5(qt, na, aF, pR, sE, HG, alo, hZ, bf, ajf, alp, alq, aW); #c1(ATPGV0C) c2(NP_001185498) c3(949) c4(27063, 40120, 53177, 14006, 66234) c5(y, u, q, b); #c1(ATP6V0D1) c2(NP_004682) c3(950) c4(27064, 40121, 53178, 14007, 66235) c5(Pv, hT); #c1(ATP6V0E1) c2(NP_003936) c3(951) c4(27065, 40122, 53179, 14008, 66236) c5(ajg, akn, oD); #c1(ATP6V0E2) c2(NP_001094062) c3(952) c4(27066, 40123, 53180, 14009, 66237) c5(oy); #c1(ATP6V1B1) c2(NP_001683) c3(953) c4(27067, 40124, 53181, 14010, 66238) c5(als, na, zl, alr, alo, di, alp, akd); #c1(ATP6V1B2) c2(NP_001684) c3(954) c4(27068, 40125, 53182, 14011, 66239) c5(kz, hW, fI); #c1(ATP6V1C1) c2(NP_001686) c3(955) c4(27069, 40126, 53183, 14012, 66240) c5(d, bb, BX, b, ip, ny, u, e, y); #c1(ATP6V1D) c2(NP_057078) c3(956) c4(27070, 40127, 53184, 14013, 66241) c5(I); #c1(ATP6V1E1) c2(NP_001034455) c3(957) c4(27071, 40128, 53185, 14014, 66242) c5(ak, iP, iL); #c1(ATP6V1F) c2(NP_001185838) c3(958) c4(27072, 40129, 53186, 14015, 66243) c5(B); #c1(ATP6V1G1) c2(NP_004879) c3(959) c4(27073, 40130, 53187, 14016, 66244) c5(aC, bb); #c1(ATP6V1G2) c2(NP_001191007) c3(960) c4(27074, 40131, 53188, 14017, 66245) c5(m, Kx, ae, aiT, aC, ix); #c1(ATP6V1G3) c2(XP_006725021) c3(961) c4(27075, 40132, 53189, 14018, 66246) c5(pR); #c1(ATP7A) c2(NP_000043) c3(962) c4(27076, 40133, 53190, 14019, 66247) c5(dx, b, fd, X, alz, sE, Mz, AA, hS, alu, U, dv, alx, Ex, cs, av, fy, aly, V, cV, XC, du, v, fO, ad, My, x, by, OA, tf, alt, alv, cH, fK, yA, alw); #c1(ATP7B) c2(NP_001005918) c3(963) c4(27077, 40134, 53191, 14020, 66248) c5(B, b, fd, alB, F, gw, w, z, cA, U, e, V, d, co, bi, eZ, f, alx, q, alD, X, abb, ff, av, u, jB, bm, aP, alA, XC, bK, nu, bp, dt, T, bh, ac, jE, xM, fN, fK, bM, alC); #c1(ATP8A1) c2(NP_001098999) c3(964) c4(27078, 40135, 53192, 14021, 66249) c5(bf, gB, bq, I, agw); #c1 (ATP8A2) C2(NP_057613) c3(965) c4(27079, 40136, 53193, 14022, 66250) c5(nU, alE, jJ); #c1(ATP8B1) c2(XP_011524324) c3(966) c4(27080, 40137, 53194, 14023, 66251) c5(gD, jB, gB, alH, alG, kc, bn, p, qB, alF, acH, gu, bk, z, bw, at, kf); #c1(ATP8B3) c2(NP_001171473) c3(967) c4(27081, 40138, 53195, 14024, 66252) c5(ak); #c1(ATP8B4) c2(NP_079113) c3(968) c4(27082, 40139, 53196, 14025, 66253) c5(at, bb, o); #c1(ATP9B) c2(NP_940933) c3(969) c4(27083, 40140, 53197, 14026, 66254) c5(dd); #c1(ATPAF2) c2(NP_663729) c3(970) c4(27084, 40141, 53198, 14027, 66255) c5(akZ, all, alJ); #c1(ATRAID) c2(NP_001164266) c3(971) c4(27085, 40142, 53199, 14028, 66256) c5(cW, wa, aX, jd, f, q, fO, J, jF, T, n, iv, aA, fy); #c1(ATR) c2(NP_001175) c3(972) c4(27086, 40143, 53200, 14029, 66257) c5(dx, KG, nU, jT, b, WT, fj, QZ, w, Iv, O, Fh, bw, U, BQ, ait, alL, d, hO, fl, dv, aX, iR, h, f, e, bu, cU, WW, ar, Ld, cs, av, fy, u, oJ, qw, V, wU, WQ, nz, du, J, ad, dt, P, X, alM, pt, x, iA, by, ss, cq, WZ, kJ, wh, alK, WV, hT, cT, fl, fD, bq, oM, WS, at, kD, y); #c1(ATRIP) c2(NP_001257952) c3(973) c4(27087, 40144, 53201, 14030, 66258) c5(EO, sE, b, X, f, eo, EQ, WS, u, av); #c1(ATRN) c2(NP_647537) c3(974) c4(27088, 40145, 53202, 14031, 66259) c5(d, aX, aeM, alN, k, e, qP, ic, tl, cK, yA, aA, O); #c1(ATRNL1) c2(NP_997186) c3(975) c4(27089, 40146, 53203, 14032, 66260) c5(TV, fr, TU, ft, bo, lo, q, fO, ad, TX, P, aal, od, cs, aC, rO, 1W, wy, bm, bT); #c1(ATRX) c2(NP_000480) c3(976) c4(27090, 40147, 53204, 14033, 66261) c5(g, fr, nU, b, k, WT, fN, Ck, hS, w, Fh, bw, U, ft, y, alS, aIT, jF, jd, AP, f, cT, jV, X, O, alU, av, u, Qx, n, cj, alR, qw, V, cV, lb, YR, nz, qq, v, J, qp, T, alO, alP, dL, tm, cz, WV, alQ, yy, ag, xr, fl, ci, rb); #c1(ATXN10) c2(NP_001161093) c3(977) c4(27091, 40148, 53205, 14034, 66262) c5(aaz, kS, el, vU, v, dt, hS, alW, sL, rw, kV, alV); #c1(ATXN1) c2(NP_001121636) c3(978) c4(27092, 40149, 53206, 14035, 66263) c5(bL, nU, b, Jl, oH, ds, ak, cO, JE, si, kV, aW, ec, jv, bb, nQ, alY, bj, h, f, jV, Vr, pn, Kz, KL, pt, RA, jG, u, dh, EX, g, Ir, GS, hW, Kx, alX, dA, bK, el, KU, v, fO, J, dt, akq, rw, alZ, bM, pw, akV, kS, Yp, AA, ao, Y, zo, ama, zp, o, bq, oM, aA, at); #c1(ATXN1L) c2(NP_001131147) c3(979) c4(27093, 40150, 53207, 14036, 66264) c5(kV, Kx); #c1(ATXN2) c2(NP_002964)

c3(980) c4(27094, 40151, 53208, 14037, 66265) c5(acE, bS, X, amf, ig, si, ai, kV, fD, dl, oy, fm, qf, nQ, zo, bj, f, amg, NJ, Kz, KL, RA, av, aV, ame, aE, EX, amd, kz, Ir, ax, Kx, aIX, cV, Nw, nW, GS, v, bN, adP, rw, aj, x, di, akV, kS, OA, ac, dH, ao, amc, KN, KR, m, cH, zp, o, amb, bM, aA, GJ, ap); #c1(ATXN2L) c2(NP_009176) c3(981) c4(27095, 40152, 53209, 14038, 66266) c5(fP); #c1(ATXN3) c2(NP_001121168) c3(982) c4(27096, 40153, 53210, 14039, 66267) c5(KC, ame, b, ami, amm, Nq, oH, KN, aiM, si, HS, amh, kV, cM, zp, Uc, il, zo, bj, f, el, sZ, NJ, do, Kz, ik, xl, KL, RA, IV, ov, EX, bk, Ir, GS, si, Kx, aIX, afx, Nw, nW, be, ao, v, dt, akq, rw, cV, tj, YT, bN, kS, ac, amf, ami, Y, aaz, xM, amj, PY, aY, amk, o, amn, dc, bM); #c1(ATXN7) c2(NP_000324) c3(983) c4(27097, 40154, 53211, 14040, 66268) c5(aF, mk, si, si, kV, aW, zo, amp, f, nv, RA, EX, Pz, Kx, nQ, dA, nW, v, KL, XV, kS, ac, zp, rw, SF); #c1(ATXN7L3B) c2(NP_001129734) c3(984) c4(27098, 40155, 53212, 14041, 66269) c5(gf, cp); #c1(AUH) c2(NP_001689) c3(985) c4(27099, 40156, 53213, 14042, 66270) c5(m, em, mS, Fg, bq); #c1(AURKA) c2(XP_006723935) c3(986) c4(27100, 40157, 53214, 14043, 66271) c5(jK, hg, aw, dB, Ip, w, e, O, jR, kJ, t, dl, n, g, aC, qY, gm, bp, ft, Ce, x, fx, jT, amq, jE, BX, ag, cT, i, fl, X, afY, iP, wy, bw, U, y, co, ip, f, bu, gX, B, cs, av, fy, bm, iT, V, ny, py, in, ci, b, ic, d, jh, Sl, re, hV, g, ar, ff, jG, u, il, qL, ad, G, iD, wV, nV, agQ, Bg, agb, wP, I, yA, A, fr, nJ, hP, aX, Ec, h, F, ajo, cU, ik, rR, fM, fU, cV, J, W, T, fO, jl, by, ac, Af, Ez); #c1(AURKB) c2(NP_001271455) c3(987) c4(27101, 40158, 53215, 14044, 66272) c5(hV, aw, b, cY, w, O, O, bu, hP, e, y, d, jh, co, aX, t, h, f, q, vQ, es, cU, gX, ik, B, A, iv, ar, av, fy, u, n, g, fU, V, cV, cs, J, bp, gv, G, T, fO, pw, iA, ad, jG, agQ, DO, nJ, ag, cT, fl, bh, X, ci); #c1(AURKC) c2(NP_001015878) c3(988) c4(27102, 40159, 53216, 14045, 66273) c5(am, b, amr, re, ams, U, at, u, iT, V); #c1(AUTS2) c2(NP_001120703) c3(989) c4(27103, 40160, 53217, 14046, 66274) c5(oy, ak, S, t, nU, cz, hS, G, bK, QZ, hW, at); #c1(AVEN) c2(NP_065104) c3(990) c4(27104, 40161, 53218, 14047, 66275) c5(b, hX, ju, iP, Eo, G, iv, bw, fy); #c1(AVP) c2(NP_000481) c3(991) c4(27105, 40162, 53219, 14048, 66276) c5(amC, by, f, Gt, amF, yz, xb, cO, bf, amG, amv, vr, ahj, amB, gB, adO, ik, oN, rR, Fx, bp, Gl, amy, amD, ag, amu, dc, GD, amw, wX, cA, U, cM, amx, co, ak, bu, cs, fy, bm, em, V, IM, gv, adM, cK, qH, aH, aY, Fu, RE, qc, ap, b, z, ey, aO, jh, amz, bb, Iz, Gv, q, Jq, ar, Gj, u, dh, il, Fw, qC, ad, rQ, SJ, uH, ih, y, amt, di, adY, bj, adM, amE, amA, I, wr, F, iZ, Gs, adQ, dj, fU, cV, GS, dt, T, cz, vv, aM, amc, eB, bh, at, oT); #c1(AVPI1) c2(NP_068378) c3(992) c4(27106, 40163, 53220, 14049, 66277) c5(oy); #c1(AVPR1A) c2(NP_000697) c3(993) c4(27107, 40164, 53221, 14050, 66278) c5(ak, mE, di, cO, bf, qs, amA, ahj, Wk, f, wv, yp, Fg, fY, I, dK, cz, wX, cK, aM, aH, hn, ih, amu, bq, aA, RB); #c1(AVPR1B) c2(NP_000698) c3(994) c4(27108, 40165, 53222, 14051, 66279) c5(dj, fU, V, aY, wr, f, amH, tR, cz, ih, ak, dc, wX, U, cM); #c1(AVPR2) c2(NP_001139623) c3(995) c4(27109, 40166, 53223, 14052, 66280) c5(aw, ami, yz, amt, di, cO, adY, adR, AO, Hq, amK, nU, adO, adQ, dt, adM, cK, amJ, Nz, AR, xr, wz, amL); #c1(AWAT1) c2(NP_001013597) c3(996) c4(27110, 40167, 53224, 14053, 66281) c5(amM); #c1(AXDND1) c2(NP_653297) c3(997) c4(27111, 40168, 53225, 14054, 66282) c5(aV, di); #c1(AXIN1) c2(NP_003493) c3(998) c4(27112, 40169, 53226, 14055, 66283) c5(by, f, b, A, et, U, bj, e, y, d, co, cr, hP, B, q, bu, ar, cs, u, amO, V, bp, gv, T, aX, ad, su, bm, jR, amN, bh); #c1(AXIN2) c2(XP_011523623) c3(999) c4(27113, 40170, 53227, 14056, 66284) c5(b, X, amR, ahS, dB, kY, U, hP, y, co, aX, amQ, q, bu, cs, av, aV, u, aE, jB, V, cV, bp, ad, W, T, Qt, x, et, fy, aY, bm, Nq, jR, Ns, amS, i, I, amP); #c1(AXL) c2(NP_001690) c3(1000) c4(27114, 40171, 53228, 14057, 66285) c5(pM, dx, ml, b, k, X, iP, dB, yD, A, ic, kY, cO, y, co, bb, LI, kJ, h, B, F, q, cy, M, fr, ik, O, mR, fy, u, g, me, il, du, J, ft, Ql, UT, ar, aX, fx, jT, fM, yG, dO, hU, py, Bg, ag, w, i, eG); #c1(AZGP1) c2(NP_001176) c3(1001) c4(27115, 40172, 53229, 14058, 66286) c5(A, aw, b, y, co, kJ, B, q, bu, ar, ji, u, kF, UK, bp, by, UT, bh, amT, kl, JY, ii, aq, ag, T, aA); #c1(AZI2) c2(NP_001127904) c3(1002) c4(27116, 40173, 53230, 14059, 66287) c5(da, aw, uj, aF, ui, jz, amU, o, jQ); #c1(AZIN1) c2(NP_001288597) c3(1003) c4(27117, 40174, 53231, 14060, 66288) c5(jh, A, b, q, fl, gE); #c1(AZIN2) c2(NP_001288754) c3(1004) c4(27118, 40175, 53232, 14061, 66289) c5(d, co, aX, QN, k, X, Tu, v, bp, amV, w, di, amW, ar, av, fy, u, e); #c1(AZU1) c2(NP_001691) c3(1005) c4(27119, 40176, 53233, 14062, 66290) c5(oy, A, b, dY, P, u); #c1(B2M) c2(NP_004039) c3(1006) c4(27120, 40177, 53234, 14063, 66291) c5(bP, gK, A, aw, jT, b, vq, anb, jz, Xl, eu, ana, Ku, O, U, bu, aK, e, gm, rN, yK, jh, Rt, co, aX, bj, h, f, jQ, vQ, es, amZ, aC, k, y, cs, yW, aV, u, aE, jH, ff, d, V, I, cV, bx, Xn, jG, yo, amY, Zr, gY, W, ad, amX, T, fO, Ez, x, et, J, hR, et, fp, jo, P, nd, aH, fy, rS, od, Zl, acg, B, m, cT, CV, Im, aT, eG, jU, dB); #c1(B3GALNT1) c2(XP_005247921) c3(1007) c4(27121, 40178, 53235, 14064, 66292) c5(g, ag, RD, anc, kJ); #c1(B3GALNT2) c2(NP_001264084) c3(1008) c4(27122, 40179, 53236, 14065, 66293) c5(and, u, y, FR); #c1(B3GALT2) c2(NP_003774) c3(1009) c4(27123, 40180, 53237, 14066, 66294) c5(bj, cp); #c1(B3GALT4) c2(NP_003773) c3(1010) c4(27124, 40181, 53238, 14067, 66295) c5(m); #c1(B3GALT5) c2(NP_149361) c3(1011) c4(27125, 40182, 53239, 14068, 66296) c5(ag, ak, ar, b, cs); #c1(B3GALTL) c2(NP_919266) c3(1012) c4(27126, 40183, 53240, 14069, 66297) c5(rQ, Ip, amS, ane, at, aW); #c1(B3GAT1) c2(XP_011541055) c3(1013) c4(27127, 40184, 53241, 14070, 66298) c5(OG, en, anh, Jy, b, k, ie, ang, mk, A, di, Ku, jC, U, bu, cM, zM, co, aX, kn, t, DM, f, es, hN, dQ, mA, Tk, fP, jH, Ac, fU, V, cV, aC, adh, J, fO, W, P, vx, cy, aeC, anf, iw, qp, aY, DR, Ic, Oa, G, he, ne, ih, CL, fD, dc, iB, aA, at, MU, bT); #c1(B3GAT2) c2(NP_542780) c3(1014) c4(27128, 40185, 53242, 14071, 66299) c5(gt); #c1(B3GAT3) c2(NP_001275652) c3(1015) c4(27129, 40186, 53243, 14072, 66300) c5(cr, LR, ani, su, gg, AP, amO); #c1(B3GNT2) c2(NP_001306004) c3(1016) c4(27130, 40187, 53244, 14073, 66301) c5(m, A, dA, aC, B, nl, bw, iu); #c1(B3GNT3) c2(XP_011525929) c3(1017) c4(27131, 40188, 53245, 14074, 66302) c5(en, jI, vR, b, cV); #c1(B3GNT5) c2(XP_011511531) c3(1018) c4(27132, 40189, 53246, 14075, 66303) c5(w); #c1(B3GNT6) c2(NP_619651) c3(1019) c4(27133, 40190, 53247, 14076, 66304) c5(b, et, W, ag, T, cs, bw); #c1(B3GNT8) c2(NP_940942) c3(1020) c4(27134, 40191, 53248, 14077, 66305) c5(x, cs, ad); #c1(B3GNTL1) c2(XP_006722335) c3(1021) c4(27135, 40192, 53249, 14078, 66306) c5(cs, ad); #c1(B4GALNT1) c2(NP_001263398) c3(1022) c4(27136, 40193, 53250, 14079, 66307) c5(aX, anj, b, cV, hP, q, T, Qt, u, aE); #c1(B4GALNT2) c2(NP_001152859) c3(1023) c4(27137, 40194, 53251, 14080, 66308) c5(dx, id, b, eR, eH, vY, A, di, C, bW, U, hP, xl, c, dv, bb, q, jV, bu, tE, aah, akk, u, V, I, sj, xf, du, J, cM, by, P, T, bp, ZF, nV, VQ, dS, aY, vK, ZL, fz, dc, bq, at, y, ap); #c1(B4GALNT3) c2(NP_775864) c3(1024) c4(27138, 40195, 53252, 14081, 66309) c5(hR); #c1(B4GALT1) c2(NP_001488) c3(1025) c4(27139, 40196, 53253, 14082, 66310) c5(ank, V, b, anl, q, bp, J, vY, ar, oD, U, vt, o, cy); #c1(B4GALT3) c2(NP_003770) c3(1026) c4(27140, 40197, 53254, 14083, 66311) c5(U, V, cV); #c1(B4GALT4) c2(NP_997708)

c3(1027) c4(27141, 40198, 53255, 14084, 66312) c5(A); #c1(B4GALT5) c2(NP_004767) c3(1028) c4(27142, 40199, 53256, 14085, 66313) c5(U, J, b); #c1(B4GALT6) c2(NP_004766) c3(1029) c4(27143, 40200, 53257, 14086, 66314) c5(ao); #c1(B4GALT7) c2(NP_009186) c3(1030) c4(27144, 40201, 53258, 14087, 66315) c5(bm, f, anl, q, vc, Ex, anm, AP); #c1(B4GAT1) c2(NP_006867) c3(1031) c4(27145, 40202, 53259, 14088, 66316) c5(ann); #c1(B9D1) c2(NP_001230404) c3(1032) c4(27146, 40203, 53260, 14089, 66317) c5(r, zW, ano); #c1(B9D2) c2(NP_085055) c3(1033) c4(27147, 40204, 53261, 14090, 66318) c5(et, r, td, i, anp); #c1(BAALC) c2(NP_001019543) c3(1034) c4(27148, 40205, 53262, 14091, 66319) c5(fe, b, hf, t, h, iv, ie, J, jV, G, Hk); #c1(BAAT) c2(NP_001692) c3(1035) c4(27149, 40206, 53263, 14092, 66320) c5(b, aF, dE, anq, U, y, h, hV, bu, cU, do, cs, u, aE, V, ad, W, Ce, T, by, anr, Pw, nV, Yv, aA); #c1(BABAM1) c2(NP_001275685) c3(1036) c4(27150, 40207, 53264, 14093, 66321) c5(X, av, u, y); #c1(BACE1) c2(NP_001193978) c3(1037) c4(27151, 40208, 53265, 14094, 66322) c5(bL, en, aN, bg, hS, gk, bf, xw, aK, sG, oB, f, tF, aaZ, ans, aV, aq, o, I, cV, v, fp, aM, aL, alt, fw, add, eB, akX, aT, ap); #c1(BACE2) c2(NP_036237) c3(1038) c4(27152, 40209, 53266, 14095, 66323) c5(o, b, alt, aq, f, aN, ih, aaZ, ans, bq, Gi, u, y); #c1(BACH1) c2(NP_996749) c3(1039) c4(27153, 40210, 53267, 14096, 66324) c5(aw, b, u, X, gE, bw, al, y, co, h, f, q, av, bm, o, dA, P, zU, oM, jU, aq, dY, pt); #c1(BACH2) c2(XP_005248815) c3(1040) c4(27154, 40211, 53268, 14097, 66325) c5(aw, b, X, pD, ig, aM, bw, bf, jT, bb, Ov, h, f, bu, qB, av, aV, aE, Fg, I, cV, aC, gm, J, P, cy, by, jG, dH, jH, ii, ie, cT, Ou, at, iu); #c1(BAD) c2(NP_004313) c3(1041) c4(27155, 40212, 53269, 14098, 66326) c5(A, b, X, sE, O, fU, vZ, cO, U, bj, y, aX, h, f, q, bu, cU, ar, B, fH, av, u, dh, fh, ma, V, cV, Bs, gm, gL, J, T, bp, x, jC, iA, ad, gg, ch, er, fJ, aA, jl); #c1(BAG1) c2(NP_001165886) c3(1042) c4(27156, 40213, 53270, 14099, 66327) c5(oC, en, aw, b, bx, w, ak, O, U, A, ai, y, d, jv, co, jl, ip, Ec, h, f, e, q, bu, do, ar, B, cB, cs, tU, fy, u, anu, o, RG, ma, V, qL, J, ad, W, T, ny, aj, x, by, an, BX, he, ag, iT, ji, ant, re); #c1(BAG3) c2(NP_004272) c3(1043) c4(27157, 40214, 53271, 14100, 66328) c5(oC, ml, IO, b, X, sJ, w, kY, cO, bw, hP, e, xl, d, bb, ip, anw, h, f, q, mR, y, A, cs, oD, av, u, cb, ma, sQ, cV, J, gL, ad, P, II, ny, jl, hV, nV, anv, BX, Y, B, ih, ag, anx); #c1(BAG4) c2(NP_001191807) c3(1044) c4(27158, 40215, 53272, 14101, 66329) c5(jl, T, b); #c1(BAG5) c2(NP_001015049) c3(1045) c4(27159, 40216, 53273, 14102, 66330) c5(A, jl, BX, ip, f, B, ny); #c1(BAG6) c2(NP_001186626) c3(1046) c4(27160, 40217, 53274, 14103, 66331) c5(m, co, cr, dn, b, fr, aF, ox, fO, aC, cT, ik, In, t, ar, ji, jD, pW); #c1(BAIAP2L1) c2(NP_061330) c3(1047) c4(27161, 40218, 53275, 14104, 66332) c5(aC, A); #c1(BAIAP3) c2(NP_001186025) c3(1048) c4(27162, 40219, 53276, 14105, 66333) c5(ih, bb, b, any); #c1(BAK1) c2(NP_001179) c3(1049) c4(27163, 40220, 53277, 14106, 66334) c5(gK, ck, b, cY, iP, jz, wy, ig, HS, bW, O, hP, e, y, jQ, d, co, aX, re, bu, oJ, av, fy, u, iT, jj, V, aC, bp, by, W, Hq, T, cd, x, jl, ac, wh, nV, er, cT, Lt, i, I, iu, Iv); #c1(BAMBI) c2(NP_036474) c3(1050) c4(27164, 40221, 53278, 14107, 66335) c5(V, b, cV, bm, q, ad, fN, T, fx, i, cs, af, U, u, aA, y); #c1(BANF1) c2(NP_001137457) c3(1051) c4(27165, 40222, 53279, 14108, 66336) c5(b, agv, h, nU, anA, anz, Lg, xl); #c1(BANK1) c2(NP_001077376) c3(1052) c4(27166, 40223, 53280, 14109, 66337) c5(PJ, fm, m, aC, Jh, be, PB, mW, anB, zm, aE, Jc, j, mD, Pk, bj, gl); #c1(BANP) c2(NP_001167010) c3(1053) c4(27167, 40224, 53281, 14110, 66338) c5(ba, bb, b, anC, f, Ij, P, ho, u, y); #c1(BAP1) c2(NP_004647) c3(1054) c4(27168, 40225, 53282, 14111, 66339) c5(aw, b, X, pR, iP, eu, anF, oi, ic, iG, jC, y, hh, co, pw, jd, f, bu, ND, Mr, ff, av, u, EM, n, gG, aC, dB, by, anD, jo, VP, aX, st, anG, Yg, DO, anE); #c1(BARD1) c2(NP_000456) c3(1055) c4(27169, 40226, 53283, 14112, 66340) c5(IO, b, X, y, co, re, f, cU, cs, av, fy, u, iT, i, cV, ad, T, x, in, gO, I, at); #c1(BARHL1) c2(NP_064448) c3(1056) c4(27170, 40227, 53284, 14113, 66341) c5(jR); #c1(BARX1) c2(NP_067545) c3(1057) c4(27171, 40228, 53285, 14114, 66342) c5(bb, Ns, anH, py); #c1(BARX2) c2(NP_003649) c3(1058) c4(27172, 40229, 53286, 14115, 66343) c5(anJ, anl, X, QB, ar, av, u, y); #c1(BASP1) c2(NP_006308) c3(1059) c4(27173, 40230, 53287, 14116, 66344) c5(Ag, q, M, T, Af, anK); #c1(BATF2) c2(NP_612465) c3(1060) c4(27174, 40231, 53288, 14117, 66345) c5(en, aX, b, q, J, T, ji, dQ); #c1(BATF) c2(NP_006390) c3(1061) c4(27175, 40232, 53289, 14118, 66346) c5(aD, P, aV, aE, dA); #c1(BAX) c2(NP_001278357) c3(1062) c4(27176, 40233, 53290, 14119, 66347) c5(by, B, aw, gG, dB, w, bf, e, O, M, Hq, cy, ajF, iR, t, kX, anL, R, aC, nl, gm, bp, ft, Ce, x, fx, hR, cq, wh, qt, BX, ie, ag, cT, i, bq, cY, oH, fU, bw, U, y, co, ip, wP, f, bu, gX, cs, vo, av, fy, bm, iT, iF, jB, V, Bs, v, ny, Qt, Fr, iA, Lx, fJ, xd, aH, tl, iu, An, bt, b, oR, ey, jD, d, jh, aiT, Be, re, hV, g, jV, X, ar, aJ, Km, yW, u, dh, o, kF, jE, VD, Mi, gL, ad, G, sf, fH, et, jG, jH, wV, nV, hU, ch, ex, gd, fl, I, A, fr, pD, di, HS, fs, jw, bj, aX, h, anM, F, cU, ik, oJ, cB, aV, ma, J, W, P, T, jl, Ap, ac, aM, jT, qp, aeq, bh, ja); #c1(BAZ1A) c2(NP_038476) c3(1063) c4(27177, 40234, 53291, 14120, 66348) c5(dB); #c1(BAZ1B) c2(NP_115784) c3(1064) c4(27178, 40235, 53292, 14121, 66349) c5(l, dK, cz, dt, alM, ap); #c1(BAZ2A) c2(NP_001287834) c3(1065) c4(27179, 40236, 53293, 14122, 66350) c5(A); #c1(BAZ2B) c2(NP_001276904) c3(1066) c4(27180, 40237, 53294, 14123, 66351) c5(dA); #c1(BBC3) c2(NP_001120712) c3(1067) c4(27181, 40238, 53295, 14124, 66352) c5(EO, f, aw, b, aF, dB, pD, jc, w, vZ, C, U, A, e, y, d, co, aX, ip, kJ, h, B, F, q, bu, ik, O, KL, cs, ar, u, iT, fh, is, V, cV, aC, gm, gL, ad, GQ, T, by, jT, Lc, aaa, bm, ag, cT, od, re); #c1(BBIP1) c2(NP_001182233) c3(1068) c4(27182, 40239, 53296, 14125, 66353) c5(TD); #c1(BBOX1) c2(XP_011518705) c3(1069) c4(27183, 40240, 53297, 14126, 66354) c5(bb); #c1(BBS10) c2(NP_078961) c3(1070) c4(27184, 40241, 53298, 14127, 66355) c5(l, ml, Ff, TD, anN, aA, zW); #c1(BBS12) c2(NP_689831) c3(1071) c4(27185, 40242, 53299, 14128, 66356) c5(anO, et, TD); #c1(BBS1) c2(NP_078925) c3(1072) c4(27186, 40243, 53300, 14129, 66357) c5(BS, sk, nQ, UK, ml, anP, anQ, TD, UT, nE, aA, nW); #c1(BBS2) c2(XP_005256137) c3(1073) c4(27187, 40244, 53301, 14130, 66358) c5(A, dB, rd, anT, anR, rh, ml, nU, cU, B, cs, zW, ff, fi, cV, nW, anS, jn, iA, Nz, TD, nE, aA); #c1(BBS4) c2(NP_149017) c3(1074) c4(27188, 40245, 53302, 14131, 66359) c5(nQ, rh, anU, ml, TD, rd, ea, aA, u, nW, ap); #c1(BBS5) c2(NP_689597) c3(1075) c4(27189, 40246, 53303, 14132, 66360) c5(ml, aA, TD); #c1(BBS7) c2(NP_060660) c3(1076) c4(27190, 40247, 53304, 14133, 66361) c5(anV, nU, TD, ml, aA, anW); #c1(BBS9) c2(NP_001028776) c3(1077) c4(27191, 40248, 53305, 14134, 66362) c5(oy, qf, fe, anX, ml, TD, Al, aA, Ap, vt, nW, jw); #c1(BBX) c2(NP_001136040) c3(1078) c4(27192, 40249, 53306, 14135, 66363) c5(Eo, aX, n, dA); #c1(BCAM) c2(NP_001013275) c3(1079) c4(27193, 40250, 53307, 14136, 66364) c5(qt, b, dA, ml g, ad, cs, anY, pF, bm, ap); #c1(BCAN) c2(NP_940051) c3(1080) c4(27194, 40251, 53308, 14137, 66365) c5(g, bb, Fs, w, i, fx, O, fh); #c1(BCAP29) c2(NP_001008405) c3(1081) c4(27195, 40252, 53309, 14138, 66366) c5(de, at); #c1(BCAP31)

c2(NP_001132929) c3(1082) c4(27196, 40253, 53310, 14139, 66367) c5(aoa, il, b, Bu, jz, q, gm, na, jQ, iL, bM, aob, oD, ex, u, y, aoc); #c1(BCAR1) c2(NP_001164185) c3(1083) c4(27197, 40254, 53311, 14140, 66368) c5(A, aw, b, X, dB, HC, w, kY, bw, U, e, y, aog, d, tp, aX, jF, B, q, es, qL, aoe, ar, O, cs, av, fy, u, aoh, yJ, vR, V, I, cV, Be, J, ad, W, P, aiL, BW, x, jT, kM, n J, aof, aod, i, aC, T, at); #c1(BCAS1) c2(NP_003648) c3(1084) c4(27198, 40255, 53312, 14141, 66369) c5(ao, A, b, bq, at, u, y); #c1(BCAS3) c2(NP_001092902) c3(1085) c4(27199, 40256, 53313, 14142, 66370) c5(g, bb, b, ME, fD, aoi, bf, u, y, Cs); #c1(BCAS4) c2(NP_001010974) c3(1086) c4(27200, 40257, 53314, 14143, 66371) c5(nU, at, u, y); #c1(BCAT1) c2(NP_001171562) c3(1087) c4(27201, 40258, 53315, 14144, 66372) c5(fl, bb, jR, w, T, aE, O); #c1(BCAT2) c2(NP_001158245) c3(1088) c4(27202, 40259, 53316, 14145, 66373) c5(agx, aA, qt, pF); #c1(BCCIP) c2(NP_057651) c3(1089) c4(27203, 40260, 53317, 14146, 66374) c5(hh, g, A, aX, V, b, k, X, af, f, aeM, e, agm, w, ic, av, at, u, U, y, d); #c1(BCDIN3D) c2(NP_859059) c3(1090) c4(27204, 40261, 53318, 14147, 66375) c5(aA, cy, I, dA); #c1(BCHE) c2(NP_000046) c3(1091) c4(27205, 40262, 53319, 14148, 66376) c5(eX, dB, aN, w, dd, bf, aK, ZU, xl, kT, gP, kX, aoj, gl, akK, aL, xO, aog, aV, cT, bk, fD, ch, aA, aom, X, oH, U, xw, y, dg, f, aor, cs, av, Gl, cx, v, eq, anl, gO, aok, abB, b, bg, z, bb, je, se, ar, ff, Jm, u, xp, o, I, xk, aon, aos, Ic, gU, xQ, xf, gE, m, Wj, GW, h, oE, tF, Dd, n, QJ, cV, J, T, aoo, aM, hq, Jz, eB, aop, iB, bh, at, zn); #c1(BCKDHA) c2(NP_000700) c3(1092) c4(27206, 40263, 53320, 14149, 66377) c5(ch, aot, agx, Dj); #c1(BCKDHB) c2(NP_000047) c3(1093) c4(27207, 40264, 53321, 14150, 66378) c5(m, agx, b, ch, Ip, ag, iL, jw, u, y); #c1(BCKDK) c2(NP_001116429) c3(1094) c4(27208, 40265, 53322, 14151, 66379) c5(hS, nU, aou, cz); #c1(BCL10) c2(XP_011540701) c3(1095) c4(27209, 40266, 53323, 14152, 66380) c5(by, A, aw, jT, b, bx, X, iP, jK, wy, ck, ds, iG, O, bf, U, G, e, y, d, jh, co, aX, aov, pp, h, f, F, q, bu, cU, kz, ik, B, cs, ar, av, aV, u, iT, ff, fU, V, il, aoz, anb, Zg, aow, fO, gm, ajF, xO, T, aox, bt, J, ad, jG, px, aM, P, ao, Lc, aoy, bm, aoA, fG, ag, cT, Lt, Bm, re); #c1(BCL11A) c2(NP_060484) c3(1096) c4(27210, 40267, 53324, 14153, 66381) c5(b, pD, Ck, Fh, t, h, ak, aoB, M, fH, fy, pP, qw, kF, I, gm, J, P, rw, jT, fJ, pq, qt, G, cT, ah, pJ, rb); #c1(BCL11B) c2(NP_075049) c3(1097) c4(27211, 40268, 53325, 14154, 66382) c5(b, jz, lv, ps, jQ, zi, cr, t, h, F, ajo, es, eE, iv, jG, aji, J, P, T, jT, AP, PL, hX, G, cT, fP, fq, ap); #c1(BCL2A1) c2(NP_001108207) c3(1098) c4(27212, 40269, 53326, 14155, 66383) c5(A, b, sO, jz, di, Iv, O, bf, U, y, jQ, co, aX, fq, re, B, gU, bu, QE, ik, aO, fy, u, dh, iT, fe, V, I, aC, gm, gL, J, P, aoC, T, fO, jl, fx, by, mA, aM, jT, dO, hX, nJ, aoD, cT, i, at, rb, ap); #c1(BCL2) c2(NP_000624) c3(1099) c4(27213, 40270, 53327, 14156, 66384) c5(api, aoV, ml, zh, dD, iX, dB, vB, Ip, Ir, aoK, e, kJ, aoF, apw, nZ, kz, cl, Zy, apz, fe, aC, qY, aow, ft, aiL, pq, pb, ape, DO, ag, pH, bk, bq, aA, Mg, Dr, GD, em, X, oa, eu, ig, dV, iG, bo, ajw, bw, Oh, cM, rY, aoM, ak, N, CL, apv, fy, MG, fY, is, fi, V, ae, Cq, apa, IR, akg, jC, fJ, if, To, apL, gR, ji, apM, kD, ck, wt, dk, jy, pi, hh, jh, Be, pi, Tp, fr, fv, aJ, nO, dh, da, fs, jE, il, Mi, gL, ad, aeC, Jl, iw, ao, nV, aoA, anu, fg, yA, af, hd, zD, Yj, aoG, pR, gn, jc, C, iL, gE, jQ, m, hB, oJ, apb, YR, be, J, jo, pc, TY, aeg, E, dx, dM, qP, bf, aK, xl, yg, bQ, ajF, apd, jn, pC, aoQ, aoX, jM, oN, rR, og, nl, du, gm, bp, aoS, x, amq, wh, fc, apy, jB, bT, bP, fl, ie, iP, fw, ix, abL, Ku, kY, cA, U, co, pw, aoR, f, bu, dZ, ky, iJ, apK, Ov, Bs, app, gv, wV, Os, YS, ny, Qt, zf, gt, apO, aoD, tl, eL, apH, ahU, am, wn, oi, z, zL, d, bb, QE, jd, q, nF, ff, hb, fE, ar, iR, o, fh, kF, VF, qL, dT, aZ, et, apm, jH, ch, NG, apt, gd, Ou, fl, Xm, gU, pD, HS, al, iK, jk, hN, pN, aq, LK, nQ, sB, Fs, dt, dU, hi, T, Il, apl, aph, vU, eB, gj, Ca, pm, DP, aw, aoJ, aoL, lu, ps, Vx, apQ, fH, g, p, Dt, fO, Q, fx, av, cT, anl, EO, kM, apF, zu, wK, cY, Dv, jz, kB, apN, NH, Ni, anh, tp, px, pp, ml, B, gX, k, O, iv, bv, oD, OA, iT, QD, apu, bj, v, alf, Hq, bt, apq, Fr, iA, Lx, YU, JY, nJ, zS, iu, ape, xm, aF, aoU, bg, aoP, aiT, apG, re, hV, aoZ, vu, ajJ, cz, IX, et, hU, hX, xN, SJ, ex, cX, IS, IA, oC, ID, gw, mW, ea, Iv, eM, jx, QV, aps, gT, cU, tF, iZ, ik, ZU, Yb, Be, W, aoN, QI, jl, nP, fM, ale, Rd, apA, Yv, fq, Ez, at, eG, apJ, iq, bx, gG, ns, Zs, w, M, dv, cy, b, apr, t, aoE, Mu, apP, anL, gl, R, cB, lb, apl, zU, od, Lb, YY, AA, xO, apE, TJ, i, Ah, id, Kt, wy, hS, ma, IW, Co, y, ip, aoW, apf, vQ, cs, kN, bm, iF, apk, Bd, CZ, apg, anl, apj, GQ, py, PY, jR, ape, gO, yq, apD, ci, apC, ic, ey, jD, Iz, ZB, jV, apB, dQ, jG, Tv, u, nj, I, im, by, Tr, G, apR, aoT, yG, aoO, aE, ih, wP, I, bL, A, aoH, apn, xa, BY, di, Bz, hP, MT, aX, Ec, Aa, h, xJ, F, aoY, Vr, Dd, n, nA, aV, fU, si, apx, cV, hZ, Zg, P, IC, aox, Oi, ac, rM, jT, qp, YQ, QJ, hq, bh, LQ); #c1(BCL2L10) c2(NP_065129) c3(1100) c4(27214, 40271, 53328, 14157, 66385) c5(by, fU, jl, V, b, h, B, gm, fO, J, P, A, Q, n, iv, T, bu, u, y); #c1(BCL2L11) c2(NP_001191036) c3(1101) c4(27215, 40272, 53329, 14158, 66386) c5(jl, A, apS, b, X, dB, pD, w, et, U, ne, e, y, d, tp, co, aX, pp, t, h, f, q, bu, cU, fr, dQ, B, cs, ar, av, fy, u, afL, iF, fU, V, wp, cV, ft, fO, gm, gL, J, W, jo, T, bp, ny, gC, iA, ad, jG, fM, jT, qp, BX, G, ip, cT, Yv, at, hd, Jj); #c1(BCL2L12) c2(NP_001035758) c3(1102) c4(27216, 40273, 53330, 14159, 66387) c5(jl, by, gE, aw, b, X, cs, gv, cT, w, O, i, ad, x, bh, av, bu, u, fx, y, JY); #c1(BCL2L13) c2(NP_001257656) c3(1103) c4(27217, 40274, 53331, 14160, 66388) c5(jl, A, bm, g); #c1(BCL2L14) c2(NP_110393) c3(1104) c4(2721B, 40275, 53332, 14161, 66389) c5(A, jl, u, B, do, i, fx, iR, y); #c1(BCL2L1) c2(NP_001182) c3(1105) c4(27219, 40276, 53333, 14162, 66390) c5(jK, B, aw, dN, gG, dB, w, bf, e, O, jT, LL, kz, cl, Dc, aC, fO, aow, bp, ft, x, fx, hR, jE, xO, K, ag, cT, i, ch, bq, cY, iP, kB, iG, bw, U, FA, y, co, px, pp, f, Ll, bu, xg, cs, av, fy, bm, jB, V, Zg, v, cy, gt, aoy, er, PY, apT, pv, b, bg, oi, z, ey, BQ, d, jh, je, q, X, pn, dQ, ff, Tr, ar, jG, iR, dh, o, fh, sQ, il, gL, ad, pF, Ca, iD, ao, u, xU, A, aov, k, fr, ds, fs, hP, aX, I, bj, h, F, M, ik, aE, aV, fU, Fs, J, gm, W, P, T, aox, jl, by, aM, Lc, ip, eB, Oi); #c1(BCL2L2) c2(NP_004041) c3(1106) c4(27220, 40277, 53334, 14163, 66391) c5(am, wn, NT, O, jl, b, ip, q, y, jG, fy, u, o, fU, cV, gm, J, ny, aV, BX, w, ji); #c1(BCL2L2-PABPN1) c2(NP_001186793) c3(1107) c4(27221, 40278, 53335, 14164, 66392) c5(fU, b, cV, J, w, O, fy, ji, aV, u, y); #c1(BCL3) c2(XP_011525499) c3(1108) c4(27222, 40279, 53336, 14165, 66393) c5(A, b, X, jz, lv, y, jQ, aX, apV, fq, B, N, Ns, fH, av, u, el, gm, J, P, jl, jT, fJ, jU, jH, Ng, cT, fP, apU, bT, ap); #c1(BCL6B) c2(NP_862827) c3(1109) c4(27223, 40280, 53337, 14166, 66394) c5(by, en, b, bu); #c1(BCL6) c2(NP_001124317) c3(1110) c4(27224, 40281, 53338, 14167, 66395) c5(WH, by, FF, b, fr, To, gw, iX, eu, pD, apY, Zs, jc, w, oR, fH, gE, ajw, Ou, al, ft, G, oU, y, apW, jT, aX, Ov, apr, iR, apZ, t, zL, jV, bu, aC, oJ, cB, Dv, as, jD, jG, jx, u, g, apN, apX, lb, Cq, iv, BC, gm, fO, J, aoS, aoN, T, iD, pt, jl, fT, ke, Ut, fM, fJ, aqa, wh, kH, iK, iY, aq, hq, ie, P, jd, cT, Aa, I, oM); #c1(BCL7A) c2(NP_001019979) c3(1111) c4(27225, 40282, 53339, 14168, 66396) c5(yh, jl, aqb, pD, gm); #c1(BCL7B) c2(NP_001184173) c3(1112) c4(27226, 40283, 53340, 14169, 66397) c5(eX, ar, I); #c1(BCL7C) c2(NP_001273455) c3(1113) c4(27227, 40284, 53341, 14170, 66398) c5(gm); #c1(BCL9L) c2(NP_872363) c3(1114) c4(27228, 40285, 53342, 14171, 66399) c5(bb, hS, cO, W, mk, Qt, x, bf); #c1(BCLAF1) c2(NP_001070908) c3(1115) c4(27229, 40286, 53343, 14172, 66400) c5(fU, jl, FM); #c1(BCO1) c2(NP_059125)

c3(1116) c4(27230, 40287, 53344, 14173, 66401) c5(aqc, I, b, ml, B, yO, ad, P, A, y, cs, U, u, aW); #c1(BCO2) c2(NP_001243326) c3(1117) c4(27231, 40288, 53345, 14174, 66402) c5(f); #c1(BCOR) c2(NP_001116855) c3(1118) c4(27232, 40289, 53346, 14175, 66403) c5(KC, b, fr, jt, kC, Tw, ku, Ld, kH, h, aqd, aqe, es, n, cB, cj, hf, J, jV, q, jR, cT, kD, ci, rb); #c1(BCORL1) c2(NP_068765) c3(1119) c4(27233, 40290, 53347, 14176, 66404) c5(cj, b, h, g, jV, kC, ku, cB, rb, u, ci, y, n); #c1(BCR) c2(NP_004318) c3(1120) c4(27234, 40291, 53348, 14177, 66405) c5(jK, f, aw, Zq, qE, w, fR, ps, oU, t, kX, EM, oP, fe, lb, aqi, gm, fO, Q, aqg, jT, dL, kl, pq, pb, wh, oQ, fN, ie, K, cT, i, aqh, pt, aA, jz, eu, oX, pK, cA, U, co, pz, ak, N, vQ, iv, cj, V, pr, pJ, fJ, aqf, if, nb, hi, jR, fG, gR, oM, ci, pv, WH, OG, b, oR, jy, oZ, jd, q, jV, es, pn, fM, oO, n, jG, o, pF, pB, G, fH, aeC, KK, hX, pa, fg, oY, I, zD, A, gw, Iv, jQ, m, aX, h, gT, M, aC, oJ, cB, J, QI, pc, oW, oL, fP, bh, aT); #c1(BCS1L) c2(NP_001073335) c3(1121) c4(27235, 40292, 53349, 14178, 66406) c5(ake, bA, b, aqj, O, aqm, SS, aqk, aqn, h, f, fi, Ea, P, cV, kW, dP, hT, fw, aql, na, Is); #c1(BDH1) c2(NP_976059) c3(1122) c4(27236, 40293, 53350, 14179, 66407) c5(gK, ii, ch, O, KF, u, y); #c1(BDH2) c2(XP_005263197) c3(1123) c4(27237, 40294, 53351, 14180, 66408) c5(k, Rr, h, X, w, yM, av); #c1(BDKRB1) c2(NP_000701) c3(1124) c4(27238, 40295, 53352, 14181, 66409) c5(bP, fl, b, vD, Kc, hS, di, wf, bf, y, qs, cy, eA, f, bu, yp, iZ, O, aV, u, hW, MO, W, tf, bq, by, et, jH, tm, fc, ch, eQ, Hf, vH, Fi, fP, fD, ji, aA, at, ap); #c1(BDKRB2) c2(NP_000614) c3(1125) c4(27239, 40296, 53353, 14182, 66410) c5(bP, bn, b, tR, hS, tH, IW, wf, bf, O, oy, vr, qs, cy, eA, cA, ak, bu, iZ, qu, o, hW, I, Vc, aC, sH, MO, wX, aZ, ji, RY, by, qD, tf, Fz, ch, Hf, fP, fD, bq, I, di, aA, at, cK, ap); #c1(BDNF) c2(NP_001137280) c3(1126) c4(27240, 40297, 53354, 14183, 66411) c5(amC, jl, KS, abu, Gt, dN, Gm, Hv, jt, DT, aqt, aN, ns, nm, dd, nq, nr, nn, aqL, no, np, aK, e, hM, BO, LL, aqC, qc, GL, dl, aqF, zb, fw, aD, fH, IV, Qx, oN, g, fe, alA, HX, aC, bK, jN, iv, fO, gm, aqv, MO, ee, ME, agx, od, IH, jv, dL, gg, Ew, aV, re, agM, aqw, Ey, fc, aq, aqG, w, rV, dc, nt, aA, Ah, JX, ux, Bu, bS, X, agu, vD, rd, hS, fO, dV, bf, cA, si, ai, xw, aho, Jx, cM, co, gd, aqK, Dq, f, aqO, bu, xg, v, dZ, ky, B, aaR, aqH, IL, av, KK, aqp, aqN, GS, xE, V, dA, nu, aqr, xF, cx, cU, Qz, cl, iA, fJ, lb, fy, amH, VG, dP, iy, aY, er, HZ, rh, aql, yM, ji, rC, ap, hV, ahU, agO, acE, ak, aqT, cB, wa, bg, dk, qa, jJ, Fm, gZ, abq, aaf, aO, cy, d, jh, b, bb, agB, apV, Wk, Qi, nU, q, aqD, zm, kz, sR, Wf, qu, Gj, u, dh, o, fh, aE, aqP, ZA, I, qA, aqR, hv, cz, IX, am, xq, aby, Wz, qp, Kc, ao, nV, kB, iR, tW, hT, HN, he, aqS, ih, na, fg, aqq, HV, I, aaT, Gn, de, oC, A, MZ, tZ, k, fN, IW, FL, gn, tR, FE, O, aqV, ds, HS, di, wf, jw, jR, bj, U, aqQ, m, Co, LS, jP, sG, fq, wr, aqs, F, aqE, oE, aqA, tF, iZ, Dd, y, aqz, p, aqy, ZU, es, eX, kD, aqJ, dj, ma, hW, nQ, cV, sj, sB, J, dt, P, wX, aqo, aj, aX, nP, by, vv, ac, aM, to, abt, Y, vu, mb, Fe, HM, eB, Ql, aop, OA, bM, at, eG, zn); #c1(BDPl) c2(NP_060899) c3(1127) c4(27241, 40298, 53355, 14184, 66412) c5(d, u, y, b, e); #c1(BEAN1) c2(NP_001184154) c3(1128) c4(27242, 40299, 53356, 14185, 66413) c5(aqY, I, kS, el, v, zp, aqW, aqX, kV); #c1(BEGAIN) c2(NP_001153003) c3(1129) c4(27243, 40300, 53357, 14186, 66414) c5(aA); #c1(BEND3) c2(NP_001073919) c3(1130) c4(27244, 40301, 53358, 14187, 66415) c5(Cr, aK, aqZ, aN); #c1(BEND4) c2(NP_001153019) c3(1131) c4(27245, 40302, 53359, 14188, 66416) c5(V); #c1(BEST1) c2(NP_001132915) c3(1132) c4(27246, 40303, 53360, 14189, 66417) c5(dx, arn, aw, b, Rx, zF, cO, Nx, sv, AA, ig, aeP, yU, du, ara, arc, bf, jw, arl, xl, cp, c, qs, dv, BL, I, sr, arg, arj, ml, eX, arm, nv, cy, cc, kz, mR, aW, arh, oD, av, nR, HP, bk, mz, JB, Ik, kG, aeh, arp, aC, nW, afh, v, dt, ahu, arf, SF, gH, rO, arn, afj, OA, aM, pk, arq, wp, are, eU, ark, cK, ari, ag, xP, ard, arh, fK, di, kD, PK); #c1(BEST2) c2(XP_005260020) c3(1133) c4(27247, 40304, 53361, 14190, 66418) c5(jH, DR); #c1(BET1) c2(NP_005859) c3(1134) c4(27248, 40305, 53362, 14191, 66419) c5(wh); #c1(BET1L) c2(NP_001092257) c3(1135) c4(27249, 40306, 53363, 14192, 66420) c5(wh, aeU, sF, oJ); #c1(BEX1) c2(NP_060946) c3(1136) c4(27250, 40307, 53364, 14193, 66421) c5(d, b, jq, Fs, J, w, O, u, e, y); #c1(BEX2) c2(NP_001161871) c3(1137) c4(27251, 40308, 53365, 14194, 66422) c5(d, b, jq, Fs, J, w, O, u, e, y); #c1(BEX4) c2(NP_001073894) c3(1138) c4(27252, 40309, 53366, 14195, 66423) c5(X, av); #c1(BFAR) c2(NP_057645) c3(1139) c4(27253, 40310, 53367, 14196, 66424) c5(em, I, b, py, vC, f, v, arr, JT, fc, cT, agN, GV, rd, aA); #c1(BFSP1) c2(NP_001155177) c3(1140) c4(27254, 40311, 53368, 14197, 66425) c5(ars, art, eO); #c1(BFSP2) c2(NP_003562) c3(1141) c4(27255, 40312, 53369, 14198, 66426) c5(HI, aru, arv, Zt, kD, arw); #c1(BGLAP) c2(NP_954642) c3(1142) c4(27256, 40313, 53370, 14199, 66427) c5(bP, A, b, vd, fr, ia, bZ, sE, eu, aE, Sc, aeP, yU, bw, bf, ey, ft, iR, aeC, y, cp, cy, zJ, t, amK, B, AO, hb, adh, mm, u, HP, o, mz, xc, og, fD, aC, Mi, arB, cs, dB, fO, arx, W, fl, T, rT, ary, ad, aA, aM, rM, arD, arq, dS, ch, zl, AR, zM, TX, arA, zF, di, arz, at, arC, amL); #c1(BGN) c2(NP_001702) c3(1143) c4(27257, 40314, 53371, 14200, 66428) c5(dx, bL, hV, anY, b, qd, fr, Hk, arF, cs, mW, AA, fl, IW, bW, U, rF, aK, arE, y, m, qs, dv, LS, vG, f, q, bu, sO, sP, zF, bw, gg, u, gl, fY, kP, bm, fs, V, wp, aC, iK, Dr, du, cd, ft, IR, IX, eq, bq, et, fx, by, et, aA, su, wu, VQ, rK, iR, dh, ag, cT, IS, pZ, i, zS, aT, Iz, ap); #c1(BHLHA15) c2(NP_803238) c3(1144) c4(27258, 40315, 53372, 14201, 66429) c5(aov, kJ, px, dB, fO, bu, T, ff, VP, by, arG); #c1(BHLHA9) c2(NP_001157877) c3(1145) c4(27259, 40316, 53373, 14202, 66430) c5(arH, arJ, arI); #c1(BHLHB9) c2(NP_001135999) c3(1146) c4(27260, 40317, 53374, 14203, 66431) c5(v, o); #c1(BHLHE22) c2(NP_689627) c3(1147) c4(27261, 40318, 53375, 14204, 66432) c5(dx, eX, aiW, dB, w, Jw, bf, O, BO, dv, AX, Em, mR, cl, arO, Ad, aC, wo, fO, ft, PZ, fx, hR, Ip, Ya, os, vK, iT, i, bq, aA, X, arQ, Id, mk, dV, arN, U, y, arR, DG, B, bu, dZ, av, fy, tQ, arM, be, arP, V, gv, b, ajW, arL, re, k, q, DZ, ar, u, aE, I, by, jU, kB, eo, rv, g, A, qd, fr, di, qs, aX, sG, Ex, rR, arK, Yb, du, cV, adh, me, J, P, T, II, aM, at, Nq, UE, zM, agw, bh, eN, eG); #c1(BHLHE23) c2(NP_542173) c3(1148) c4(27262, 40319, 53376, 14205, 66433) c5(akB, A, aw, arT, fi, le, i, Id, aN, Ip, mk, w, XW, bw, U, aK, GL, xl, arV, jh, fO, co, b, Ox, arW, f, e, q, arU, bu, Ex, y, p, ar, fy, u, arS, Yb, ff, aE, d, xc, fU, fs, V, B, bK, cs, Fs, n, j, ad, dt, iB, P, gn, XV, II, XT, x, Jw, fx, by, LI, XY, aL, jT, st, XZ, hS, Qk, Ya, cV, eo, ag, tl, XX, T, ci, ap); #c1(BHLHE40) c2(NP_003661) c3(1149) c4(27263, 40320, 53377, 14206, 66434) c5(ak, b, pR, dB, ajW, bw, e, y, cp, d, jh, co, aX, f, F, q, bu, ik, cs, NS, fy, bm, il, m, by, T, gF, aY, u, ag, Au, at); #c1(BHLHE41) c2(NP_110389) c3(1150) c4(27264, 40321, 53378, 14207, 66435) c5(arX, co, b, kJ, aY, ak, nJ, T, bp, kY, ji, ar, u, y, R); #c1(BHMT2) c2(NP_001171476) c3(1151) c4(27265, 40322, 53379, 14208, 66436) c5(dx, IJ, cr, du, Nq, cd, Ns, xf, bb, at, fh); #c1(BHMT) c2(NP_001704) c3(1152) c4(27266, 40323, 53380, 14209, 66437) c5(dx, bL, IJ, LA, pX, xf, y, arY, jl, bb, q, LB, tE, fy, u, fh, V, I, du, bp, cd, cr, dL, xd, aq, Nq, Ns, mx, amS, i, fN, I, bh, aA, at, ap); #c1(BICC1) c2(NP_001073981) c3(1153) c4(27267, 40324, 53381, 14210, 66438) c5(asd, bf, aY, xc, asc, cA, Nz, Ni, dc, arZ, asa, et, ash, cM, aM); #c1(BICD1) c2(NP_001003398) c3(1154) c4(27268, 40325, 53382, 14211, 66439) c5(A, aC, tv, I, bw, aV); #c1(BICD2) c2(NP_001003800) c3(1155)

c4(27269, 40326, 53383, 14212, 66440) c5(ase, kz, bN); #c1(BID) c2(NP_001187) c3(1156) c4(27270, 40327, 53384, 14213, 66441) c5(dx, f, b, A, gE, bu, y, tp, co, aX, h, ak, q, es, ar, B, jG, u, aE, o, Yj, ma, V, Bs, du, gm, bp, by, P, dv, T, II, x, jl, fM, cT, iT, at, re); #c1(BIN1) c2(NP_004296) c3(1157) c4(27271, 40328, 53385, 14214, 66442) c5(OG, gk, b, cG, A, cO, y, aX, Vj, cK, B, q, VI, cs, oD, bm, o, cV, el, ad, T, x, bb, u, xP, Vi); #c1(BIN2) c2(NP_001276936) c3(1158) c4(27272, 40329, 53386, 14215, 66443) c5(b); #c1(BIN3) c2(NP_061158) c3(1159) c4(27273, 40330, 53387, 14216, 66444) c5(cO); #c1(BIRC2) c2(NP_001243092) c3(1160) c4(27274, 40331, 53388, 14217, 66445) c5(A, aw, b, X, asf, jz, dB, oi, Iv, e, U, re, aeC, y, jQ, d, c, co, aX, t, h, f, F, q, bu, fr, xl, hb, cs, oD, aV, u, iT, n, jh, gm, bp, J, P, T, fO, iA, ft, cq, cW, apR, qt, G, B, cT, i, asg, BK); #c1(BIRC3) c2(NP_892007) c3(1161) c4(27275, 40332, 53389, 14218, 66446) c5(by, en, aZ, b, X, asi, iP, dB, w, Iv, U, A, e, eh, d, co, aX, Ob, pp, re, B, q, fr, ar, y, hb, cs, av, aV, u, iT, n, fU, ft, fO, gm, gL, J, alf, P, dv, T, II, bt, x, jl, aeC, ad, jG, eg, jH, jT, fy, qt, bm, To, ash, ag, cT, oi, asj, i, fN, I, bp, ask); #c1(BIRC5) c2(NP_001012270) c3(1162) c4(27276, 40333, 53390, 14219, 66447) c5(gK, jK, aw, iD, EM, gG, dB, Ty, w, cO, Mn, e, O, hO, cy, t, apw, nZ, dl, n, g, og, aC, gm, bp, x, fx, jT, apv, jE, M, BX, ag, cT, i, bg, asl, fl, X, iP, jz, kB, fU, kY, IW, bw, U, Oh, y, V, tp, co, ip, B, bu, cs, av, fy, bm, iT, is, rN, ny, cK, iA, GB, gt, P, in, jd, ji, b, z, d, jh, Be, re, hV, q, ar, ff, jG, u, il, qL, gL, ad, G, sf, Fk, et, nV, iR, jc, Bg, asg, asm, A, k, BY, Iv, iL, Lr, jR, jQ, aX, wG, h, cU, ik, rR, cB, Jk, ma, cV, Fs, J, W, jo, T, fO, jl, by, VF, Ez, eG, ja); #c1(BIRC6) c2(NP_057336) c3(1163) c4(27277, 40334, 53391, 14220, 66448) c5(A, aX, BX, b, cV, Dt, QJ, ip, B, ny, cs, fy, ad, u, y, ez); #c1(BIRC7) c2(NP_071444) c3(1164) c4(27278, 40335, 53392, 14221, 66449) c5(aw, b, k, fr, dB, oi, Lr, co, aX, t, cY, cs, av, fy, u, cV, iv, bp, ad, T, jl, asn, VF, Eu, i, X); #c1(BIVM) c2(NP_001153068) c3(1165) c4(27279, 40336, 53393, 14222, 66450) c5(ak, bb, cO); #c1(BLCAP) c2(NP_001161292) c3(1166) c4(27280, 40337, 53394, 14223, 66451) c5(fe, b, fr, re, iT, jo, T, ff, i, fx, ft, u, y); #c1(BLID) c2(NP_001001786) c3(1167) c4(27281, 40338, 53395, 14224, 66452) c5(aso, bb, b, t, G, u, y, ap); #c1(BLK) c2(NP_001706) c3(1168) c4(27282, 40339, 53396, 14225, 66453) c5(bL, fl, asp, gn, mW, bf, m, BL, fm, zm, jG, aV, gl, PJ, I, aC, Bs, j, lo, cl, Pk, aM, aE, cT, aA); #c1(BLMH) c2(NP_000377) c3(1169) c4(27283, 40340, 53397, 14226, 66454) c5(eE, ck, fq, asq, v, q, dl, o, Lv, Lr, gg, u, y); #c1(BLM) c2(NP_001274175) c3(1170) c4(27284, 40341, 53398, 14227, 66455) c5(dx, b, cY, Nh, Lq, U, hP, fD, y, dv, aX, h, f, jV, pt, u, Qx, fU, V, asr, lb, du, gm, tz, J, dt, P, Ce, T, bp, ass, Qt, jl, fx, cq, wU, ast, Oi, i, I, oM, fj, IA); #c1(BLNK) c2(NP_001107566) c3(1171) c4(27285, 40342, 53399, 14228, 66456) c5(WH, fl, Kt, b, asx, aF, eu, mW, gE, vp, al, vl, m, jT, rY, Zq, pp, t, bX, zH, asz, cs, asw, aC, asv, Pv, oO, aV, gl, be, Ov, bx, hZ, jD, BT, gm, fO, J, bR, P, pD, Io, ad, pi, jU, asy, pr, ie, G, aE, gd, cT, Ou, asu, iB, iu, rr, Dg); #c1(BLOCIS2) c2(NP_001269365) c3(1172) c4(27286, 40343, 53400, 14229, 66457) c5(HI, aiT, be, N, asA, fg, If); #c1(BLOCIS3) c2(NP_997715) c3(1173) c4(27287, 40344, 53401, 14230, 66458) c5(XS, IZ, kF, o, asB); #c1(BLOCIS4) c2(NP_060836) c3(1174) c4(27288, 40345, 53402, 14231, 66459) c5(bw, XS, asC, IZ); #c1(BLOCIS5) c2(NP_001186251) c3(1175) c4(27289, 40346, 53403, 14232, 66460) c5(IY); #c1(BLOCIS6) c2(NP_036520) c3(1176) c4(27290, 40347, 53404, 14233, 66461) c5(IY, en, IZ, Eg, Dv, asE, gd, asD, jG, O, n); #c1(BLVRA) c2(XP_011513776) c3(1177) c4(27291, 40348, 53405, 14234, 66462) c5(dx, gB, du, at, aF, f, v, tF, bh, asF, o); #c1(BLVRB) c2(NP_000704) c3(1178) c4(27292, 40349, 53406, 14235, 66463) c5(jh, aoz, bm, h, g, bu, asH, n, asG, asl, av, iu, EM); #c1(BLZF1) c2(NP_003657) c3(1179) c4(27293, 40350, 53407, 14236, 66464) c5(asL, asK, A, b, X, Pv, MS, si, Ku, z, ai, sb, cp, asN, bb, kJ, Ks, f, q, jV, y, zQ, u, cl, di, I, Be, me, v, fO, gm, MW, P, jG, II, BW, pt, J, dL, av, sK, ao, as J, Y, bm, asM, cT, iB, oM, ael); #c1(BMF) c2(NP_001003942) c3(1180) c4(27294, 40351, 53408, 14237, 66465) c5(BX, ip, az, cT, au, ny, bf, fy, aM); #c1(BMI1) c2(NP_005171) c3(1181) c4(27295, 40352, 53409, 14238, 66466) c5(pm, B, aw, gG, w, aoK, e, O, kJ, t, dl, fH, jM, arS, R, g, asQ, cs, gm, bp, ft, fx, jT, cq, jE, Iu, ie, yE, i, bT, Dr, GD, X, eu, U, y, co, pp, ag, f, bu, Em, iv, Tk, av, fy, bm, iT, if, V, iA, fJ, jR, asP, ji, ci, b, asO, ic, Mr, d, jh, re, q, es, n, jG, u, dh, da, il, qL, ad, G, Nh, Ut, aE, yA, A, k, fr, pD, BY, nT, hP, QV, aX, I, h, F, cU, ik, rR, cB, QJ, fU, cV, J, po, T, fO, by, QN, Ez, vt); #c1(BMP10) c2(NP_055297) c3(1182) c4(27296, 40353, 53410, 14239, 66467) c5(A, B, di, mR, u, y); #c1(BMP15) c2(NP_005439) c3(1183) c4(27297, 40354, 53411, 14240, 66468) c5(UH, bQ, kF, agc, wp, Bl, UJ, UV, asU, UU, asS, asR, asT, jw, Ap); #c1(BMP1) c2(NP_001190) c3(1184) c4(27298, 40355, 53412, 14241, 66469) c5(IJ, b, X, zF, si, dY, cA, pz, anW, cM, h, B, asY, fv, fy, asW, aV, u, o, n, JP, V, P, asX, cq, at, eF, aY, he, gd, dc, Oi, asV, lu); #c1(BMP2) c2(NP_001191) c3(1185) c4(27299, 40356, 53413, 14242, 66470) c5(dx, zw, EM, dB, ads, w, cO, e, cp, dv, do, cl, n, aeM, mm, lb, du, yO, ata, fO, ft, fp, wh, abv, ag, Lo, fD, aA, Al, X, jj, wy, Ak, kB, iG, IW, U, xw, y, alS, co, pw, pp, B, ate, bu, cs, IS, av, fy, bm, vR, V, dA, IR, jR, tl, ji, b, d, bb, ate, q, jV, ar, u, aE, wR, oa, jE, I, by, IX, iD, aeC, atd, wV, Bu, wP, Ns, atb, zO, Au, A, vd, fr, acH, asZ, C, hA, iC, Co, S, LI, jk, HY, oJ, aV, be, P, T, Im, ad, Nq, zM, Oi, at); #c1(BMP2K) c2(NP_060063) c3(1186) c4(27300, 40357, 53414, 14243, 66471) c5(et, cp); #c1(BMP3) c2(XP_006714354) c3(1187) c4(27301, 40358, 53415, 14244, 66472) c5(LI, ID, Fr, U, o, V); #c1(BMP4) c2(NP_001193) c3(1188) c4(27302, 40359, 53416, 14245, 66473) c5(dx, gK, IJ, B, lr, zw, dN, xl, cp, dv, LL, t, cl, ati, PH, zW, aeM, ajc, aC, du, aB, ft, Jj, x, mm, pq, atn, qt, vz, fc, DO, ag, fD, fi, cY, Ak, hS, Ni, bw, U, y, atj, tq, ml, f, bu, O, cs, av, nR, bm, fY, iF, V, bj, atl, iy, nb, OW, er, atf, T, apU, kD, atq, b, yU, ic, z, bb, q, jV, X, ar, uz, u, aE, o, atp, kF, I, LR, ad, G, atm, sW, Bu, Ns, Mp, ats, bL, A, fr, atk, di, wf, hP, aW, aX, ajn, ath, wN, M, atg, Ll, aV, wF, atr, yO, J, yE, W, co, atn, by, HL, eJ, vt, Nq, zM, Oi, eG); #c1(BMP5) c2(NP_066551) c3(1189) c4(27303, 40360, 53417, 14246, 66474) c5(d, eJ, A, Ll, fc, jk, Dt, aC, jj, B, bq, aV, u, e, y); #c1(BMP6) c2(NP_001709) c3(1190) c4(27304, 40361, 53418, 14247, 66475) c5(A, zw, b, atu, fr, ia, att, IW, jz, dB, kB, di, Iv, cO, bf, pz, y, jQ, jh, co, t, h, f, q, bu, aW, pq, u, aE, fh, ma, kF, V, il, aC, yO, J, fO, ft, G, bQ, T, Fr, by, jU, aM, jT, fy, iP, bm, Ns, B, cT, pZ, gj, Im); #c1(BMP7) c2(NP_001710) c3(1191) c4(27305, 40362, 53419, 14248, 66476) c5(bP, gK, rN, A, ats, b, vq, cY, atw, q, NF, kB, vR, ds, IW, cA, bf, U, jb, e, y, gO, d, fe, co, aX, pz, re, f, atx, bu, atv, do, ar, B, iT, iJ, PH, aV, u, dh, fY, afM, wF, ma, V, I, mm, Be, sB, jU, gv, Jk, aty, x, bb, aeC, ft, et, gg, ac, aM, jT, Hs, fr, SR, fw, aE, zM, ag, fP, o, fD, atz, bh, jC, eG); #c1(BMP8B) c2(XP_011540326) c3(1192) c4(27306, 40363, 53420, 14249, 66477) c5(T, vQ); #c1(BMPER) c2(NP_597725) c3(1193) c4(27307, 40364, 53421, 14250, 66478) c5(ed, gE, cO, dY, gv, z, P, atA, vQ, Wf, bh, al, pq); #c1(BMPR1A) c2(NP_004320) c3(1194) c4(27308, 40365, 53422, 14251, 66479) c5(A, b, Yq, atD, ads, og, IW, hP, Ct, O, atC, B, UF, kq, oJ, atE, fe, rN, I, by, IR, IX, Ca, Oi, x, et, ca, AP, xd, atn, wh, Cr, IS, bh, aA, atB);

c1(BMPR1B) c2(NP_001243721) c3(1195) c4(27309, 40366, 53423, 14252, 66480) c5(b, atj, cy, atE, atG, ID, u, QM, Ak, IX, Ca, w, di, ac, A, IW, Oi, Co, AP, y, cp); #c1(BMPR2) c2(NP_001195) c3(1196) c4(27310, 40367, 53424, 14253, 66481) c5(bL, A, b, fr, gw, dB, atK, ZE, di, IW, U, Co, yw, cy, uS, f, Cz, B, cs, Cp, u, ma, V, atH, wO, ft, atl, j, vF, IR, IX, vc, T, ad, hR, xd, rQ, ch, atJ, P, Oi, IS, E, atL, bh, aA, at, Jh, ap); #c1(BMS1) c2(NP_055568) c3(1197) c4(27311, 40368, 53425, 14254, 66482) c5(bP, acE, id, aw, b, bx, iP, fU, di, qX, iG, jj, A, cM, qZ, jk, B, rc, ra, qY, as, jG, qT, o, da, ax, I, cV, T, qV, qF, dH, qW, mP, qS, m, oi, fD, aA, at, eG, gf, rb); #c1(BMX) c2(NP_001712) c3(1198) c4(27312, 40369, 53426, 14255, 66483) c5(A, b, aC, B, dB, P, fU, co, u, y, n); #c1(BNC1) c2(NP_001288135) c3(1199) c4(27313, 40370, 53427, 14256, 66484) c5(d, b, q, ag, tl, bm, e); #c1(BNC2) c2(NP_060107) c3(1200) c4(27314, 40371, 53428, 14257, 66485) c5(py, X, AP, cf, Nq, aE, bf, av, eG, PH, aM); #c1(BNIP1) c2(NP_001196) c3(1201) c4(27315, 40372, 53429, 14258, 66486) c5(afZ, di, A, u, y); #c1(BNIP2) c2(NP_004321) c3(1202) c4(27316, 40373, 53430, 14259, 66487) c5(do, A, jl, B, cV); #c1(BNIP3) c2(NP_004043) c3(1203) c4(27317, 40374, 53431, 14260, 66488) c5(by, A, aw, b, cO, dB, O, w, vZ, xa, bb, bw, U, hP, y, LL, pz, f, q, bu, ar, B, cs, fy, u, dh, ff, V, gm, bp, J, jo, T, fO, bq, aX, hR, qW, bm, G, sh, ag, Re, jl); #c1(BNIP3L) c2(NP_004322) c3(1204) c4(27318, 40375, 53432, 14261, 66489) c5(A, BX, b, X, bj, f, ip, ag, bn, pv, B, ny, cO, bf, av, hR, u, dh, y, aM); #c1(BNIPL) c2(XP_011507538) c3(1205) c4(27319, 40376, 53433, 14262, 66490) c5(g); #c1(BOC) c2(NP_001288790) c3(1206) c4(27320, 40377, 53434, 14263, 66491) c5(aiG, iw, hN, jR); #c1(BODIL2) c2(NP_001244893) c3(1207) c4(27321, 40378, 53435, 14264, 66492) c5(at); #c1(BOK) c2(NP_115904) c3(1208) c4(27322, 40379, 53436, 14265, 66493) c5(iR, sH, hT, vt); #c1(BOLA3) c2(NP_001030582) c3(1209) c4(27323, 40380, 53437, 14266, 66494) c5(Vn, atM, atN); #c1(BOLL) c2(NP_001271287) c3(1210) c4(27324, 40381, 53438, 14267, 66495) c5(NT, am, el, wn, ar, sF, afm); #c1(BOPI) c2(NP_056016) c3(1211) c4(27325, 40382, 53439, 14268, 66496) c5(Oi, bu); #c1(BORA) c2(NP_001273675) c3(1212) c4(27326, 40383, 53440, 14269, 66497) c5(dA); #c1(BPGM) c2(NP_001280014) c3(1213) c4(27327, 40384, 53441, 14270, 66498) c5(atO, ak, atP, atQ); #c1(BPIFA1) c2(NP_057667) c3(1214) c4(27328, 40385, 53442, 14271, 66499) c5(d, aw, aei, q, bp, T, zO, aZ, ar, Al, fy, pi, e, eh, bk); #c1(BPIFA2) c2(NP_542141) c3(1215) c4(27329, 40386, 53443, 14272, 66500) c5(acE, bn, kJ, B, A, IV); #c1(BPIFA3) c2(NP_001035904) c3(1216) c4(27330, 40387, 53444, 14273, 66501) c5(oy); #c1(BPIFB1) c2(NP_149974) c3(1217) c4(27331, 40388, 53445, 14274, 66502) c5(Pb, p, yr, vc, T, bk, atR, cl); #c1(BPIFB2) c2(NP_079503) c3(1218) c4(27332, 40389, 53446, 14275, 66503) c5(atS); #c1(BPIFC) c2(NP_777592) c3(1219) c4(27333, 40390, 53447, 14276, 66504) c5(av); #c1(BPI) c2(NP_001716) c3(1220) c4(27334, 40391, 53448, 14277, 66505) c5(aF, z, DT, ns, nm, nt, nq, nr, nn, hW, no, np, cM, hi, bX, ak, aeY, vu, atT, fy, mz, aP, Zz, l, aC, gL, gv, j, aZ, bq, pi, jU, JH, aY, fP, bk, i, dc, l, bh); #c1(BPNT1) c2(NP_001273078) c3(1221) c4(27335, 40392, 53449, 14278, 66506) c5(f, b, X, atU, A, atV, Ec, nU, zV, Lm, B, Us, zR, u, g, be, dB, T, Fr, PH, zT, y); #c1(BPTF) c2(NP_004450) c3(1222) c4(27336, 40393, 53450, 14279, 66507) c5(u, i, y); #c1(BPY2) c2(NP_004669) c3(1223) c4(27337, 40394, 53451, 14280, 66508) c5(NT, A, B, am); #c1(BRAF) c2(NP_004324) c3(1224) c4(27338, 40395, 53452, 14281, 66509) c5(jp, by, en, aw, auI, auT, F, Zy, gG, Vz, HG, auJ, w, hM, et, iq, atX, aue, adr, ra, O, BO, zi, auQ, kJ, QQ, t, e, apw, fp, dl, FN, aui, cl, Zv, EM, g, atW, aC, zj, aow, bp, dB, auf, auH, auq, cV, x, Lw, aus, aup, YY, xO, Lz, auk, sg, Yw, DD, K, anb, ag, cT, pH, i, agQ, jC, jI, auz, auN, Dr, QD, kM, QF, auW, fi, cY, afY, iP, wy, auP, os, aun, ava, auF, bw, U, xw, y, tp, co, Ml, pp, yE, f, lN, bu, gX, B, cs, auD, av, fy, bm, iT, yJ, if, Bd, V, aub, Qz, Wh, anD, auR, ny, auw, Fr, bd, pJ, hV, if, aen, auK, afz, aum, auB, nJ, Le, aut, apG, auC, yg, tl, Xk, fK, ji, kD, auZ, auS, An, afb, b, auX, cr, ic, Og, aur, auO, iA, aul, Ne, d, jh, auu, QE, jd, asn, re, aua, q, auE, ND, aug, apB, ar, ff, auG, auv, jG, u, kP, QL, jj, fs, VD, Xu, ad, as, QK, Yi, iD, auA, auL, auY, kS, Ut, jH, wV, nV, Eu, oe, iR, Yg, iY, Dj, wP, Lr, af, zD, A, auc, k, Mr, auj, auo, gw, gQ, og, in, aud, aux, jR, auV, Ld, ajb, Oh, aX, or, Qm, kn, jk, h, of, auh, Uq, cU, bn, ik, cB, Sj, fU, Eg, OC, atY, auU, Fs, J, gm, W, P, QI, T, fO, FF, atZ, nP, Wo, AP, fM, Ll, auM, jT, qp, st, ck, adu, Ce, auy, Oi, X, eG, Bi, oT); #c1(BRAP) c2(NP_006759) c3(1225) c4(27339, 40396, 53453, 14282, 66510) c5(dx, du, avb, l, b, ado, u, ak, J, Sw, eX, bq, at, pY, y, ap); #c1(BRAT1) c2(NP_689956) c3(1226) c4(27340, 40397, 53454, 14283, 66511) c5(hS, mk, avc); #c1(BRCA1) c2(NP_009225) c3(1227) c4(27341, 40398, 53455, 14284, 66512) c5(dx, fA, lJ, mL, aw, dN, wS, EM, avk, QZ, w, hC, bV, cO, bf, O, ca, Up, cU, bQ, avt, ajF, kJ, avD, amq, e, do, mR, QB, fH, age, cq, R, g, fe, aeM, lb, nl, du, fO, dB, by, Ce, cV, x, avi, fx, jT, pq, BX, YV, qN, DO, jh, Ly, ip, ag, cT, bk, i, dc, avl, pt, aol, jl, Mq, bT, Dr, GD, X, fE, arQ, eu, jf, oH, ajL, W, kY, bw, U, avy, avr, cM, TC, tp, co, ave, pp, aeG, f, lN, bu, gX, B, cs, avh, av, fy, avg, iT, yJ, xE, V, aub, avf, afn, dv, xF, ny, mD, iy, iA, aA, qW, ajV, aY, in, Qa, jd, yg, gO, oM, ap, afE, b, aF, qz, avv, MS, Ey, ic, jC, aoi, agm, gZ, Ne, d, Ag, GB, Dx, fv, aga, re, PA, q, fJ, NJ, dQ, Xp, ar, jG, u, avs, bU, iP, VM, il, wU, qL, ave, dT, ad, iO, Ca, Nh, JJ, et, aeC, jC, agQ, WZ, iw, QN, kB, iR, avp, ih, gd, atb, o, bq, l, avn, fj, bL, A, fr, WY, iH, BY, og, hi, C, iL, nT, jw, jh, Ld, LS, wp, h, F, avA, avu, avj, hN, ik, y, cB, zv, nA, PT, aV, rb, ajt, avm, avC, Ea, Be, J, dt, avw, P, T, ji, avd, aX, di, Ap, ac, aM, avq, Hy, ii, iK, mo, avB, avz, eX, Af, agc, avx, eG, ja, iE); #c1(BRCA2) c2(NP_000050) c3(1228) c4(27342, 40399, 53456, 14285, 66513) c5(fA, f, aw, avM, EM, sE, jt, avk, aN, iO, hC, bV, et, bf, O, aK, e, Up, cU, bQ, b, kJ, nZ, do, fH, g, fe, aeM, gm, bp, Tk, Ce, x, avi, ca, jT, cq, MS, BX, aaz, qN, DO, jh, ag, cT, aaS, i, avl, pt, Mq, avz, Dr, GO, X, fE, iP, kY, bw, VJ, avy, avA, y, jb, co, Ml, ave, pz, ak, agm, bu, B, cs, avh, av, avg, tQ, yJ, em, V, aub, avf, qq, v, afn, ny, aff, jC, iA, f, J, avG, in, jd, yg, qO, oM, ci, ap, afE, am, Dm, bg, wn, ic, gZ, BQ, d, Ag, avH, aga, avN, re, hV, q, es, age, ar, ff, VM, fv, u, dh, NT, I, TY, avE, be, dT, ad, avL, Ca, iD, JJ, avF, Ut, iw, nV, agQ, avp, ih, gd, Ly, xX, I, avn, fj, A, ID, fr, gw, avJ, iH, BY, hi, jR, avK, hP, U, Ld, aX, il, h, F, avu, qL, avj, hN, ik, n, cB, nA, aV, ajt, avC, Be, YR, J, dt, avw, ajF, T, ji, jl, by, ac, aM, Hy, Lc, avl, agc, avx, Ez, eG); #c1(BRCC3) c2(NP_001018065) c3(1229) c4(27343, 40400, 53457, 14286, 66514) c5(atn, bL, bU, KA, qz, J, u, y, cq); #c1(BRD1) c2(NP_001291737) c3(1230) c4(27344, 40401, 53458, 14287, 66515) c5(avO, bm, ak, hW, iG, di, cO, vu, f, q, ns, nm, nt, nq, nr, nn, T, no, np, A, rb); #c1(BRD2) c2(NP_001106653) c3(1231) c4(27345, 40402, 53459, 14288, 66516) c5(pM, aw, hY, aiW, w, bf, cp, avT, bQ, cy, b, kz, zW, avP, mz, afh, gm, avS, Jj, fx, jT, avY, EZ, CG, yE, i, aA, avX, X, rd, hS, Ku, OV, U, y, avQ, co, RD, UV, avR, av, fy, OT, iF, V, iA, UH, UT, am, wn, ey, UI, PK, nU, as, u, o, NT, kF, wp, UK, Fb, yH, Ca, jr, rO, afj, yG, avU, UJ, UW, OU, A, pu, qi, iL, jw, m, S, I, aV, avW, Uq, cU, cB, an, J, vF, W, P, T, Il, Ze, jl, Ap, aM, acK, hq, agc, PS, eG); #c1(BRD3) c2(NP_031397) c3(1232) c4(27346, 40403, 53460, 14289, 66517) c5(ao, b); #c1(BRD4)

c2(XP_011526156) c3(1233) c4(27347, 40404, 53461, 14290, 66518) c5(b, cY, Ku, gE, al, U, y, awa, aX, aej, uj, h, q, cs, u, awe, si, V, ui, fl, J, fO, ad, P, T, iD, cy, jT, dP, bm, jR, awb, avZ, DM); #c1(BRD7) c2(NP_001167455) c3(1234) c4(27348, 40405, 53462, 14291, 66519) c5(b, X, t, h, ft, cU, fr, T, kY, fP, av, O); #c1(BRD8) c2(NP_001157798) c3(1235) c4(27349, 40406, 53463, 14292, 66520) c5(o, V, b, ag, Be, eG, qL, gX, T, zO, O, x, U, u, y); #c1(BRE) c2(NP_004890) c3(1236) c4(27350, 40407, 53464, 14293, 66521) c5(qf, Eu, h, jL, q, T, u, y); #c1(BRF1) c2(NP_001229715) c3(1237) c4(27351, 40408, 53465, 14294, 66522) c5(A, B); #c1(BRF2) c2(NP_060780) c3(1238) c4(27352, 40409, 53466, 14295, 66523) c5(d, QJ, fy, b, e); #c1(BRI3BP) c2(NP_542193) c3(1239) c4(27353, 40410, 53467, 14296, 66524) c5(V, b, re, J, T, iT, U, u, y); #c1(BRI3) c2(NP_001152963) c3(1240) c4(27354, 40411, 53468, 14297, 66525) c5(GD, by, afE, aw, awg, b, k, X, awh, Rd, Qy, w, kY, D, U, OJ, A, fx, y, OB, hh, cU, jt, co, aX, Tq, Bc, rc, re, B, e, Kg, YX, bu, sZ, kz, mR, awd, cg, cs, sV, ar, av, QJ, u, aE, o, rR, g, d, og, V, I, jh, hZ, ly, j, Xr, acE, P, T, bp, ji, tj, YT, iA, ad, fM, awj, fy, qp, aq, awi, DO, bY, jR, bT, cz, FT, iT, i, awf, od, awe, ne); #c1(BRINP1) c2(NP_055433) c3(1241) c4(27355, 40412, 53469, 14298, 66526) c5(d, jT, fy, aw, b, iR, bq, anC, bj, e, lj, by, G, i, cO, cy, fx, aV, u, Dq, y); #c1(BRINP2) c2(NP_066988) c3(1242) c4(27356, 40413, 53470, 14299, 66527) c5(oy, dA); #c1(BRINP3) c2(NP_950252) c3(1243) c4(27357, 40414, 53471, 14300, 66528) c5(dx, bb, bX, du, bR, fP, bq, at, Fg, TP); #c1(BRIP1) c2(NP_114432) c3(1244) c4(27358, 40415, 53472, 14301, 66529) c5(A, aw, b, X, Qz, Dj, O, bw, U, al, y, co, jd, h, f, q, ar, B, ss, av, u, iT, g, V, afn, dt, agm, P, zU, T, awl, pt, jU, pq, bm, dY, awk, i, I, oM, yA, re); #c1(BRK1) c2(NP_060932) c3(1245) c4(27359, 40416, 53473, 14302, 66530) c5(BO, co, b, RX, pR, f, awm, dB, QO, Hq, ff, JC, auw, VP, QJ); #c1(BRMS1) c2(NP_001020128) c3(1246) c4(27360, 40417, 53474, 14303, 66531) c5(b, X, od, e, O, d, co, aX, DP, q, ar, y, Dd, av, fy, u, bp, zU, T, fx, DO, i, ji); #c1(BRMSIL) c2(NP_115728) c3(1247) c4(27361, 40418, 53475, 14304, 66532) c5(b, X, e, O, d, co, aX, DP, q, Dd, y, ar, av, fy, u, o, bp, zU, T, ji, fx, nV, DO, Eo, cT, i, bq, od); #c1(BRS3) c2(NP_001718) c3(1248) c4(27362, 40419, 53476, 14305, 66533) c5(ak, b, yu, yz, hS, yD, w, di, yx, yn, cO, bf, O, A, yv, y, yy, co, aX, yl, f, F, ys, oE, yp, X, yF, B, cB, av, yB, u, el, l, aC, nW, bp, P, yk, fD, uw, cy, jv, jC, yA, aM, yG, gp, ym, yr, cT, gu, il, T, aA, yO); #c1(BRSK1) c2(NP_115806) c3(1249) c4(27363, 40420, 53477, 14306, 66534) c5(jw, ho, u, y, Ap); #c1(BRSK2) c2(NP_001243556) c3(1250) c4(27364, 40421, 53478, 14307, 66535) c5(f0); #c1(BRWD1) c2(NP_001007247) c3(1251) c4(27365, 40422, 53479, 14308, 66536) c5(jH, NT, ak, aq, fP); #c1(BRWD3) c2(NP_694984) c3(1252) c4(27366, 40423, 53480, 14309, 66537) c5(awn, nz); #c1(BSCL2) c2(NP_001116427) c3(1253) c4(27367, 40424, 53481, 14310, 66538) c5(nU, IK, cG, bf, Md, Ma, f, Me, kz, k, cc, OA, aM, awo, dt, Hh, gF, dL, jG, sK, ao, PL, Y, Me, fN, Kf, cH, Mb); #c1(BSG) c2(NP_001719) c3(1254) c4(27368, 40425, 53482, 14311, 66539) c5(dx, B, aw, dB, w, PM, e, O, dv, fH, oP, g, aC, du, fO, ft, aaD, fx, hR, wh, awp, ag, i, id, X, Bd, IW, vl, y, co, pp, yE, f, bu, cs, av, bm, iT, yJ, be, f, J, fU, W, PY, yM, zS, re, b, d, jh, jd, bX, k, q, ra, fv, ar, u, dh, o, da, il, by, Vw, cW, nV, iR, aof, A, sO, fr, zK, Xv, U, aW, m, aX, Bi, F, ik, ma, cV, me, J, GB, bR, T, ad, fM, mb, eG, rb); #c1(BSN) c2(NP_003449) c3(1255) c4(27369, 40426, 53483, 14312, 66540) c5(jH, at, I, aC, ak, v, xr, di, aV, fP, hR, aE, GS); #c1(BSPH1) c2(NP_001121798) c3(1256) c4(27370, 40427, 53484, 14313, 66541) c5(M, h, jG); #c1(BSPRY) c2(NP_060158) c3(1257) c4(27371, 40428, 53485, 14314, 66542) c5(Ns, Ng); #c1(BST1) c2(NP_004325) c3(1258) c4(27372, 40429, 53486, 14315, 66543) c5(cy, aC, f, cz, aZ, av, bj); #c1(BST2) c2(NP_004326) c3(1259) c4(27373, 40430, 53487, 14316, 66544) c5(g, aX, b, k, X, aq, AX, hg, J, fO, dB, cU, P, av, u, iA, y, awg); #c1(BSX) c2(NP_001091639) c3(1260) c4(27374, 40431, 53488, 14317, 66545) c5(aA); #c1(BTBD10) c2(XP_011518706) c3(1261) c4(27375, 40432, 53489, 14318, 66546) c5(ao); #c1(BTBD11) c2(NP_001017523) c3(1262) c4(27376, 40433, 53490, 14319, 66547) c5(bq, ao, bm); #c1(BTBD16) c2(NP_653188) c3(1263) c4(27377, 40434, 53481, 14320, 66548) c5(ak, aW); #c1(BTBD1) c2(NP_001011885) c3(1264) c4(27378, 40435, 53492, 14321, 66549) c5(awr, lo); #c1(BTBD2) c2(NP_060267) c3(1265) c4(27379, 40436, 53493, 14322, 66550) c5(g, O, aW); #c1(BTBD3) c2(NP_001269480) c3(1266) c4(27380, 40437, 53494, 14323, 66551) c5(at, bb, cO); #c1(BTBD9) c2(NP_001165889) c3(1267) c4(27381, 40438, 53495, 14324, 66552) c5(bP, aws, zo, EE, zb, fD, qu, awu, awt); #c1(BTC) c2(NP_001720) c3(1268) c4(27382, 40439, 53496, 14325, 66553) c5(mz, auW, b, l, mD, Be, ja, q, nY, bf, iJ, zE, ey, u, aE, y, aM); #c1(BTD) c2(NP_000051) c3(1269) c4(27383, 40440, 53497, 14326, 66554) c5(oy, fk, CD, Ad, nb, b, an, mt, awv, BM, cz, awx, dZ, dV, as, PZ, at, u, aww, y); #c1(BTF3) c2(NP_001032726) c3(1270) c4(27384, 40441, 53498, 14327, 66555) c5(V, b, kJ, ag, w, ar, U); #c1(BTG1) c2(NP_001722) c3(1271) c4(27385, 40442, 53499, 14328, 66556) c5(cU, A, G, b, t, ajy, B, J, fO, dl, cT, jV, fy, aq, iA, awy, aV, u, h, y); #c1(BTG2) c2(NP_006754) c3(1272) c4(27386, 40443, 53500, 14329, 66557) c5(bL, A, Ir, b, pR, y, co, awA, awz, f, q, rR, NB, u, fh, ma, cV, aC, Bs, jo, T, ff, Fk, fx, jR, B, i); #c1(BTG3) c2(NP_001124386) c3(1273) c4(27387, 40444, 53501, 14330, 66558) c5(m, co, lO, b, X, B, dB, q, mW, bT, ih, pr, jo, A, j, aC, ji, av, bp, gl, ff); #c1(BTG4) c2(NP_060059) c3(1274) c4(27388, 40445, 53502, 14331, 66559) c5(V, q, cT, U, bm, yw); #c1(BTK) c2(NP_000052) c3(1275) c4(27389, 40446, 53503, 14332, 66560) c5(WH, fl, Zq, eu, w, iC, ajw, Ou, b, pp, t, h, hN, n, zQ, fy, Ry, awC, Ov, awD, gm, fO, J, CM, P, aeV, iw, awB, amJ, asM, cT, WA, fl, awE, gf, zD); #c1(BTLA) c2(NP_001078826) c3(1276) c4(27390, 40447, 53504, 14333, 66561) c5(P, m, aC, fl, rq, gm, xU, cT, gO, gE, jT, u, aE, y); #c1(BTN1A1) c2(NP_001723) c3(1277) c4(27391, 40448, 53505, 14334, 66562) c5(aC, og, f, v); #c1(BTN2A1) c2(NP_001184162) c3(1278) c4(27392, 40449, 53506, 14335, 66563) c5(m, pE, I, eX, di, bq, bf, aM); #c1(BTN2A2) c2(NP_001184166) c3(1279) c4(27393, 40450, 53507, 14336, 66564) c5(Dj); #c1(BTN3A1) c2(NP_001138480) c3(1280) c4(27394, 40451, 53508, 14337, 66565) c5(X, av); #c1(BTN3A2) c2(NP_001184175) c3(1281) c4(27395, 40452, 53509, 14338, 66566) c5(m, V, b, kJ, X, aE, ag, av, U, o); #c1(BTN3A3) c2(NP_008925) c3(1282) c4(27396, 40453, 53510, 14339, 66567) c5(V, b, kJ, awF, ag, U); #c1(BTNL2) c2(NP_001291490) c3(1283) c4(27397, 40454, 53511, 14340, 66568) c5(pM, A, vk, iU, awG, sJ, bj, oy, m, B, aaZ, qB, aV, aE, da, aC, Io, jU, jH, awH, fP, Bm, iu, bT); #c1(BTRC) c2(NP_001243785) c3(1284) c4(27398, 40455, 53512, 14341, 66569) c5(A, b, k, w, bw, U, y, co, aX, h, q, bu, u, jB, og, V, cV, bp, by, et, jR, Le, ag); #c1(80818) c2(NP_001202) c3(1285) c4(27399, 40456, 53513, 14342, 66570) c5(f, aw, iD, b, X, jj, jz, xc, w, iA, y, jQ, d, jh, co, aX, XE, jk, h, hV, e, q, bu, cU, ar, cl, cs, av, u, g, asd, V, qL, aow, gm, aiL, awl, Nh, QZ, Yn, by, jH, nV, xr, QG, aiJ, ag, cT, fl, T); #c1(BUB1) c2(NP_001265545) c3(1286) c4(27400, 40457, 53514, 14343, 66571) c5(by, A, b, X, jz, MS, w, bw, bf, U, y, jQ, co, t, h, hV, F, q, bu, ar, B, hb, cs, av, fy, u, V, el, aow, bp, J, aul, T, fO, ad, jT, nV, agQ, ie, G, ag, fl, i, Mp); #c1(8083) c2(NP_001007794) c3(1287) c4(27401, 40458, 53515, 14344, 66572) c5(V, b, fr, q, bu, fG, w, i, U, by, u, y); #c1(BUD13) c2(NP_001153208) c3(1288) c4(27402, 40459, 53516, 14345, 66573) c5(o6, A, B, I, ap); #c1(BUD31) c2(NP_003901) c3(1289) c4(27403, 40460, 53517, 14346, 66574) c5(oy, b, cG, X, f, ft, fr, av, y); #c1(BVES) c2(XP_011533700) c3(1290) c4(27404, 40461, 53518, 14347, 66575) c5(adK, q, ad, cs, U, awJ); #c1(BYSL) c2(NP_004044) c3(1291) c4(27405, 40462, 53519, 14348, 66576) c5(awK); #c1(BZRAP1) c2(NP_001248764) c3(1292) c4(27406, 40463, 53520, 14349, 66577) c5(Mr, f, cB, O, cz); #c1(BZW1) c2(NP_001193996) c3(1293) c4(27407, 40464, 53521, 14350, 66578) c5(aX); #c1(C10orf107) c2(XP_005269657) c3(1294) c4(27408, 40465, 53522, 14351, 66579) c5(oy, di); #c1(C10orf10) c2(NP_008952) c3(1295) c4(27409, 40466, 53523, 14352, 66580) c5(bL, cf, u, f, ep, w, aA, awL, eG, y); #c1(C10orf113) c2(NP_001010896) c3(1296) c4(27410, 40467, 53524, 14353, 66581) c5(bq, at); #c1(C10orf11) c2(NP_114413) c3(1297) c4(27411, 40468, 53525, 14354, 66582) c5(aw, awM, IV, at, u, y); #c1(C10orf2) c2(NP_001157284) c3(1298) c4(27412, 40469, 53526, 14355, 66583) c5(X, awR, dB, awQ, aoJ, hS, awO, kV, awU, ala, kW, cb, bj, awS, aaR, Nw, RA, oD, av, aV, aE, EX, n, awP, cV, nl, el, awN, v, awT, Q, cK, jf, kS, KW, awV, amy, KL, Y, aaz, ch, AB, he, KR, cH, zp, o, rw, T); #c1(C10orf32) c2(NP_001129672) c3(1299) c4(27413, 40470, 53527, 14356, 66584) c5(bj); #c1(C10orf35) c2(NP_660349) c3(1300) c4(27414, 40471, 53528, 14357, 66585) c5(o); #c1(C10orf54) c2(NP_071436) c3(1301) c4(27415, 40472, 53529, 14358, 66586) c5(cy); #c1(C10orf67) c2(NP_714925) c3(1302) c4(27416, 40473, 53530, 14359, 66587) c5(g, bw, sJ, jH); #c1(C10orf82) c2(NP_653262) c3(1303) c4(27417, 40474, 53531, 14360, 66588) c5(IV); #c1(C10orf88) c2(NP_079218) c3(1304) c4(27418, 40475, 53532, 14361, 66589) c5(u, O, y); #c1(C10orf90) c2(NP_001004298) c3(1305) c4(27419, 40476, 53533, 14362, 66590) c5(at, bb, b, dA); #c1(C11orf21) c2(NP_001136418) c3(1306) c4(27420, 40477, 53534, 14363, 66591) c5(cT); #c1(C11orf30) c2(NP_064578) c3(1307) c4(27421, 40478, 53535, 14364, 66592) c5(jH, nV, kF, b, X, fq, B, fP, cU, A, T, qO, cy, av, u, y); #c1(C11orf53) c2(NP_940900) c3(1308) c4(27422, 40479, 53536, 14365, 66593) c5(U, V); #c1(C11orf65) c2(NP_689800) c3(1309) c4(27423, 40480, 53537, 14366, 66594) c5(i); #c1(C11orf68) c2(NP_001129107) c3(1310) c4(27424, 40481, 53538, 14367, 66595) c5(aX); #c1(C11orf73) c2(NP_057485) c3(1311) c4(27425, 40482, 53539, 14368, 66596) c5(aX, bu); #c1(C11orf74) c2(NP_001263656) c3(1312) c4(27426, 40483, 53540, 14369, 66597) c5(Ks, qf, dA); #c1(C11orf80) c2(NP_001289013) c3(1313) c4(27427, 40484, 53541, 14370, 66598) c5(ak); #c1(C11orf87) c2(XP_011541119) c3(1314) c4(27428, 40485, 53542, 14371, 66599) c5(oy, bb); #c1(C11orf95) c2(NP_001138408) c3(1315) c4(27429, 40486, 53543, 14372, 66600) c5(awX, awW, ib); #c1(C12orf10) c2(NP_067653) c3(1316) c4(27430, 40487, 53544, 14373, 66601) c5(pV, yY, awY, qB, u, y); #c1(C12orf42) c2(NP_940923) c3(1317) c4(27431, 40488, 53545, 14374, 66602) c5(jm); #c1(C12orf43) c2(NP_001273127) c3(1318) c4(27432, 40489, 53546, 14375, 66603) c5(at); #c1(C12orf50) c2(NP_689802) c3(1319) c4(27433, 40490, 53547, 14376, 66604) c5(at); #c1(C12orf57) c2(NP_001288763) c3(1320) c4(27434, 40491, 53548, 14377, 66605) c5(aev, nU, axa, o, awZ); #c1(C12orf5) c2(NP_065108) c3(1321) c4(27435, 40492, 53549, 14378, 66606) c5(jH, fl, b, f, Ll, q, cT, w, cB, x, jM, bm, O); #c1(C12orf65) c2(NP_001181924) c3(1322) c4(27436, 40493, 53550, 14379, 66607) c5(pQ, Y, axb, awS, axe); #c1(C12orf66) c2(NP_001287869) c3(1323) c4(27437, 40494, 53551, 14380, 66608) c5(kF); #c1(C12orf75) c2(NP_001138671) c3(1324) c4(27438, 40495, 53552, 14381, 66609) c5(axd, X, av, qf, ap); #c1(C12orf77) c2(NP_001094809) c3(1325) c4(27439, 40496, 53553, 14382, 66610) c5(bq); #c1(C14orf166) c2(NP_057123) c3(1326) c4(27440, 40497, 53554, 14383, 66611) c5(g, bw); #c1(C14orf177) c2(NP_872366) c3(1327) c4(27441, 40498, 53555, 14384, 66612) c5(cO); #c1(C14orf1) c2(NP_009107) c3(1328) c4(27442, 40499, 53556, 14385, 66613) c5(ag); #c1(C15orf32) c2(NP_694585) c3(1329) c4(27443, 40500, 53557, 14386, 66614) c5(ak); #c1(C15orf41) c2(XP_011520412) c3(1330) c4(27444, 40501, 53558, 14387, 66615) c5(axe); #c1(C15orf48) c2(NP_922946) c3(1331) c4(27445, 40502, 53559, 14388, 66616) c5(d, jh, e, b); #c1(C15orf53) c2(NP_997327) c3(1332) c4(27446, 40503, 53560, 14389, 66617) c5(oy, ak, bb, A, cO); #c1(C15orf59) c2(XP_005254426) c3(1333) c4(27447, 40504, 53561, 14390, 66618) c5(A, dA); #c1(C16orf72) c2(NP_054836) c3(1334) c4(27448, 40505, 53562, 14391, 66619) c5(Eo); #c1(C16orf74) c2(NP_996850) c3(1335) c4(27449, 40506, 53563, 14392, 66620) c5(fx, i); #c1(C16orf78) c2(NP_653203) c3(1336) c4(27450, 40507, 53564, 14393, 66621) c5(Fg); #c1(C16orf95) c2(NP_001182053) c3(1337) c4(27451, 40508, 53565, 14394, 66622) c5(axf); #c1(C17orf51) c2(NP_001106905) c3(1338) c4(27452, 40509, 53566, 14395, 66623) c5(da, bj); #c1(C17orf53) c2(NP_076937) c3(1339) c4(27453, 40510, 53567, 14396, 66624) c5(aG); #c1(C17orf64) c2(NP_859058) c3(1340) c4(27454, 40511, 53568, 14397, 66625) c5(aW); #c1(C17orf96) c2(NP_001124149) c3(1341) c4(27455, 40512, 53569, 14398, 66626) c5(ac); #c1(C18orf54) c2(NP_001275909) c3(1342) c4(27456, 40513, 53570, 14399, 66627) c5(ar, auU, bb, bp); #c1(C18orf8) c2(NP_001263271) c3(1343) c4(27457, 40514, 53571, 14400, 66628) c5(dx, B, aw, b, qd, cY, w, axg, U, A, y, ajb, dv, bb, bn, f, Ll, bu, tF, O, pN, cs, u, l, aC, Mi, du, ad, aX, fx, by, ag, i, bq, aA, ap); #c1(C19orf12) c2(NP_001026896) c3(1344) c4(27458, 40515, 53572, 14401, 66629) c5(X, bN, axh, i, PE, axj, axi); #c1(C19orf18) c2(NP_689687) c3(1345) c4(27459, 40516, 53573, 14402, 66630) c5(IV); #c1(C19orf24) c2(NP_060384) c3(1346) c4(27460, 40517, 53574, 14403, 66631) c5(bq); #c1(C19orf26) c2(NP_689982) c3(1347) c4(27461, 40518, 53575, 14404, 66632) c5(axk, aop, b); #c1(C19orf33) c2(NP_277055) c3(1348) c4(27462, 40519, 53576, 14405, 66633) c5(eQ, aw, iA, jU); #c1(C19orf40) c2(NP_689479) c3(1349) c4(27463, 40520, 53577, 14406, 66634) c5(oM, f, pt); #c1(C19orf45) c2(XP_011526294) c3(1350) c4(27464, 40521, 53578, 14407, 66635) c5(F); #c1(C19orf48) c2(NP_001277083) c3(1351) c4(27465, 40522, 53579, 14408, 66636) c5(jp, fe, aX, b, h, dB, q, ad, cT, ff, cs, u, y); #c1(C19orf57) c2(NP_077299) c3(1352) c4(27466, 40523, 53580, 14409, 66637) c5(bb); #c1(C19orf68) c2(NP_955373) c3(1353) c4(27467, 40524, 53581, 14410, 66638) c5(kF); #c1(CID) c2(NP_775269) c3(1354) c4(27468, 40525, 53582, 14411, 66639) c5(dx, bL, b, aN, di, bW, y, cp, co, aX, sG, acO, ar, u, o, wo, l, du, bp, axl, dv, T, bq, dS, Bu, jd, ji, aA, at); #c1(CIGALTIC1) c2(NP_689905) c3(1355) c4(27469, 40526, 53583, 14412, 66640) c5(lp, x, JD, fl, JC); #c1(CIGALT1) c2(XP_005249869) c3(1356) c4(27470, 40527, 53584, 14413, 66641) c5(fl, b, lp, eD, ak, q, ad, ix, cs, vp, aV, et);

c1(C1orf106) c2(NP_001136041) c3(1357) c4(27471, 40528, 53585, 14414, 66642) c5(jH, fP); #c1(C1orf109) c2(NP_001289959) c3(1358) c4(27472, 40529, 53586, 14415, 66643) c5(y, u, b, nJ); #c1(C1orf110) c2(NP_848645) c3(1359) c4(27473, 40530, 53587, 14416, 66644) c5(fP, di, l, cO); #c1(C1orf112) c2(XP_005245374) c3(1360) c4(27474, 40531, 53588, 14417, 66645) c5(di, b, cp); #c1(C1orf115) c2(NP_078985) c3(1361) c4(27475, 40532, 53589, 14418, 66646) c5(ao); #c1(C1orf127) c2(XP_011539059) c3(1362) c4(27476, 40533, 53590, 14419, 66647) c5(es); #c1(C1orf141) c2(XP_011539768) c3(1363) c4(27477, 40534, 53591, 14420, 66648) c5(Bm, HQ); #c1(C1orf167) c2(XP_011539574) c3(1364) c4(27478, 40535, 53592, 14421, 66649) c5(l); #c1(C1orf204) c2(NP_001127705) c3(1365) c4(27479, 40536, 53593, 14422, 66650) c5(I); #c1(C1orf226) c2(NP_001078844) c3(1366) c4(27480, 40537, 53594, 14423, 66651) c5(c0); #c1(C1orf228) c2(XP_011539646) c3(1367) c4(27481, 40538, 53595, 14424, 66652) c5(da, m, JH, V, ae, fc, fq, fP, cy, aeR, aC, P, dQ, aE, HE, aD, aX, U, aV, aeS); #c1(C1orf27) c2(NP_001157717) c3(1368) c4(27482, 40539, 53596, 14425, 66653) c5(6); #c1(C1orf61) c2(NP_001307383) c3(1369) c4(27483, 40540, 53597, 14426, 66654) c5(bh, q, b, z); #c1(C1orf86) c2(XP_011539224) c3(1370) c4(27484, 40541, 53598, 14427, 66655) c5(oM, pt); #c1(CIQB) c2(XP_011540361) c3(1371) c4(27485, 40542, 53599, 14428, 66656) c5(m, fl, aX, pp, mW, axm, xg, jl, at, gl); #c1(CIQBP) c2(NP_001203) c3(1372) c4(27486, 40543, 53600, 14429, 66657) c5(cW, jT, co, b, cV, jd, re, q, gL, eu, gd, P, iT, gE, qH, u, y); #c1(CIQL1) c2(NP_006679) c3(1373) c4(27487, 40544, 53601, 14430, 66658) c5(bP, b, jJ, cA, bf, y, gO, bb, wr, f, cM, u, o, iF, dj, fU, cV, W, P, od, aM, aY, ih, fD, dc); #c1(CIQL3) c2(NP_001010908) c3(1374) c4(27488, 40545, 53602, 14431, 66659) c5(aA); #c1(CIQTNF1) c2(NP_112230) c3(1375) c4(27489, 40546, 53603, 14432, 66660) c5(gp, l, fN, eX, Jq, Hq, di, z, ey, dL, aA, aW); #c1(CIQTNF3) c2(NP_112207) c3(1376) c4(27490, 40547, 53604, 14433, 66661) c5(bQ, kF, I, di, cy, aA); #c1(CIQTNF5) c2(NP_001265360) c3(1377) c4(27491, 40548, 53605, 14434, 66662) c5(nQ, arg, ml, nv, oG, ard, aA, nW, aW, axn); #c1(CIQTNF6) c2(NP_872292) c3(1378) c4(27492, 40549, 53606, 14435, 66663) c5(aX, l, aC, cO, hM, qB, aA, iu, aE); #c1(CIQTNF7) c2(NP_001128642) c3(1379) c4(27493, 40550, 53607, 14436, 66664) c5(jI, aA, GF, Fg); #c1(CIQTNF9B-AS1) c2(NP_001014442) c3(1380) c4(27494, 40551, 53608, 14437, 66665) c5(A, B); #c1(CIR) c2(NP_001724) c3(1381) c4(27495, 40552, 53609, 14438, 66666) c5(eG, Xe, o); #c1(CIRL) c2(NP_001284572) c3(1382) c4(27496, 40553, 53610, 14439, 66667) c5(jI); #c1(CIS) c2(XP_005253817) c3(1383) c4(27497, 40554, 53611, 14440, 66668) c5(m, axn, jl, axp, bY, RY); #c1(C20orf194) c2(NP_001009984) c3(1384) c4(27498, 40555, 53612, 14441, 66669) c5(al, n/v); #c1(C20orf196) c2(NP_001290406) c3(1385) c4(27499, 40556, 53613, 14442, 66670) c5(aal, eO); #c1(C20orf27) c2(NP_001034229) c3(1386) c4(27500, 40557, 53614, 14443, 66671) c5(at); #c1(C20orf85) c2(NP_848551) c3(1387) c4(27501, 40558, 53615, 14444, 66672) c5(d, co, Eu, bp, ji, fy, e); #c1(C21orf2) c2(NP_001258369) c3(1388) c4(27502, 40559, 53616, 14445, 66673) c5(Pb, sL, Bx, cK, aq, o); #c1(C21orf33) c2(NP_004640) c3(1389) c4(27503, 40560, 53617, 14446, 66674) c5(bm, by, A, aw, b, k, X, jq, FL, Ty, ahV, lv, bW, axq, U, y, jR, co, aX, jd, h, B, axr, q, cc, bu, cU, fr, iZ, ar, O, pt, bw, av, u, aE, cl, da, jB, fU, V, cV, ft, cs, gm, bp, J, W, G, T, Qt, gC, ad, jG, fM, Al, jH, an, jp, aq, os, ag, oM, bV); #c1(C21orf59) c2(NP_067077) c3(1390) c4(27504, 40561, 53618, 14447, 66675) c5(MW, Pu, axs); #c1(C21orf62) c2(XP_011545334) c3(1391) c4(27505, 40562, 53619, 14448, 66676) c5(RA); #c1(C21orf91) c2(NP_001093890) c3(1392) c4(27506, 40563, 53620, 14449, 66677) c5(fl); #c1(C22orf29) c2(NP_078903) c3(1393) c4(27507, 40564, 53621, 14450, 66678) c5(co, aX, b, asx, pR, f, gm, fO, dB, cT, A, B, ji, kJ, jT, u, y); #c1(C2CD3) c2(NP_001273506) c3(1394) c4(27508, 40565, 53622, 14451, 66679) c5(ahN); #c1(C2CD4A) c2(NP_997205) c3(1395) c4(27509, 40566, 53623, 14452, 66680) c5(bf, ao, I, aM); #c1(C2CD4B) c2(NP_001007596) c3(1396) c4(27510, 40567, 53624, 14453, 66681) c5(bf, ap, l, aM); #c1(C2CD5) c2(NP_001273104) c3(1397) c4(27511, 40568, 53625, 14454, 66682) c5(ap); #c1(C2) c2(NP_000054) c3(1398) c4(27512, 40569, 53626, 14455, 66683) c5(dx, A, k, ZP, fl, arr, bf, GV, BH, axt, aW, m, BL, ml, ox, q, dW, abh, fP, aV, Uy, aE, o, da, em, rN, I, aC, du, gL, P, Jc, Io, jl, mO, RY, axu, agN, aco, iB, at, aG); #c1(C2orf16) c2(NP_115642) c3(1399) c4(27513, 40570, 53627, 14456, 66684) c5(oG); #c1(C2orf40) c2(NP_115787) c3(1400) c4(27514, 40571, 53628, 14457, 66685) c5(d, jh, il, b, ik, O, U, u, e, y); #c1(C2orf43) c2(NP_001269649) c3(1401) c4(27515, 40572, 53629, 14458, 66686) c5(oG, A, B, at); #c1(C2orf47) c2(NP_078796) c3(1402) c4(27516, 40573, 53630, 14459, 66687) c5(t); #c1(C2orf57) c2(NP_689827) c3(1403) c4(27517, 40574, 53631, 14460, 66688) c5(dA); #c1(C2orf61) c2(NP_001157033) c3(1404) c4(2751B, 40575, 53632, 14461, 66689) c5(dA); #c1(C3AR1) c2(NP_004045) c3(1405) c4(27519, 40576, 53633, 14462, 66690) c5(mZ, ma, cy, JX, aF, gd, ti, fl, aZ, l, jl, aA, aV, aW); #c1(C3) c2(NP_000055) c3(1406) c4(27520, 40577, 53634, 14463, 66691) c5(dx, eX, axx, oz, DT, Ka, eC, sJ, bW, fR, eD, dv, cy, t, fP, nv, dl, Uy, gl, axB, aC, sH, du, aB, MO, aw, eH, fc, ag, axC, bq, qD, wa, fl, X, Kc, ma, vp, GV, vl, y, pp, DM, B, JX, av, Bs, gv, Fy, axw, aA, eF, aY, P, akT, Xe, axz, aE, DJ, au, xg, bb, dW, u, aE, o, fh, da, kF, I, el, awD, ad, G, ao, hU, mA, gd, ay, ri, th, IA, axv, k, UA, mW, axA, vZ, bc, bj, aW, m, jl, sG, fq, az, iZ, axy, Ek, aV, ax, nQ, be, dB, jo, ti, T, nk, agl, lc, arr, HM, Dl, agN, at, eG); #c1(C3orf17) c2(NP_056227) c3(1407) c4(27521, 40578, 53635, 14464, 66692) c5(o, ap); #c1(C3orf18) c2(NP_001165212) c3(1408) c4(27522, 40579, 53636, 14465, 66693) c5(P); #c1(C3orf20) c2(NP_001171887) c3(1409) c4(27523, 40580, 53637, 14466, 66694) c5(bj); #c1(C3orf35) c2(NP_848029) c3(1410) c4(27524, 40581, 53638, 14467, 66695) c5(fU, aw, b, F, u, y); #c1(C3orf56) c2(NP_001007535) c3(1411) c4(27525, 40582, 53639, 14468, 66696) c5(o); #c1(C3orf58) c2(NP_001127942) c3(1412) c4(27526, 40583, 53640, 14469, 66697) c5(A, aX, b, Wk, nU, J, cz, axD, bq, dh); #c1(C3orf67) c2(NP_940865) c3(1413) c4(27527, 40584, 53641, 14470, 66698) c5(hR, bb, o); #c1(C3orf79) c2(NP_001094807) c3(1414) c4(27528, 40585, 53642, 14471, 66699) c5(afZ, cy); #c1(C4A) c2(NP_001239133) c3(1415) c4(27529, 40586, 53643, 14472, 66700) c5(VK, id, pV, Jo, gn, mW, axH, bf, eD, m, Fp, bb, pp, IS, oB, q, dl, JX, qB, dH, bm, gl, o, NO, da, axE, I, dA, aC, afh, gL, cz, Jc, xd, bq, wA, cy, afj, aM, axG, hU, bY, vT, aE, axF, l, bh, jl, iu, bT, ap); #c1(C4B_2) c2(NP_001229752) c3(1416) c4(27530, 40587, 53644, 14473, 66701) c5(id, pV, Jo, gn, mW, axH, bf, IS, m, Fp, bb, oB, q, qB, bm, gl, o, NO, da, axE, l, aC, afh, cz, wA, afj, aM, axG, hU, bY, vT, aE, axF, bq, iu, bT, ap); #c1(C4B) c2(NP_001002029) c3(1417) c4(27531, 40588, 53645, 14474, 66702) c5(id, pV, Jo, gn, mW, axH, bf, IS, El, Fp, bb, oB, q, dl, JX, qB, bm, gl, o, NO, da, axE, l, m, aC, afh, cz, wA, afj, be, aM, axG, hU, bY, vT, aE, axF, bq, iu, bT, ap); #c1(C4BPA) c2(XP_005273308) c3(1418) c4(27532, 40589, 53646, 14475, 66703) c5(en, kE, axl, eR, kB, ix, ku, iL, U, y, jh, jl, aW, kr, kk, iv, fy, u, ans, Xx, J, kp, dt, P, bp, BW, eJ, ks, hT, eo, kC, qD, kK); #c1(C4BPB) c2(NP_001017365) c3(1419) c4(27533, 40590, 53647, 14476, 66704) c5(jl, eR, dt, ix, YT, fy, aW); #c1(C4orf22) c2(NP_001193926) c3(1420) c4(27534, 40591, 53648, 14477, 66705) c5(oy, gf); #c1(C4orf26) c2(NP_001193910) c3(1421) c4(27535, 40592, 53649, 14478, 66706) c5(Ur, axJ); #c1(C4orf27) c2(NP_060337) c3(1422) c4(27536, 40593, 53650, 14479, 66707) c5(fl); #c1(C4orf32) c2(NP_689613) c3(1423) c4(27537, 40594, 53651, 14480, 66708) c5(I); #c1(C4orf33) c2(NP_001093253) c3(1424) c4(27538, 40595, 53652, 14481, 66709) c5(oy, di, aA, at, bb); #c1(C4orf36) c2(XP_011529917) c3(1425) c4(27539, 40596, 53653, 14482, 66710) c5(ao); #c1(C4orf48) c2(NP_001135408) c3(1426) c4(27540, 40597, 53654, 14483, 66711) c5(axK); #c1(C4orf51) c2(XP_011530499) c3(1427) c4(27541, 40598, 53655, 14484, 66712) c5(bb); #c1(C5AR1) c2(NP_001727) c3(1428) c4(27542, 40599, 53656, 14485, 66713) c5(fl, b, aE, aN, eC, xb, wf, al, aK, ey, aW, co, cy, aej, ml, f, q, axL, hN, ajJ, fy, nA, ky, Hs, bm, dh, o, ma, aC, sB, jU, lC, zl, ll, aZ, jl, JN, et, be, ao, axM, iV, gd, I, aA, axN, gl); #c1(C5AR2) c2(NP_001258679) c3(1429) c4(27543, 40600, 53657, 14486, 66714) c5(l, eH, Fy, aA, at, jU); #c1(C5) c2(NP_001726) c3(1430) c4(27544, 40601, 53658, 14487, 66715) c5(dx, jl, fl, aE, Ka, sJ, Pl, al, aW, m, bb, pp, DM, f, q, dl, hN, ajJ, jU, nA, ky, Hs, dh, ri, fh, ma, l, aC, Bs, du, ajl, ti, ll, cy, JN, be, dH, axN, Eb, axO, agl, mE, aE, Dl, dX, bh, at, eG, gf, axG, gl); #c1(C5orf22) c2(NP_060826) c3(1431) c4(27545, 40602, 53659, 14488, 66716) c5(ao); #c1(C5orf30) c2(NP_149988) c3(1432) c4(27546, 40603, 53660, 14489, 66717) c5(aC); #c1(C5orf34) c2(NP_940968) c3(1433) c4(27547, 40604, 53661, 14490, 66718) c5(at); #c1(C5orf38) c2(NP_001281266) c3(1434) c4(27548, 40605, 53662, 14491, 66719) c5(ao, bb, cO); #c1(C5orf42) c2(NP_075561) c3(1435) c4(27549, 40606, 53663, 14492, 66720) c5(axQ, axP); #c1(C5orf63) c2(NP_001157950) c3(1436) c4(27550, 40607, 53664, 14493, 66721) c5(IV); #c1(C6) c2(NP_000056) c3(1437) c4(27551, 40608, 53665, 14494, 66722) c5(hU, axS, xu, vd, aE, axR, gL, sU, fD, jl, mm, eV, aW); #c1(C6orf106) c2(NP_073595) c3(1438) c4(27552, 40609, 53666, 14495, 66723) c5(xr); #c1(C6orf10) c2(XP_011512542) c3(1439) c4(27553, 40610, 53667, 14496, 66724) c5(pM, da, at, cy, l, m, aC, aV, aE, di, hR, iu, bT, dH); #c1(C6orf15) c2(NP_054789) c3(1440) c4(27554, 40611, 53668, 14497, 66725) c5(aC, m, ix, Bm); #c1(C6orf25) c2(NP_079536) c3(1441) c4(27555, 40612, 53669, 14498, 66726) c5(jH, qt, aoR, m, mW, aE, gE, bb, gl); #c1(C6orf47) c2(NP_067007) c3(1442) c4(27556, 40613, 53670, 14499, 66727) c5(aC, m, aE); #c1(C6orf48) c2(NP_001274413) c3(1443) c4(27557, 40614, 53671, 14500, 66728) c5(m); #c1(C6orf89) c2(NP_001273564) c3(1444) c4(27558, 40615, 53672, 14501, 66729) c5(bq, at, eX, dS); #c1(C7) c2(NP_000578) c3(1445) c4(27559, 40616, 53673, 14502, 66730) c5(eC, jl, aw, axT, CM, pW, cO, bq, aV, aW); #c1(C7orf49) c2(NP_001230683) c3(1446) c4(27560, 40617, 53674, 14503, 66731) c5(gL); #c1(C7orf57) c2(NP_001254795) c3(1447) c4(27561, 40618, 53675, 14504, 66732) c5(ao); #c1(C7orf60) c2(NP_689769) c3(1448) c4(27562, 40619, 53676, 14505, 66733) c5(aIF); #c1(C7orf62) c2(XP_011514206) c3(1449) c4(27563, 40620, 53677, 14506, 66734) c5(bq, bb, cp); #c1(C7orf65) c2(NP_001116537) c3(1450) c4(27564, 40621, 53678, 14507, 66735) c5(bq, o); #c1(C7orf69) c2(NP_079307) c3(1451) c4(27565, 40622, 53679, 14508, 66736) c5(Bm); #c1(C7orf72) c2(NP_001155306) c3(1452) c4(27566, 40623, 53680, 14509, 66737) c5(m, o); #c1(C8orf34) c2(NP_001182568) c3(1453) c4(27567, 40624, 53681, 14510, 66738) c5(oy, bq); #c1(C8orf37) c2(NP_808880) c3(1454) c4(27568, 40625, 53682, 14511, 66739) c5(axU, nR, bq, aW, cO); #c1(C8orf46) c2(NP_689978) c3(1455) c4(27569, 40626, 53683, 14512, 66740) c5(et); #c1(C8orf48) c2(NP_001007091) c3(1456) c4(27570, 40627, 53684, 14513, 66741) c5(oy, o, eO); #c1(C8orf4) c2(NP_064515) c3(1457) c4(27571, 40628, 53685, 14514, 66742) c5(by, nV, Qm, hV, bu, cs, jG, ad, u, y); #c1(C8orf86) c2(NP_997295) c3(1458) c4(27572, 40629, 53686, 14515, 66743) c5(bj); #c1(C9) c2(NP_001728) c3(1459) c4(27573, 40630, 53687, 14516, 66744) c5(BL, pp, axV, axX, bj, ajl, q, agl, Wf, jl, axW, eG, jZ, aW); #c1(C9orf106) c2(NP_001012733) c3(1460) c4(27574, 40631, 53688, 14517, 66745) c5(bq); #c1(C9orf135) c2(NP_001010940) c3(1461) c4(27575, 40632, 53689, 14518, 66746) c5(Ks); #c1(C9orf152) c2(NP_001013011) c3(1462) c4(27576, 40633, 53690, 14519, 66747) c5(bq); #c1(C9orf156) c2(NP_057565) c3(1463) c4(27577, 40634, 53691, 14520, 66748) c5(da, aw, uj, aF, ui, Nq, Ns, amU, o); #c1(C9orf170) c2(NP_001001709) c3(1464) c4(27578, 40635, 53692, 14521, 66749) c5(fP, hW); #c1(C9orf171) c2(NP_001269886) c3(1465) c4(27579, 40636, 53693, 14522, 66750) c5(bq, cO); #c1(C9orf3) c2(NP_001180260) c3(1466) c4(27580, 40637, 53694, 14523, 66751) c5(sX, an); #c1(C9orf43) c2(NP_001265558) c3(1467) c4(27581, 40638, 53695, 14524, 66752) c5(Ns, Nq); #c1(C9orf66) c2(NP_689782) c3(1468) c4(27582, 40639, 53696, 14525, 66753) c5(c0); #c1(C9orf72) c2(NP_060795) c3(1469) c4(27583, 40640, 53697, 14526, 66754) c5(acE, nU, aw, bS, ayb, ul, ak, ai, bj, oy, avH, Vr, f, ayd, aye, tF, aya, aaR, zo, aye, OA, aV, o, hW, aC, Ue, GS, axY, v, bN, Ql, aj, jv, hw, axZ, ao, xM, Tq, PY, he, at); #c1(C9orf85) c2(NP_872311) c3(1470) c4(27584, 40641, 53698, 14527, 66755) c5(oy); #c1(C9orf91) c2(NP_694590) c3(1471) c4(27585, 40642, 53699, 14528, 66756) c5(Bm); #c1(C9orf9) c2(NP_061829) c3(1472) c4(27586, 40643, 53700, 14529, 66757) c5(Xq, bk, oE); #c1(CA10) c2(NP_001076003) c3(1473) c4(27587, 40644, 53701, 14530, 66758) c5(bb, dA, GF, fM, gO, bq, aA, u, y, cp); #c1(CA11) c2(NP_001208) c3(1474) c4(27588, 40645, 53702, 14531, 66759) c5(b, cV, re, KL, bu, iT, fM, by, u, y); #c1(CA12) c2(NP_001209) c3(1475) c4(27589, 40646, 53703, 14532, 66760) c5(nV, aw, b, k, Be, ayf, er, dB, q, afn, iU, ayg, iT, cO, bb, u, re, y): #c1(CA13) c2(NP_940986) c3(1476) c4(27590, 40647, 53704, 14533, 66761) c5(V, aC, fO, aW, U, u, y); #c1(CA1) c2(XP_011515886) c3(1477) c4(27591, 40648, 53705, 14534, 66762) c5(jh, ar, V, jH, aC, bu, T, cs, wf, Oi, mY, ad, et, U, ii); #c1(CA2) c2(NP_000058) c3(1478) c4(27592, 40649, 53706, 14535, 66763) c5(nU, b, gw, jt, bn, bV, hw, bu, pz, cp, yg, dN, iR, ni, fq, KA, f, q, ayi, es, cU, ar, qY, fv, pP, aE, o, jH, da, jh, aC, akd, ayh, gY, dt, fx, et, aoO, W, dO, OR, dS, aq, DR, hT, kh, jR, ag, bk, i, at, eG, zl, ap); #c1(CA3) c2(NP_005172) c3(1479) c4(27593, 40650, 53707, 14536, 66764) c5(gK, jE, gt, c, q, bq, aA, bm); #c1(CA4) c2(NP_000708) c3(1480) c4(27594, 40651, 53708, 14537, 66765) c5(sS, X, DR, f, dB, ea, nW, yn, ml, x, av, ayj); #c1(CA5A) c2(NP_001730) c3(1481) c4(27595, 40652, 53709, 14538, 66766) c5(ayk, ak, b, jg, er, rn, pg); #c1(CA6) c2(XP_011540385) c3(1482) c4(27596, 40653, 53710, 14539, 66767) c5(aym, V, kC, ku, ayl, yo, rZ); #c1(CA8) c2(NP_004047) c3(1483) c4(27597, 40654, 53711, 14540, 66768) c5(MW, aX, V, b, ja, nU, cK, ad, W, mR, cl, cs, x, ar, U, fy, kS, ayn, adT, cp); #c1(CAB39) c2(NP_001124322) c3(1484) c4(27598, 40655, 53712, 14541, 66769) c5(MS, fl, O, b); #c1(CAB39L) c2(NP_001274268) c3(1485) c4(27599, 40656, 53713, 14542, 66770) c5(bw, jL); #c1(CABIN1) c2(NP_036427) c3(1486) c4(27600, 40657, 53714, 14543, 66771) c5(ayo, ao, gE, aw, X, fq, dD, be, q, vQ, ER, T, y, fD, cO, di, av, Hs, u, fY, gO); #c1(CABLES1) c2(NP_001094089) c3(1487) c4(27601, 40658, 53715, 14544, 66772) c5(bb, V, b, YE, cs, ad, cU, X, Qt, x, U, av); #c1(CABP2) c2(NP_057450) c3(1488) c4(27602, 40659, 53716, 14545, 66773) c5(cV, ayp); #c1(CABP4) c2(NP_001287824) c3(1489) c4(27603, 40660, 53717, 14546, 66774) c5(ayr, ml, ayq, cV); #c1(CABS1) c2(NP_149113) c3(1490) c4(27604, 40661, 53718, 14547, 66775) c5(bq); #c1(CABYR) c2(NP_036321) c3(1491) c4(27605, 40662, 53719, 14548, 66776) c5(g, co, ck, b); #c1(CACNA1A) c2(NP_001120693) c3(1492) c4(27606, 40663, 53720, 14549, 66777) c5(vf, ak, aw, hY, Id, akB, hS, A, aqX, Nw, aks, fx, Up, auC, akV, nQ, zo, sG, kV, nU, B, Pn, ayt, bj, bK, RA, CG, EX, adf, Ir, KU, si, Kx, alX, ayv, nI, nW, ayy, Iq, akr, v, dt, akq, zk, akw, bp, ayx, rw, yH, bN, kS, KL, ayw, ayr, ays, akz, ayu, mE, eo, vW, zp, o, i, XX, bM, dR); #c1(CACNA1B) c2(NP_000709) c3(1493) c4(27607, 40664, 53721, 14550, 66778) c5(W, Fw, ac); #c1(CACNA1C) c2(NP_000710) c3(1494) c4(27608, 40665, 53722, 14551, 66779) c5(dx, nU, b, TQ, xc, FE, Ak, di, ak, cA, xw, cM, vW, qf, atj, bb, pp, sG, ayB, wr, f, ajW, do, vu, ky, Jm, dj, vR, hW, KH, l, bK, Fw, du, qs, gL, cz, dt, CM, lj, hR, AP, mO, sK, rQ, ayA, ayz, gZ, cf, mM, he, ih, aY, fP, dc, arL, bq, Wd, dR); #c1(CACNA10) c2(NP_000711) c3(1495) c4(27609, 40666, 53723, 14552, 66780) c5(de, qs, vR, Fz, l, Fw, MO, AA, W, ayD, mD, di, ey, oN, mO, ayC); #c1(CACNA1E) c2(NP_000712) c3(1496) c4(27610, 40667, 53724, 14553, 66781) c5(mz, vR, l, p, vf, vW); #c1(CACNA1F) c2(NP_001243718) c3(1497) c4(27611, 40668, 53725, 14554, 66782) c5(k, ayE, w, dV, rc, ml, ayF, ayG, awS, Jm, ayH, ayl, ayJ, nW, KU, dZ, pk, ayz, ayr, Bu, dR, Ik); #c1(CACNA1G) c2(NP_001243253) c3(1498) c4(27612, 40669, 53726, 14555, 66783) c5(aw, V, b, hY, nU, Id, bu, W, hS, cz, l, aE, ar, ad, CG, Eg); #c1(CACNA1H) c2(NP_001005407) c3(1499) c4(27613, 40670, 53727, 14556, 66784) c5(dx, W, A, hY, ayK, Fw, du, hn, Id, cz, yp, hS, rQ, di, B, ayL, u, CG); #c1(CACNA11) c2(NP_066919) c3(1500) c4(27614, 40671, 53728, 14557, 66785) c5(qf); #c1(CACNA1S) c2(NP_000060) c3(1501) c4(27615, 40672, 53729, 14558, 66786) c5(ayQ, ao, ayP, ayN, ayM, Ho, eI, lw, ayz, vR, akL, Ij, cO, Eh, Jm, dR, ayO, IZ, xl); #c1(CACNA2D1) c2(NP_000713) c3(1502) c4(27616, 40673, 53730, 14559, 66787) c5(oy, at, dA, mM, ajW, alM, x, Jm, dR); #c1(CACNA2D2) c2(NP_001005505) c3(1503) c4(27617, 40674, 53731, 14560, 66788) c5(g, co, u, IC, kS, re, Id, O, fy, bp, ayR, y); #c1(CACNA2D3) c2(NP_060868) c3(1504) c4(2761B, 40675, 53732, 14561, 66789) c5(jh, ayS, b, bu, eO, ayT, bq, by, u, y); #c1(CACNA2D4) c2(NP_758952) c3(1505) c4(27619, 40676, 53733, 14562, 66790) c5(hW, ayr, ayU, ak, vu, ml); #c1(CACNB1) c2(NP_000714) c3(1506) c4(27620, 40677, 53734, 14563, 66791) c5(u); #c1(CACNB2) c2(NP_000715) c3(1507) c4(27621, 40678, 53735, 14564, 66792) c5(oy, ayV, bb, ak, mM, bu, vW, do, rQ, di, ajW, cz); #c1(CACNB3) c2(NP_000716) c3(1508) c4(27622, 40679, 53736, 14565, 66793) c5(ak, l, mO); #c1(CACNB4) c2(NP_000717) c3(1509) c4(27623, 40680, 53737, 14566, 66794) c5(hY, yH, ayW, akB, hS, jr, XX, CG); #c1(CACNG2) c2(NP_006069) c3(1510) c4(27624, 40681, 53738, 14567, 66795) c5(b, ak, EE, hS, gR, ayX, alV); #c1(CACNG3) c2(NP_006530) c3(1511) c4(27625, 40682, 53739, 14568, 66796) c5(hS, jV, ayY, Id, aW); #c1(CACNG4) c2(NP_055220) c3(1512) c4(27626, 40683, 53740, 14569, 66797) c5(aV); #c1(CACNG5) c2(XP_011522915) c3(1513) c4(27627, 40684, 53741, 14570, 66798) c5(ayZ); #c1(CACNG6) c2(NP_114103) c3(1514) c4(27628, 40685, 53742, 14571, 66799) c5(cy); #c1(CACOL1) c2(NP_722517) c3(1515) c4(27629, 40686, 53743, 14572, 66800) c5(cW, by, cy, V, b, Be, nz, f, fO, es, apG, ar, o, U, bu, u, re, y); #c1(CACYBP) c2(NP_001007215) c3(1516) c4(27630, 40687, 53744, 14573, 66801) c5(by, cK, dB, ad, ag, jo, ff, cs, bw, O, bu, u, bq, y); #c1(CAD) c2(NP_004332) c3(1517) c4(27631, 40688, 53745, 14574, 66802) c5(dx, bL, id, b, eR, eH, vY, A, di, C, bW, U, VX, y, dv, bb, q, jV, pP, cM, Da, akk, u, tE, bm, V, I, sj, xf, du, aza, bp, P, ZF, aah, nV, qt, gt, dS, aY, ch, ZL, vK, Af, fz, dc, bq, at, ap); #c1(CADM1) c2(NP_001091987) c3(1518) c4(27632, 40689, 53746, 14575, 66803) c5(GD, nU, aw, b, fH, aF, EM, iP, jz, A, Iv, O, ji, U, jQ, adr, e, y, Zz, d, tp, co, aX, kJ, jd, azb, h, f, q, bu, azc, Xi, rR, ar, fy, u, iT, fU, azd, V, cV, jL, bp, cz, do, T, Xj, jl, fx, jT, fv, akG, jE, rQ, ale, ck, bm, DO, jh, jR, ag, fJ, i, dc, Ez, eG, re); #c1(CADM2) c2(NP_001161146) c3(1519) c4(27633, 40690, 53747, 14576, 66804) c5(jH, A, aw, b, dA, Jt, hT, q, B, aA, at); #c1(CADM3) c2(NP_001120645) c3(1520) c4(27634, 40691, 53748, 14577, 66805) c5(O, A, B, b); #c1(CADM4) c2(NP_660339) c3(1521) c4(27635, 40692, 53749, 14578, 66806) c5(A, b, pR, B, bp, O); #c1(CADPS2) c2(NP_001009571) c3(1522) c4(27636, 40693, 53750, 14579, 66807) c5(hT, hW, nU, cz, hS, rQ, bb, IV); #c1(CADPS) c2(NP_003707) c3(1523) c4(27637, 40694, 53751, 14580, 66808) c5(A, B, ix, o, aze, ac); #c1(CAGE1) c2(NP_001164163) c3(1524) c4(27638, 40695, 53752, 14581, 66809) c5(ar, T); #c1(CALB1) c2(NP_004920) c3(1525) c4(27639, 40696, 53753, 14582, 66810) c5(lr, ak, aw, si, bj, hg, dB, an, jR, v, od, it, ff, qq, hW, et, o); #c1(CALB2) c2(NP_001731) c3(1526) c4(27640, 40697, 53754, 14583, 66811) c5(fi, azg, ar, V, b, iP, NC, PY, ad, cA, oi, T, iG, cs, x, asg, U, azf, rn); #c1(CALCA) c2(NP_001029125) c3(1527) c4(27641, 40698, 53755, 14584, 66812) c5(ak, aw, yz, HC, bn, zC, adt, bf, oE, aK, e, cp, DE, t, DB, jq, Gw, fe, bK, sH, cs, fO, Iq, bp, azo, ahO, od, x, jT, gg, EZ, fy, Vb, cT, rt, mD, aA, X, ahS, jB, hS, dV, IW, U, azq, y, co, rY, B, N, HE, vQ, dZ, iv, av, azp, azi, SA, V, n, hi, alM, YP, mF, pi, W, nc, aG, hV, b, aF, A, yU, azk, azn, d, zJ, jd, nU, q, dQ, RF, ar, yW, u, dh, ff, l, Fb, gL, cz, G, wx, auA, MO, jG, jU, azh, jH, nV, ch, iq, aE, fg, D, QU, Qv, azm, gU, fr, azj, di, ft, bj, eh, m, qs, VD, sG, fq, h, yx, Aq, M, Pm, aq, dj, fU, hW, cV, Be, be, J, dt, azl, jo, ti, T, Bg, pw, nP, Ap, aM, wU, QN, ale, TU, Ic, MP, vW, Yv, iB, gl); #c1(CALCB) c2(NP_000719) c3(1528) c4(27642, 40699, 53756, 14585, 66813) c5(nP); #c1(CALCOCO1) c2(NP_001137154) c3(1529) c4(27643, 40700, 53757, 14586, 66814) c5(wX, FG, u, cO); #c1(CALCOCO2) c2(NP_001248319) c3(1530) c4(27644, 40701, 53758, 14587, 66815) c5(BV, ll, cV, bT); #c1(CALCR) c2(NP_001158209) c3(1531) c4(27645, 40702, 53759, 14588, 66816) c5(B, aw, b, k, X, QG, dD, ako, A, yU, cO, vl, fx, y, cp, co, vR, zJ, re, f, bu, av, fy, u, o, ax, cV, nz, fl, cx, fO, ad, I, P, vM, nP, by, dH, azr, Oi, iT, i, bg, iB, D, nc); #c1(CALCRL) c2(NP_005786) c3(1532) c4(27646, 40703, 53760, 14589, 66817) c5(qs, vR, sr, b, aC, hg, md, cz, od, ag, azs, w, T, aA, gj, di, av, at, dh); #c1(CALD1) c2(NP_004333) c3(1533) c4(27647, 40704, 53761, 14590, 66818) c5(dx, id, b, eR, eH, vY, A, di, C, O, hW, U, y, aoa, BO, dv, bb, f, q, jV, bu, ZB, tE, cs, oD, akk, u, aE, V, I, aC, sj, xf, du, BG, cM, ad, dU, P, bp, ZF, by, et, fM, aah, nV, iK, dS, aY, ch, cf, pD, vK, ZL, fz, dc, bq, at, ap); #c1(CALHM1) C2(NP_001001412) c3(1534) c4(27648, 40705, 53762, 14591, 66819) c5(gk, iZ, o); #c1(CALHM2) c2(XP_006717946) c3(1535) c4(27649, 40706, 53763, 14592, 66820) c5(o); #c1(CALHM3) c2(NP_001123214) c3(1536) c4(27650, 40707, 53764, 14593, 66821) c5(e); #c1(CALM2) c2(NP_001734) c3(1537) c4(27651, 40708, 53765, 14594, 66822) c5(ml, le, dB, w, dd, cO, e, O, cp, jT, cy, qc, azu, iZ, oJ, og, ado, aC, cs, fO, Yl, FW, fx, hR, xx, mO, wh, qt, hx, ag, cT, bk, i, dc, hM, aA, cY, dE, lW, cM, co, f, acT, B, iv, av, fy, iT, is, v, iy, azw, ayz, aY, P, fw, jd, ap, gG, b, Pv, ajW, arL, d, bb, jF, rl, re, q, X, mL, ar, ff, Jm, jG, u, fh, iP, fs, I, Dg, sf, rw, iD, Xl, azy, hX, ih, azt, A, k, pR, jc, di, jR, hP, SD, qs, aX, h, oE, M, azv, azx, y, fU, cV, J, W, jo, T, nP, sK, agw, jN, at); #c1(CALML3) c2(NP_005176) c3(1538) c4(27652, 40709, 53766, 14595, 66823) c5(azz, fr, Nq, ft, Ns, amS, amR); #c1(CALML5) c2(NP_059118) c3(1539) c4(27653, 40710, 53767, 14596, 66824) c5(da, mk); #c1(CALN1) c2(NP_001017440) c3(1540) c4(27654, 40711, 53768, 14597, 66825) c5(by, bu); #c1(CALR3) c2(NP_659483) c3(1541) c4(27655, 40712, 53769, 14598, 66826) c5(azA); #c1(CALR) c2(NP_004334) c3(1542) c4(27656, 40713, 53770, 14599, 66827) c5(f, pV, dD, w, cO, aw, pz, Na, O, mR, kX, gl, aC, nz, yO, cV, x, fx, jv, xO, Yw, ag, cT, i, cY, mk, aer, bo, U, Oh, y, V, pp, yE, fF, ak, N, vQ, bu, B, cs, av, iT, yJ, iF, rN, gv, azD, cl, azC, iu, pv, b, azB, Og, yK, jh, eA, re, k, g, mL, ar, as, u, il, qA, ad, pF, et, agQ, eQ, Zl, he, fg, fl, A, vd, mW, ako, m, aX, h, azE, auh, qB, sH, dj, hW, Eg, an, J, W, P, T, bh, by, qp, azG, Oi, at, azF); #c1(CAL0) c2(NP_001124146) c3(1543) c4(27657, 40714, 53771, 14600, 66828) c5(yJ, dx, dv, b, aaP, du, ad, w, fy, cs, ji, mm, at); #c1(CALY) c2(NP_056537) c3(1544) c4(27658, 40715, 53772, 14601, 66829) c5(GN); #c1(CAMK1D) c2(NP_065130) c3(1545) c4(27659, 40716, 53773, 14602, 66830) c5(qf, A, I, b, P, BY, do, bf, aA, u, y, ap); #c1(CAMK1G) c2(NP_065172) c3(1546) c4(27660, 40717, 53774, 14603, 66831) c5(ao); #c1(CAMK1) c2(NP_003647) c3(1547) c4(27661, 40718, 53775, 14604, 66832) c5(A, B, jR, fy, u, y); #c1(CAMK2A) c2(NP_057065) c3(1548) c4(27662, 40719, 53776, 14605, 66833) c5(d, ak, fr, nU, dd, Xt, e, o); #c1(CAMK2B) c2(NP_001211) c3(1549) c4(27663, 40720, 53777, 14606, 66834) c5(to, aX, cY, eX, acT, dd, jN, O); #c1(CAMK2D) c2(NP_001212) c3(1550) c4(27664, 40721, 53778, 14607, 66835) c5(kF, hS, Io, cO, bb, av, at); #c1(CAMK2G) c2(NP_001213) c3(1551) c4(27665, 40722, 53779, 14608, 66836) c5(M, o); #c1(CAMK4) c2(NP_001735) c3(1552) c4(27666, 40723, 53780, 14609, 66837) c5(oy, ih, HI, NT, Yk, wn, X, mW, Eo, mk, do, dd, pD, vp, m, gl); #c1 (CAMKK1) c2(NP_757343) c3(1553) c4(27667, 40724, 53781, 14610, 66838) c5(bK, co, b); #c1(CAMKK2) c2(NP_001257414) c3(1554) c4(27668, 40725, 53782, 14611, 66839) c5(mz, A, X, ak, eu, ih, B, azH, av, aA, aO, cp); #c1(CAMKMT) c2(NP_079042) c3(1555) c4(27669, 40726, 53783, 14612, 66840) c5(f, b, X, iP, dB, jc, w, hM, IW, O, azJ, A, e, y, d, azl, qf, aX, qc, ak, q, cY, cM, av, u, oJ, is, fU, cV, Dg, fO, W, jo, T, ff, cy, fx, jT, xx, jG, wh, qt, azy, aY, P, B, jd, i, dc); #c1(CAMLG) c2(NP_001736) c3(1556) c4(27670, 40727, 53784, 14613, 66841) c5(dx, aX, b, h, du, J, jT, u, y); #c1(CAMP) c2(NP_004336) c3(1557) c4(27671, 40728, 53785, 14614, 66842) c5(dx, by, hV, JH, b, X, aF, eu, Em, mk, A, ku, XR, Al, O, G, y, m, xT, LS, dv, t, h, Si, bu, M, hN, ajJ, B, JX, cs, mR, av, u, da, Zz, lb, Kr, du, J, gL, ad, bR, wL, co, azL, aZ, ar, cy, BV, pi, azK, qe, azM, ata, nV, EZ, ag, P, ajv, kC, bk, fq, I, ael, bp, iu, bX); #c1(CAMSAP1) c2(NP_056262) c3(1558) c4(27672, 40729, 53786, 14615, 66843) c5(Ez, b); #c1(CAMSAP2) c2(NP_001284636) c3(1559) c4(27673, 40730, 53787, 14616, 66844) c5(hS); #c1(CAMTA1) c2(XP_011539388) c3(1560) c4(27674, 40731, 53788, 14617, 66845) c5(at, bb, I, cV, nO, Fs, w, cO, azN, azO, O); #c1(CAND1) c2(NP_060918) c3(1561) c4(27675, 40732, 53789, 14618, 66846) c5(A, b, B, Eo, ar, cp); #c1(CAND2) c2(NP_001155971) c3(1562) c4(27676, 40733, 53790, 14619, 66847) c5(Yj); #c1(CANT1) c2(XP_005257079) c3(1563) c4(27677, 40734, 53791, 14620, 66848) c5(dx, azP, kW, bK, du, v, KX, kV, cq); #c1(CANX) c2(XP_011532966) c3(1564) c4(27678, 40735, 53792, 14621, 66849) c5(dx, fl, pV, b, cG, cY, azB, yz, ea, kY, bf, y, iy, dv, aX, kn, re, f, F, qB, u, iT, pE, asQ, nQ, nW, du, fO, cl, aiy, Y, cT, at); #c1(CAP1) c2(XP_011538812) c3(1565) c4(27679, 40736, 53793, 14622, 66850) c5(A, b, Ku, gE, al, U, y, cp, awa, cy, aej, uj, f, q, B, u, si, V, I, ui, fl, Dp, P, T, dP, bm, awb, avZ); #c1(CAP2) c2(NP_006357) c3(1566) c4(27680, 40737, 53794, 14623, 66851) c5(sE, q, aW); #c1(CAPG) c2(NP_001243069) c3(1567) c4(27681, 40738, 53795, 14624, 66852) c5(bP, aw, b, dD, eO, dB, eR, cO, oU, y, Hg, h, f, bu, sL, mg, aW, iv, oD, Hs, u, fp, o, qb, Dg, be, by, P, II, cV, ar, Ut, kU, fU, ji, gD); #c1(CAPN10) c2(NP_075571) c3(1568) c4(27682, 40739, 53796, 14625, 66853) c5(dx, GD, nU, aw, jv, mz, dD, rd, A, di, bw, wf, bf, U, ey, aW, qs, bQ, f, bu, afH, afF, cs, o, rR, em, kF, V, I, sH, du, cx, vF, GB, Fy, dv, T, eX, gF, by, aM, ch, agc, MP, mA, bk, azQ, aA, at, fD, ap); #c1(CAPN13) c2(NP_653176) c3(1569) c4(27683, 40740, 53797, 14626, 66854) c5(di); #c1(CAPN14) c2(NP_001138594) c3(1570) c4(27684, 40741, 53798, 14627, 66855) c5(akm, zE); #c1(CAPN1) c2(XP_011543594) c3(1571) c4(27685, 40742, 53799, 14628, 66856) c5(d, c, A, aX, I, n/v, tl, kV, e, o); #c1 (CAPN2) c2(NP_001139540) c3(1572) c4(27686, 40743, 53800, 14629, 66857) c5(c, bj, h, v, cT, u, y); #c1(CAPN3) c2(NP_000061) c3(1573) c4(27687, 40744, 53801, 14630, 66858) c5(azR, afE, Ir, b, gw, EM, rO, AA, azT, aiE, bf, Pl, xl, aX, oB, q, cc, arh, oD, bo, atW, kG, I, nl, dt, bb, aM, Rz, VQ, cT, Au, adF, aA, WB, azS); #c1(CAPN5) c2(NP_004046) c3(1574) c4(27688, 40745, 53802, 14631, 66859) c5(dx, b, X, Hr, di, PL co, f, cU, av, kF, I, du, bp, dU, bQ, Ca, iA, pk, nV, aA, rn, ap); #c1(CAPN6) c2(NP_055104) c3(1575) c4(27689, 40746, 53803, 14632, 66860) c5(ak); #c1(CAPN7) c2(NP_055111) c3(1576) c4(27690, 40747, 53804, 14633, 66861) c5(aW); #c1 (CAPN9) c2(NP_006606) c3(1577) c4(27691, 40748, 53805, 14634, 66862) c5(cU, cT, by, iA, bu); #c1(CAPNS1) c2(NP_001289561) c3(1578) c4(27692, 40749, 53806, 14635, 66863) c5(tp, A, aw, Dx, b, bm, q, Mr, w, O, aA, u, y); #c1(CAPRIN1) c2(NP_005889) c3(1579) c4(27693, 40750, 53807, 14636, 66864) c5(f, fl); #c1(CAPRIN2) c2(NP_001002259) c3(1580) c4(27694, 40751, 53808, 14637, 66865) c5(jB, at, Fg); #c1(CAPS2) c2(NP_001273476) c3(1581) c4(27695, 40752, 53809, 14638, 66866) c5(rQ, cz); #c1(CAPS) c2(NP_004049) c3(1582) c4(27696, 40753, 53810, 14639, 66867) c5(A, ix, B, iV, awX); #c1(CAPSL) c2(NP_001036090) c3(1583) c4(27697, 40754, 53811, 14640, 66868) c5(bT, aE); #c1 (CAPZA2) c2(NP_006127) c3(1584) c4(27698, 40755, 53812, 14641, 66869) c5(fl); #c1(CAPZA3) c2(NP_201585) c3(1585) c4(27699, 40756, 53813, 14642, 66870) c5(Fg, cO); #c1(CARD10) c2(NP_055365) c3(1586) c4(27700, 40757, 53814, 14643, 66871) c5(co, cy, ez, b, X, bY, dB, fy, at, u, y); #c1(CARD11) c2(NP_115791) c3(1587) c4(27701, 40758, 53815, 14644, 66872) c5(oy, WH, b, aF, iX, gm, dB, gd, CL, aoh, fq, jT, azU); #c1 (CARD14) c2(NP_001244899) c3(1588) c4(27702, 40759, 53816, 14645, 66873) c5(en, kE, axl, kB, ku, iL, xe, y, bb, fq, kr, kk, aV, u, azY, da, kp, eJ, azW, azX, ks, hT, eo, kC, azV, iu, kK); #c1(CARD16) c2(NP_001017534) c3(1589) c4(27703, 40760, 53817, 14646, 66874) c5(ae, aw, b, qL, ps, h, f, q, bu, by, ag, ar, gE, si, jf, u, y); #c1(CARD6) c2(NP_115976) c3(1590) c4(27704, 40761, 53818, 14647, 66875) c5(cO); #c1(CARD8) c2(NP_001171829) c3(1591) c4(27705, 40762, 53819, 14648, 66876) c5(dx, b, di, nl, aAb, bW, y, dv, bb, aAa, aO, cs, u, o, azZ, ax, V, aC, du, cd, ad, pi, be, dH, jH, dY, cT, fP, Om, bq); #c1(CARD9) c2(NP_434700) c3(1592) c4(27706, 40763, 53820, 14649, 66877) c5(Pp, jH, aAc, aw, pR, sE, gm, aAe, Dp, fl, fP, nl, z, aAd); #c1(CARF) c2(NP_001098056) c3(1593) c4(27707, 40764, 53821, 14650, 66878) c5(nU, f, b); #c1(CARKD) c2(NP_001229810) c3(1594) c4(27708, 40765, 53822, 14651, 66879) c5(bu); #c1(CARM1) c2(NP_954592) c3(1595) c4(27709, 40766, 53823, 14652, 66880) c5(da, IJ, co, aX, V, b, B, q, kz, T, cl, A, wf, cy, U, fy, u, y); #c1(CARS) c2(NP_001014437) c3(1596) c4(27710, 40767, 53824, 14653, 66881) c5(l, b, aF, q, gm, cz, bf, ahm, av, Wh, et, aE, O, aM); #c1(CARTPT) c2(NP_004282) c3(1597) c4(27711, 40768, 53825, 14654, 66882) c5(dx, Gt, b, aqu, FE, jc, dd, fw, cO, aO, oy, qf, dv, bb, ae, ak, oE, cM, Gj, dh, aAf, Yk, du, hW, aqQ, I, sB, Ql, Qt, qD, qp, tm, ii, aY, Ic, he, ih, Yv, dc, di, aA, awt); #c1(CASC1) c2(NP_001076441) c3(1598) c4(27712, 40769, 53826, 14655, 66883) c5(auU, ji, co, ar, bp); #c1(CASC3) c2(XP_005257220) c3(1599) c4(27713, 40770, 53827, 14656, 66884) c5(aC, f, u, y, b); #c1(CASC4) c2(NP_612432) c3(1600) c4(27714, 40771, 53828, 14657, 66885) c5(bb); #c1(CASC5) c2(NP_653091) c3(1601) c4(27715, 40772, 53829, 14658, 66886) c5(ck, aX, b, t, h, bp, ais, G, ac, aAg, ait); #c1(CASD1) c2(NP_075051) c3(1602) c4(27716, 40773, 53830, 14659, 66887) c5(Oi, aAh, u, y); #c1(CASK) c2(NP_001119526) c3(1603) c4(27717, 40774, 53831, 14660, 66888) c5(YV, U, NV, Ag, aAl, nU, cs, Vf, ahk, V, il, aAj, Nw, nz, KU, by, aAi, QZ, aAk, hT, Nq, Af, T, FR); #c1(CASP10) c2(NP_001193453) c3(1604) c4(27718, 40775, 53832, 14661, 66889) c5(by, A, b, X, ie, od, ic, y, m, jV, aX, t, re, B, q, jG, bu, ik, fy, iv, ar, av, aV, u, Yj, V, il, cV, cs, J, bp, ad, W, P, ti, T, fO, fH, cy, Dd, aAn, fM, fJ, an, ZU, aAm, DO, G, ne, cT, i, I, Oi, jl); #c1(CASP14) c2(NP_036246) c3(1605) c4(27719, 40776, 53833, 14662, 66890) c5(dx, bL, en, bW, b, asx, X, gz, eu, Ip, eW, A, ic, cO, bf, U, jl, xl, ed, Nm, dv, cy, aAo, pp, Lq, AX, f, q, ys, bu, ar, sb, cB, gg, fM, av, u, iT, iF, fU, V, hZ, k, du, v, kp, ad, W, aax, T, Ca, qV, jU, hR, et, yW, be, aM, pk, jV, zl, kJ, P, ih, gd, cz, fP, ZL, tl, O, bp, wD, re, afd); #c1(CASP1) c2(NP_001244048) c3(1606) c4(27720, 40777, 53834, 14663, 66891) c5(dx, en, Ob, sE, dB, w, cO, Eh, bW, O, dv, cy, AX, mR, nB, aC, du, Ce, gs, FG, azM, re, Ey, fc, ag, cT, dc, bg, aA, aAp, td, Zx, UW, iG, cM, co, DM, f, bu, jo, B, cs, gg, Zn, em, le, ae, Bs, Cq, ajl, v, gv, pi, aH, aY, PY, iV, abB, ck, b, aF, dk, yN, alh, ajJ, ff, ar, jG, u, dh, o, gL, by, et, et, P, jH, ao, aAs, ch, Dj, xU, ih, gd, zO, fl, aAr, A, In, xf, m, aX, Ll, bn, fq, h, tF, y, fP, aV, aAq, ma, cV, hZ, W, aoN, T, ll, jl, On, fM, nk, UE, Dl, j, Af, bh, at, Dg); #c1(CASP2) c2(NP_001215) c3(1607) c4(27721, 40778, 53835, 14664, 66892) c5(nU, b, dB, dk, A, O, y, aX, ip, t, h, f, q, bu, ar, B, hb, cs, av, aV, u, V, ad, G, Ce, ny, bb, fx, jT, fM, BX, ag, cT, jl); #c1(CASP3) c2(XP_011530603) c3(1608) c4(27722, 40779, 53836, 14665, 66893) c5(dx, by, en, aw, aAB, aiW, dB, aE, aN, w, cO, Eh, bf, aK, e, O, aAt, jT, iy, iR, t, iT, dl, mR, cl, Dc, fH, yG, rR, g, gG, mm, lb, bK, du, fO, gm, bp, ft, cV, x, FW, fx, aoJ, dL, Yp, pq, wh, QJ, qt, dk, fN, YA, ag, cT, bk, i, aC, pt, ic, EO, il, C, nF, vD, jz, eu, xB, kB, fU, si, sF, IW, U, Oh, kV, y, jb, tp, co, RD, ip, aAy, ml, f, bu, cc, B, cs, RA, av, fy, bm, fY, fi, ali, V, Bs, v, aAA, Io, Qt, gC, iA, f J, aec, sK, er, PY, fw, mD, aca, oM, Tp, b, aF, wn, m, aAw, jC, zL, Tr, d, qf, bb, kW, jd, zy, re, hV, je, q, jV, X, apB, ajJ, hb, n, Yr, ar, jG, HL, u, dh, o, fh, Ir, iP, I, Mi, LR, gL, ad, akq, vS, sf, Yi, Fk, et, kS, Lt, DP, iw, ao, ch, hT, UW, ex, zO, fl, I, Iv, bL, A, vd, fr, a Ax, bU, pD, ds, HS, iL, wf, al, hP, vl, jQ, asN, aX, ajn, bn, bj, h, F, cU, tF, iZ, ik, oJ, cB, aV, aq, NO, ma, si, bC, Be, hZ, J, P, aAC, T, j, ji, jl, fT, akV, fM, aM, eJ, alt, aAu, Yj, aAz, G, sp, zp, iE, fq, iB, n/v, aAv); #c1(CASP4) c2(NP_001216) c3(1609) c4(27723, 40780, 53837, 14666, 66894) c5(o, co, aX, b, Ob, aAD, iR, f, PY, BV, sp, A, T, y, fM, ar, U, jl, u, fY); #c1(CASP5) c2(NP_001129581) c3(1610) c4(27724, 40781, 53838, 14667, 66895) c5(A, b, X, al, hP, U, y, co, jl, ar, ff, cB, aV, u, fY, J, bp, jo, T, jT, fM, cT); #c1(CASP6) c2(NP_001217) c3(1611) c4(27725, 40782, 53839, 14668, 66896) c5(A, b, aF, Dm, dk, BL, abr, O, tp, aX, F, bu, ar, cs, o, fh, Id, ma, si, V, gm, v, P, T, x, bb, ad, fM, Iq, ch, jl); #c1(CASP7) c2(NP_001218) c3(1612) c4(27726, 40783, 53840, 14669, 66897) c5(A, aw, b, si, U, y, tp, co, aX, ip, h, f, F, q, bu, cU, ar, B, qB, jG, aV, u, aE, o, ma, V, aC, Bs, by, T, ny, jl, iA, jT, fM, JY, fy, BX, py, bm, eB, fl); #c1(CASP8AP2) c2(NP_001131140) c3(1613) c4(27727, 40784, 53841, 14670, 66898) c5(jl, Yh, b, pf, P, T, gR, U, wy, aAE, V); #c1(CASP8) c2(NP_001073594) c3(1614) c4(27728, 40785, 53842, 14671, 66899) c5(ak, aw, aiW, dB, w, bf, rF, e, O, cy, b, aAJ, t, yh, dl, do, kz, cl, Zv, gl, Yj, sE, aAL, fO, gm, bp, ft, fl, od, x, fx, jT, ahX, BX, f, DO, OJ, ag, cT, i, aC, pt, Dr, X, jz, eu, aAM, bw, U, y, aAH, co, pp, lb, hg, bu, B, cs, iJ, av, fy, bm, iT, is, V, jh, Bs, gg, v, Qz, ny, mD, iA, py, jR, Le, aAN, og, oM, iu, acl, bt, am, aF, dk, m, oi, ic, d, Ag, bb, aAG, jd, re, hV, q, jV, QE, ar, pB, jG, u, dh, o, fs, I, Mi, RK, gL, ad, G, aAn, jU, yG, aAE, aAK, ao, nV, ch, bq, I, IA, g, A, eZ, qd, fr, mW, jc, fe, C, gE, ne, jQ, fG, aX, fq, h, F, cU, aAl, ik, cB, aV, NO, fU, si, cV, hZ, J, W, P, ti, T, ll, Ez, jl, by, fM, ip, aAu, pZ, Yv, gj, Oi, ja); #c1(CASP9) c2(XP_011540572) c3(1615) c4(27729, 40786, 53843, 14672, 66900) c5(EO, jl, by, A, aw, jT, b, X, aF, aiW, dB, xB, wy, O, w, vZ, z, bw, U, ba, bj, cM, tp, co, aX, asy, rG, h, F, f, q, bu, fr, ar, y, bK, fM, av, aV, u, dh, iT, fh, Yj, gG, IT, ma, V, I, cV, Bs, ft, fO, gm, gL, v, vS, T, bp, asz, bb, fx, hR, jG, ac, cq, ao, fy, iY, ch, py, nG, jR, B, ag, cT, Af, i, fl, I, gE, iu, re); #c1(CASQ1) c2(NP_001222) c3(1616) c4(27730, 40787, 53844, 14673, 66901) c5(mz, bb, I, ch, f, JA, Jm, bf, nj, aM); #c1(CASR) c2(NP_001171536) c3(1617) c4(27731, 40788, 53845, 14674, 66902) c5(dx, XQ, aw, dB, HC, sJ, Pf, hM, bf, fx, O, gO, dv, aAX, dl, mR, asd, du, fO, azo, fl, x, aAP, jT, mm, qt, fc, ag, cT, aeP, i, aAQ, aA, Mb, hP, td, a AY, X, eu, hS, IW, U, y, V, avQ, co, pp, yE, B, k, cs, av, cp, GG, em, vR, a AT, Bs, qq, gv, mD, cK, aAE, nc, Fa, aAW, aAR, b, Bh, MZ, fD, ec, Qe, hV, q, QX, jF, Pc, IW, u, o, I, ad, et, iw, ao, Xl, ch, aAV, bq, I, D, aAZ, A, Pb, sO, fr, sv, di, Pm, aX, bn, h, aBa, yx, hN, aAD, aAS, QJ, aAU, xc, cV, YR, J, W, T, II, Oi, nP, ft, aM, TU, Ic, LG, bh, at); #c1(CASS4) c2(NP_001157587) c3(1618) c4(27732, 40789, 53846, 14675, 66903) c5(b); #c1(CAST) c2(NP_001035905) c3(1619) c4(27733, 40790, 53847, 14676, 66904) c5(dx, Kt, X, aE, xc, mW, aN, w, di, cO, vp, O, aK, y, m, dv, aX, alh, VX, im, fJ, cc, Bs, fH, av, aV, u, gl, o, fh, da, jB, ma, nQ, aBb, aC, bK, bj, du, FC, v, vc, cV, x, bb, jT, gg, jU, HL, ao, hU, fc, P, dh, FT, fP, zO, aA); #c1(CASZ1) c2(XP_011539937) c3(1620) c4(27734, 40791, 53848, 14677, 66905) c5(oy, co, aX, b, cV, eQ, f, q, eV, w, aBc, di, O, vf, al, jT, u, qG, y, pq); #c1(CAT) c2(NP_001743) c3(1621) c4(27735, 40792, 53849, 14678, 66906) c5(dx, by, en, pV, aZ, dN, bx, Rr, aBg, Zy, sE, vB, QZ, sJ, bn, ak, cO, bIF, e, O, gO, dv, aBi, rh, re, gB, gU, fp, eE, sL, wY, ia, bl, IV, nf, g, mz, aBs, fe, aeM, aAL, aBm, ft, du, gY, KK, od, Gl, x, jT, kl, yj, cq, PX, dk, bm, aBy, ag, oi, bk, i, fN, RR, pt, aA, Jn, aBo, bV, ug, td, aBj, aBv, X, vD, jz, oH, fU, Dj, iG, bw, kV, y, co, bi, px, ml, f, cs, bu, B, Bs, av, cp, pP, iT, yJ, em, jB, V, yY, fl, v, Jc, eX, bt, atl, bb, fv, Iz, aBw, mD, dy, iP, cz, PY, HZ, vH, HB, oM, fW, ap, fn, ach, hV, b, bL, aE, eY, aBk, yU, ic, aAb, MY, ey, ha, fD, cy, d, aBp, aBn, eA, oB, nU, je, q, fy, akP, ra, dQ, A, aBl, pB, ar, u, dh, o, aBh, da, qy, aP, Kx, I, qL, ad, BZ, CM, atm, rw, rB, HE, aC, et, jU, P, jH, ao, nV, ch, adf, mA, aE, El, na, ix, Ny, aBA, bq, I, yA, fh, cK, anE, Lq, de, aBt, fr, JR, gw, Oe, aBf, og, di, iL, wf, F, yv, aW, jQ, m, qs, aX, wG, aBx, aBd, cU, Vr, Gs, iM, Jf, qB, kO, aV, aq, ajH, ma, si, cV, Be, J, aBr, W, aoN, T, jl, nP, MO, aBq, aM, wU, aBe, ii, zE, MP, aBu, aBz, atR, at, eG, gl); #c1(CATSPER1) c2(NP_444282) c3(1622) c4(27736, 40793, 53850, 14679, 66907) c5(aBB, am); #c1(CATSPER2) c2(NP_001269238) c3(1623) c4(27737, 40794, 53851, 14680, 66908) c5(am); #c1(CAV1) c2(NP_001166366) c3(1624) c4(27738, 40795, 53852, 14681, 66909) c5(dx, by, f, aw, dN, sE, dB, Tw, Ip, w, hM, vp, ca, O, bQ, ajF, iR, e, cl, jq, aD, jF, Fg, g, aBE, Qf, du, fO, bp, MO, od, x, fx, gg, pq, jE, BX, aBC, Ox, ag, cT, qP, iT, i, aA, bT, ib, bP, Kt, fi, cY, Hk, oa, jz, eu, fU, bo, bf, bw, U, co, y, co, ip, gd, ak, bu, B, cs, av, fy, bm, fY, d, V, Qz, gv, IR, aBD, dv, eX, ny, Hh, JY, kJ, er, P, nJ, rn, gO, ji, dR, aBF, ap, Mo, bt, b, aF, QY, fD, hh, jh, Iz, ra, jd, re, hV, aBG, q, es, X, mL, ar, ff, xd, u, o, fh, fs, il, im, gL, sX, LR, gL, ad, IX, et, an, nV, ch, na, agf, IS, fl, I, vZ, Mp, bL, A, k, fr, IW, iH, di, Iv, iL, zY, vl, jx, MT, aX, I, Qm, h, qr, Ug, jQ, cB, aV, aat, ma, kG, ez, Be, Fs, W, jo, T, j, gF, ft, aM, Jh, XH, E, bh, at); #c1(CAV2) c2(NP_001224) c3(1625) c4(27739, 40796, 53853, 14682, 66910) c5(dx, A, b, fr, dB, Id, hS, w, dV, e, y, d, ip, ak, qr, ra, mL, O, xd, u, ez, sX, du, LG, gL, ft, W, T, dZ, ny, x, pq, BX, er, hh, aA, bT, rn); #c1(CAV3) c2(NP_001225) c3(1626) c4(27740, 40797, 53854, 14683, 66911) c5(afE, le, aBK, AA, ds, cK, Bo, xl, c, Fp, cr, aBO, oB, cc, mR, ac, p, aBJ, oD, xd, u, aBL, aBM, WG, kG, nl, aBN, aBH, avS, bq, pw, hR, mO, sK, hQ, ch, At, aBI, iB, bh, at, ap); #c1(CBFA2T2) c2(NP_001028171) c3(1627) c4(27741, 40798, 53855, 14684, 66912) c5(dj, o, bb, b, bm, h, eX, q, fO, pn, bQ, T, Iv, jU, cs, O, fy, u, y); #c1(CBFA2T3) c2(NP_005178) c3(1628) c4(27742, 40799, 53856, 14685, 66913) c5(jH, jK, jT, b, Be, h, f, gm, J, jU, oV, u, y); #c1(CBFB) c2(NP_001746) c3(1629) c4(27743, 40800, 53857, 14686, 66914) c5(fl, X, aBQ, cO, U, y, cr, aBP, t, h, bu, M, ar, iv, av, u, V, FK, J, by, G, jG, P, Nq, gR); #c1(CBLB) c2(NP_733762) c3(1630) c4(27744, 40801, 53858, 14687, 66915) c5(b, fc, t, h, jN, G, sJ, cc, gl, bf, aV, iu, aE, aM); #c1(CBL) c2(NP_005179) c3(1631) c4(27745, 40802, 53859, 14688, 66916) c5(KC, A, b, aBR, mW, ana, bu, hP, Ld, m, zh, acL, aBP, kT, t, h, N, es, n, iv, fg, hD, gl, cj, I, im, pF, gm, J, P, zi, agl, kX, pz, by, fM, jT, aBS, G, mA, pj, yy, xr, Ql, CL, Q, pJ, fj, ci, pv); #c1(CBLL1) c2(NP_001271220) c3(1632) c4(27746, 40803, 53860, 14689, 66917) c5(aiW, Il); #c1(CBLN1) c2(NP_004343) c3(1633) c4(27747, 40804, 53861, 14690, 66918) c5(aY, A, cM, dc); #c1(CBLN2) c2(XP_011524128) c3(1634) c4(27748, 40805, 53862, 14691, 66919) c5(IR, IX, IS, zb, IW); #c1(CBLN4) c2(NP_542184) c3(1635) c4(27749, 40806, 53863, 14692, 66920) c5(cV); #c1(CBR1) c2(NP_001748) c3(1636) c4(27750, 40807, 53864, 14693, 66921) c5(A, b, aBT, IW, aBU, U, hP, y, co, iy, h, f, q, jV, bu, cs, u, aE, Em, gG, V, J, ad, P, bt, x, cK, nP, by, jH, aq, i, I); #c1(CBR3) c2(NP_001227) c3(1637) c4(27751, 40808, 53865, 14694, 66922) c5(afE, aw, I, b, X, h, f, i, cO, I, cK, u); #c1(CBR4) c2(NP_116172) c3(1638) c4(27752, 40809, 53866, 14695, 66923) c5(bq); #c1(CBS) c2(XP_011528084) c3(1639) c4(27753, 40810, 53867, 14696, 66924) c5(dx, IJ, B, dN, sE, jK, bf, e, dv, eE, tE, g, du, gJ, gm, bp, vc, fx, hR, dL, hQ, fN, i, bq, aA, Nn, bP, mZ, fO, X, TM, Nr, mk, sF, U, y, co, pp, f, bu, cs, av, fy, bm, wK, V, Zr, cd, tj, xd, aBY, fw, ap, aaW, b, aF, jg, tG, pl, aO, d, bb, jd, vj, nU, q, HW, ar, u, o, fh, I, bc, aza, fz, gL, ad, et, Ut, ex, Ns, I, xf, bL, A, aBX, aBV, di, vg, hP, aW, m, cr, Qm, ni, bj, h, nA, aq, si, J, dt, T, aBW, jl, by, aM, jT, Ic, Nq, fP, hh, at, mo); #c1(CBX1) c2(NP_006798) c3(1640) c4(27754, 40811, 53868, 14697, 66925) c5(A, b, Bi, hV, B, cB); #c1(CBX2) c2(NP_005180) c3(1641) c4(27755, 40812, 53869, 14698, 66926) c5(Lp, bp, UZ, b, aBZ); #c1(CBX3) c2(NP_009207) c3(1642) c4(27756, 40813, 53870, 14699, 66927) c5(wV, A, aw, b, B, wP, sf, co, ss, ji, fp); #c1(CBX4) c2(NP_003646) c3(1643) c4(27757, 40814, 53871, 14700, 66928) c5(A, aw, q, Up, B); #c1(CBX5) c2(NP_001120793) c3(1644) c4(27758, 40815, 53872, 14701, 66929) c5(wV, co, ae, b, hV, J, jG, wP, aCa, T, B, A, cA, sf, u, fp, y); #c1(CBX6) c2(NP_001290423) c3(1645) c4(27759, 40816, 53873, 14702, 66930) c5(i, k); #c1(CBX7) c2(NP_783640) c3(1646) c4(27760, 40817, 53874, 14703, 66931) c5(B, b, w, U, A, jT, aX, hV, bu, fv, cs, ar, V, qL, gm, fO, by, W, T, ad, fp, nV, po, ag); #c1(CBX8) c2(NP_065700) c3(1647) c4(27761, 40818, 53875, 14704, 66932) c5(ag, i, bq, Bz, u, y); #c1(CBY1) c2(NP_001002880) c3(1648) c4(27762, 40819, 53876, 14705, 66933) c5(awX, V, vg, aCb, gL, mk, vc, tG, U); #c1(CC2D1A) c2(NP_060191) c3(1649) c4(27763, 40820, 53877, 14706, 66934) c5(f, aCc, nU, P, co, cA, aW); #c1(CC2D1B) c2(XP_011539232) c3(1650) c4(27764, 40821, 53878, 14707, 66935) c5(P); #c1(CC2D2A) c2(NP_001073991) c3(1651) c4(27765, 40822, 53879, 14708, 66936) c5(aCf, r, nW, nU, vU, Nz, GF, z, aCd, aCe, vt, aCg); #c1(CCAR1) c2(NP_001269889) c3(1652) c4(27766, 40823, 53880, 14709, 66937) c5(jT, hW, b, eu, ad, cs, oE, u); #c1(CCAR2) c2(NP_066997) c3(1653) c4(27767, 40824, 53881, 14710, 66938) c5(jT, A, aw, b, iR, u, f, by, fN, G, T, B, i, ji, kJ, aA, QJ, dL, fx, y); #c1(CCBE1) c2(NP_597716) c3(1654) c4(27768, 40825, 53882, 14711, 66939) c5(gB, dA, X, nU, aC, aCh, av, u, y); #c1(CCBL1) c2(NP_001116144) c3(1655) c4(27769, 40826, 53883, 14712, 66940) c5(T, ff, gl); #c1(CCDC101) c2(NP_612423) c3(1656) c4(27770, 40827, 53884, 14713, 66941) c5(f, et); #c1(CCDC102B) c2(NP_001087198) c3(1657) c4(27771, 40828, 53885, 14714, 66942) c5(dA); #c1(CCDC103) c2(NP_001245326) c3(1658) c4(27772, 40829, 53886, 14715, 66943) c5(MW, Pu, aCi); #c1(CCDC105) c2(NP_775753) c3(1659) c4(27773, 40830, 53887, 14716, 66944) c5(oy); #c1(CCDC108) c2(NP_001265224) c3(1660) c4(27774, 40831, 53888, 14717, 66945) c5(c0); #c1(CCDC114) c2(NP_653178) c3(1661) c4(27775, 40832, 53889, 14718, 66946) c5(MW, aCj, Pu, cr); #c1(CCDC115) c2(NP_115733) c3(1662) c4(27776, 40833, 53890, 14719, 66947) c5(Dg, aw, cV); #c1(CCDC121) c2(NP_001136155) c3(1663) c4(27777, 40834, 53891, 14720, 66948) c5(oG); #c1(CCDC122) c2(NP_659411) c3(1664) c4(27778, 40835, 53892, 14721, 66949) c5(acO, acN, Bm, dA); #c1(CCDC129) c2(NP_001244896) c3(1665) c4(27779, 40836, 53893, 14722, 66950) c5(Eo); #c1(CCDC130) c2(NP_110445) c3(1666) c4(27780, 40837, 53894, 14723, 66951) c5(zN); #c1(CCDC134) c2(NP_001291726) c3(1667) c4(27781, 40838, 53895, 14724, 66952) c5(bm, o); #c1(CCDC136) c2(NP_001188301) c3(1668) c4(27782, 40839, 53896, 14725, 66953) c5(T); #c1(CCDC140) c2(NP_694583) c3(1669) c4(27783, 40840, 53897, 14726, 66954) c5(cy); #c1(CCDC141) c2(NP_775919) c3(1670) c4(27784, 40841, 53898, 14727, 66955) c5(di); #c1(CCDCI48) c2(NP_001288613) c3(1671) c4(27785, 40842, 53899, 14728, 66956) c5(cz, cp); #c1(CCDC151) c2(NP_001289382) c3(1672) c4(27786, 40843, 53900, 14729, 66957) c5(MW, Pu, cr); #c1(CCDC167) c2(NP_612502) c3(1673) c4(27787, 40844, 53901, 14730, 66958) c5(bq, o, cO); #c1(CCDC169-SOHLH2) c2(NP_001185839) c3(1674) c4(27788, 40845, 53902, 14731, 66959) c5(X, av, Ap, jw, b); #c1(CCDC170) c2(NP_079335) c3(1675) c4(27789, 40846, 53903, 14732, 66960) c5(u); #c1(CCDCl71) c2(NP_775821) c3(1676) c4(27790, 40847, 53904, 14733, 66961) c5(eO); #c1 (CCDC175) c2(NP_001157871) c3(1677) c4(27791, 40848, 53905, 14734, 66962) c5(o); #c1(CCDC176) c2(NP_079333) c3(1678) c4(27792, 40849, 53906, 14735, 66963) c5(kF); #c1(CCDC178) c2(NP_001098998) c3(1679) c4(27793, 40850, 53907, 14736, 66964) c5(A); #c1(CCDC180) c2(NP_065944) c3(1680) c4(27794, 40851, 53908, 14737, 66965) c5(ix); #c1(CCDC181) c2(NP_067002) c3(1681) c4(27795, 40852, 53909, 14738, 66966) c5(di, aw); #c1(CCDC185) c2(NP_689823) c3(1682) c4(27796, 40853, 53910, 14739, 66967) c5(at); #c1(CCDC22) c2(NP_054727) c3(1683) c4(27797, 40854, 53911, 14740, 66968) c5(o); #c1(CCDC28A) c2(NP_056254) c3(1684) c4(27798, 40855, 53912, 14741, 66969) c5(M, fg,jK, N, iv); #c1(CCDC39) c2(NP_852091) c3(1685) c4(27799, 40856, 53913, 14742, 66970) c5(MW, Pu, aCk); #c1(CCDC3) c2(NP_001269587) c3(1686) c4(27800, 40857, 53914, 14743, 66971) c5(aA); #c1 (CCDC40) c2(NP_001230271) c3(1687) c4(27801, 40858, 53915, 14744, 66972) c5(MW, Pu, aCI); #c1(CCDC42B) c2(NP_001138344) c3(1688) c4(27802, 40859, 53916, 14745, 66973) c5(al, q, z); #c1(CCDC42) c2(NP_001151733) c3(1689) c4(27803, 40860, 53917, 14746, 66974) c5(ix); #c1(CCDC50) c2(NP_777568) c3(1690) c4(27804, 40861, 53918, 14747, 66975) c5(cT, aCm); #c1(CCDC54) c2(NP_115989) c3(1691) c4(27805, 40862, 53919, 14748, 66976) c5(d, ck, b, il, X, Ks, re, fO, e, cU, ik, ar, av, fy, iA, iT); #c1(CCDC60) c2(NP_848594) c3(1692) c4(27806, 40863, 53920, 14749, 66977) c5(at, I); #c1(CCDC62) c2(NP_958843) c3(1693) c4(27807, 40864, 53921, 14750, 66978) c5(A, bj, B, v, ck, bM, GJ, ajj, ajH); #c1(CCDCG3) c2(XP_011536303) c3(1694) c4(27808, 40865, 53922, 14751, 66979) c5(aX); #c1(CCDC65) c2(NP_149115) c3(1695) c4(27809, 40866, 53923, 14752, 66980) c5(MW, Pu, aCn); #c1(CCDC6) c2(NP_001012524) c3(1696) c4(27810, 40867, 53924, 14753, 66981) c5(nW, aCo); #c1(CCDC67) c2(NP_857596) c3(1697) c4(27811, 40868, 53925, 14754, 66982) c5(by, cy, bu); #c1(CCDC68) c2(NP_001137301) c3(1698) c4(27812, 40869, 53926, 14755, 66983) c5(Ew, at); #c1(CCDC6) c2(NP_005427) c3(1699) c4(27813, 40870, 53927, 14756, 66984) c5(Dr, mZ, hV, aw, b, Qv, Mj, wy, afR, w, ic, iq, Mn, azq, y, co, Bi, f, N, aBd, ra, FN, pB, aCr, u, Bd, V, VD, Dt, aow, wV, xO, T, nP, YU, aCq, nV, VQ, aCp, jR, wP, og, tl, ji, yo); #c1(CCDC78) c2(NP_001026907) c3(1700) c4(27814, 40871, 53928, 14757, 66985) c5(At, oD, aCs); #c1(CCDC80) c2(NP_955805) c3(1701) c4(27815, 40872, 53929, 14758, 66986) c5(Dr, A, b, fr, fq, hV, ft, nV); #c1(CCDC83) c2(NP_001273088) c3(1702) c4(27816, 40873, 53930, 14759, 66987) c5(ck, cs, ad); #c1 (CCDC85A) c2(NP_001073902) c3(1703) c4(27817, 40874, 53931, 14760, 66988) c5(qf, at, aA); #c1(CCDC86) c2(NP_077003) c3(1704) c4(27818, 40875, 53932, 14761, 66989) c5(bb); #c1(CCDC88A) c2(NP_001129069) c3(1705) c4(27819, 40876, 53933, 14762, 66990) c5(ao, bb, V, b, f, ad, ag, cs, gj, U, u, y); #c1(CCDC88C) c2(NP_001073883) c3(1706) c4(27820, 40877, 53934, 14763, 66991) c5(NG, vt, dA, N, NH, Xz, u, y); #c1 (CCDC8) c2(NP_114429) c3(1707) c4(27821, 40878, 53935, 14764, 66992) c5(dx, pE, dv, aX, b, nQ, F, du, dB, aCt, aCv, aCu, ea, asQ, kY, bf, u, y, iy); #c1(CCDC91) c2(NP_060788) c3(1708) c4(27822, 40879, 53936, 14765, 66993) c5(aCw, IV, Bu, acg); #c1(CCDC94) c2(NP_060544) c3(1709) c4(27823, 40880, 53937, 14766, 66994) c5(h); #c1(CCDC97) c2(NP_443080) c3(1710) c4(27824, 40881, 53938, 14767, 66995) c5(i); #c1 (CCHCR1) c2(NP_001099033) c3(1711) c4(27825, 40882, 53939, 14768, 66996) c5(A, JH, b, aF, Gl, mk, ix, NH, ic, bf, e, d, m, aCy, cy, il, f, aD, pW, da, I, aeP, xq, eX, Oi, yA, aM, jH, aCx, NG, xe, wq, pH, tl, di, aA, at, ap); #c1(CCKAR) c2(NP_000721) c3(1712) c4(27826, 40883, 53940, 14769, 66997) c5(jJ, tR, au, bf, cA, bw, bj, iK, jd, ak, bu, az, OC, ar, O, Sp, vR, aqQ, I, qA, nu, by, wX, aM, aaf, ih, ag, i, aA, Gn); #c1(CCKBR) c2(NP_795344) c3(1713) c4(27827, 40884, 53941, 14770, 66998) c5(EO, by, A, b, bx, tR, aCz, dd, O, bw, U, hP, iK, aX, jd, bj, hV, q, bu, OC, ar, B, cs, qu, fv, fU, V, I, gm, bp, J, W, T, bt, x, nP, ad, fM, JY, aCC, nV, ch, aCA, ih, ag, aCB, wX jU); #c1(CCK) c2(NP_000720) c3(1714) c4(27828, 40885, 53942, 14771, 66999) c5(EO, de, ak, bf, b, k, ka, je, is, eu, tR, aCD, O, ig, jc, au, aCB, dV, z, kF, Jx, bu, hP, U, cM, ag, Wp, Ml, vR, ty, bn, bj, rr, hV, hB, es, az, X, OC, dZ, ar, B, A, cs, bw, fv, av, fy, cl, g, fU, hW, V, I, dA, ju, nu, bp, by, W, Bg, T, Gl, cV, jT, aA, fM, Sp, GL, qp, iK, ch, tW, eA, Ir, os, OJ, ih, jd, IN, dn, mD, yq, wX, Gn); #c1(CCL11) c2(NP_002977) c3(1715) c4(27829, 40886, 53943, 14772, 67000) c5(dx, b, TQ, X, aF, DT, Ka, Kc, kB, ali, NH, bf, aO, gM, aCF, bb, fq, DM, eX, dl, jU, JF, fP, aCH, aV, aE, fh, ma, I, aCG, du, dB, P, ti, T, aCE, bq, cy, gg, qe, aM, jH, nk, dP, NG, Ic, zX, gd, akm, DI, pH, fD, I, aCI, aA, at, eG, rr); #c1(CCL13) c2(NP_005399) c3(1716) c4(27830, 40887, 53944, 14773, 67001) c5(P, hU, Xz, NG, X, aCJ, h, v, aD, gd, cT, DI, NH, aC, fq, vJ, cy, aV, DM); #c1(CCL14) c2(NP_116738) c3(1717) c4(27831, 40888, 53945, 14774, 67002) c5(m, co, cy, fD, eG, DM, fP, q, mW, gv, Dl, fv, iL, iv, bh, aV, u, gl, y); #c1(CCL15) c2(NP_116741) c3(1718) c4(27832, 40889, 53946, 14775, 67003) c5(cy, DM, q, Dl, fP, fD); #c1(CCL16) c2(XP_005258077) c3(1719) c4(27833, 40890, 53947, 14776, 67004) c5(tp, A, aX, bm, DM, adK, q, cy, eE, ag, abb, Dl, T, y, z, bh, jG, u, aAv, C); #c1(CCL17) c2(NP_002978) c3(1720) c4(27834, 40891, 53948, 14777, 67005) c5(dx, en, anh, b, Zx, gE, Jz, Ip, mk, ck, NH, Iv, z, e, jQ, d, m, dv, aX, fq, h, ox, bu, eE, QE, aCM, dQ, aD, fH, gg, aV, ye, bk, da, ax, bK, LR, wE, gm, J, as, Io, cy, jT, fJ, yj, aCK, du, nk, dP, NG, MU, aCN, fG, gd, Dl, pH, aex, gj, eG, DM, aCL); #c1(CCL18) c2(NP_002979) c3(1721) c4(27835, 40892, 53949, 14778, 67006) c5(dx, aCO, b, jz, Ip, mk, iL, eO, al, jD, y, cp, dC, dv, cy, t, DM, oO, gg, jQ, u, Yb, LR, cV, aC, du, J, j, aD, P, bp, aZ, aCP, aCK, G, sN, a km, Dl, aex, fq, at, wz, ij); #c1(CCL19) c2(NP_006265) c3(1722) c4(27836, 40893, 53950, 14779, 67007) c5(dx, WH, Ik, jz, sJ, lv, cO, y, jQ, co, BL, DM, jG, aV, u, ye, da, Id, ax, du, gL, gj, P, dv, cy, yj, dH, Ig, nk, fc, DO, sN, fG, gd, cT, Dl, aCQ, ji, aA, at); #c1(CCL1) c2(NP_002972) c3(1723) c4(27837, 40894, 53951, 14780, 67008) c5(b, IW, jz, lv, eO, e, jQ, d, jh, cy, il, DM, dQ, vo, aV, u, adK, V, ae, vJ, P, jl, yG, hU, Dl, I, eG); #c1(CCL20) c2(NP_001123518) c3(1724) c4(27838, 40895, 53952, 14781, 67009) c5(bm, hV, b, zH, sE, jz, gN, Ip, mk, A, vZ, z, bf, U, vl, y, jQ, oy, ag, co, cy, iR, Bc, fq, aCR, f, yh, q, aC, B, fH, aV, u, aE, fh, da, ax, Pz, V, bx, fO, J, gL, nk, T, pD, bt, x, dH, fJ, jU, aM, jH, yG, nV, Eu, ch, gd, fP, I, O, iu, bT); #c1(CCL21) c2(NP_002980) c3(1725) c4(27839, 40896, 53953, 14782, 67010) c5(azt, bL, id, b, JS, X, Ik, jz, gn, aE, fl, di, lv, WH, cO, al, U, y, jQ, co, aX, ajn, yX, fi, hV, yh, q, cy, aCS, jT, fy, cs, UM, av, aV, u, dx, jH, da, Id, ax, V, il, cV, aC, LR, gL, ad, W, P, dv, j, BL, aCT, pi, jG, be, dH, Iq, du, nV, uJ, DO, xe, fG, cT, fl, iB, at, eG, ap); #c1(CCL22) c2(NP_002981) c3(1726) c4(27840, 40897, 53954, 14783, 67011) c5(dx, anY, b, Zx, gE, jz, gN, Ip, sJ, di, ic, z, anh, j, jQ, bb, fq, h, bu, QE, dQ, as, fH, gg, aV, u, da, aC, bK, LR, asM, bp, by, P, cy, fx, jT, fJ, aCK, hU, dP, xe, gd, cT, Dl, i, bq, jC, MU, DM, lv); #c1(CCL23) c2(NP_005055) c3(1727) c4(27841, 40898, 53955, 14784, 67012) c5(cy, aC, fq, DM, P, Dl); #c1(CCL24) c2(XP_011514762) c3(1728) c4(27842, 40899, 53956, 14785, 67013) c5(gM, tY, nk, cy, NG, fq, DM, aCU, gL, eE, gd, P, ti, NH, aD, Xz, Kc, jH, Dl); #c1(CCL25) c2(NP_001188288) c3(1729) c4(27843, 40900, 53957, 14786, 67014) c5(dx, A, X, y, yg, dv, aX, DM, B, aD, av, u, yd, vR, aC, du, P, cy, DO, cT, Dl, aA, eG); #c1(CCL26) c2(NP_006063) c3(1730) c4(27844, 40901, 53958, 14787, 67015) c5(Tp, DT, NH, DK, jh, iy, fq, DM, im, eE, Tr, fP, aos, ali, dA, aC, gL, aD, P, cy, jH, NG, gd, akm, Dl, pH, dn, oT); #c1(CCL27) c2(NP_006655) c3(1731) c4(27845, 40902, 53959, 14788, 67016) c5(da, b, fr, jz, wy, mk, bo, yi, y, jh, cy, fq, DM, yh, q, eE, cs, as, IW, jQ, u, ye, TV, bm, aC, avo, j, ad, P, od, fO, rO, ft, yj, TU, Io, TX, cT, Dl, gj, yf, bT); #c1(CCL28) c2(NP_001288802) c3(1732) c4(27846, 40903, 53960, 14789, 67017) c5(jp, Jy, b, Mj, mk, aCB, lv, bw, Mn, cy, DM, n, Dc, u, gL, P, T, aeC, et, cT, Dl, rr, di, aA, h); #c1(CCL2) c2(NP_002973) c3(1733) c4(27847, 40904, 53961, 14790, 67018) c5(ml, aCW, dD, dB, vB, aDg, en, Ir, OH, e, uA, aDo, kJ, aDw, nv, cl, TP, aC, zv, ft, ME, kN, pq, tO, ag, fD, aCQ, bq, aA, X, eu, ig, sF, II, bw, vl, fm, aDn, uj, pz, Dq, ak, vo, MR, av, CX, NW, ae, nl, cd, IR, J, xd, uJ, ji, aG, bn, Hr, dk, vY, cl, jy, HQ, jh, yN, amU, aJ, Km, dh, da, fs, gL, ad, aDC, ajU, ao, nV, ea, mA, Ns, aDa, xf, BK, aDF, g, vd, fr, vZ, iL, gE, zK, Pl, aDt, m, cr, or, wG, oJ, ev, aCH, wF, ui, be, bd, bR, Pk, VF, Jh, Ic, fP, gl, dx, dM, iU, aDq, vp, aK, O, at, aDi, LN, AX, DB, amW, aoh, VA, du, yO, MO, x, wh, gs, dS, fc, sN, mx, bP, fl, He, iP, dj, aCY, mk, ix, cA, U, co, BL, f, aDD, bu, ky, yV, Bs, NZ, gv, Hh, Le, ti, tl, wT, Pv, z, d, bb, aDr, eA, jd, q, mL, sR, ff, ar, aM, iR, o, fh, qL, LR, aDv, aZ, jU, jH, rQ, ch, gd, fl, aDj, Tl, Ik, aDc, eO, al, aW, ajb, aDm, cB, aq, ax, nQ, sB, uF, T, II, aDs, nk, aDd, Dl, gj, IJ, eX, aw, Fk, DT, Ka, aoL, BO, iy, aDh, aDx, eE, sM, VB, ha, NM, bK, Qf, fO, vc, fx, FG, eH, aDb, fy, bY, cT, dX, rn, aDf, cG, cY, bf, ai, V, Ei, pp, DM, B, hj, iT, rN, v, bt, Fr, iA, dO, aDE, zS, bW, b, LX, aF, Of, jL, tG, re, k, OC, sz, atr, UG, nd, IX, vS, et, hU, pS, hT, ex, IS, Bm, oC, aCZ, mW, aDB, axA, ds, vg, wf, gs, bj, cU, tF, Ek, aDz, aDA, jl, HL, Y, Rd, agN, ap, eG, adl, gK, iq, Ym, aN, sJ, w, cO, wk, gO, dv, cy, t, do, tE, ju, Hs, gl, gm, aDk, sH, LW, od, aDe, Lz, jv, dL, dH, aDI, xO, fN, Ox, i, azR, Nv, td, Kt, jf, hS, fU, IW, Co, y, ed, cV, vQ, cs, aDp, mm, JD, bm, agS, aCG, Tn, cK, jR, Im, apD, id, Df, anY, ey, jD, aD, aCV, lz, zJ, bX, CR, aCF, dQ, u, nj, PJ, aDu, sQ, I, qA, by, BZ, G, Io, aE, I, bL, A, kg, HJ, Nq, di, sx, aCX, c, aX, sS, fq, h, F, gg, aV, jZ, ma, acu, hZ, wE, P, j, aj, gF, ac, zE, MU, aDy, bh, Nu, iE); #c1(CCL3) c2(NP_002974) c3(1734) c4(27848, 40905, 53962, 14791, 67019) c5(dx, en, aw, sE, iU, aDG, w, bW, e, O, dv, cy, LN, AX Hs, g, aC, du, fO, vc, x, jT, dH, hx, aDH, sJ, sN, cT, pH, bk, aCQ, jz, mk, ma, NH, Ku, vp, f, hZ, aye, gg, bm, be, yV, ae, aDI, fw, zS, b, dk, tG, jD, d, bb, q, ar, jG, u, dh, o, fh, kF, aiU, LR, gL, nd, jH, hU, DR, gd, Bm, bL, axA, vg, bj, jQ, fq, h, aV, ax, oS, sj, sB, J, P, aDA, gF, nk, NG, aCO, zM, at, gl); #c1(CCL3L3) c2(NP_001001437) c3(1735) c4(27849, 40906, 53963, 14792, 67020) c5(da, m, Pz, iL, ae, aC, aye, h, ht, aE, mk, P, Io, gE, cy, al, jG, pq); #c1(CCL4) c2(NP_002975) c3(1736) c4(27850, 40907, 53964, 14793, 67021) c5(dx, bm, en, aCO, b, LX, xO, aF, sE, jz, iU, mk, w, W, Ku, iL, z, al, jD, y, at, dv, bb, ae, LN, h, f, q, cy, aC, gg, jQ, u, o, fh, da, du, Pz, yV, I, jH, C, ht, J, fO, gv, dt, P, nk, T, eX, Io, ajU, hU, gE, jT, anf, ac, Iz, aDJ, Lc, aaa, pS, aq, bV, gd, cT, Dl, bh, zD, DM, lv); #c1(CCL4L1) c2(NP_996890) c3(1737) c4(27851, 40908, 53965, 14794, 67022) c5(dx, bm, en, aCO, b, LX, aF, sE, jz, dk, w, W, Ku, iL, z, al, y, jQ, dv, bb, ae, h, f, q, aC, u, da, du, yV, I, jH, C, ht, J, gv, dt, P, xO, eX, Io, gE, jT, ac, Iz, BZ, aDJ, Lc, aaa, aq, bV, cT, bh, aA, zD, MU, lv); #c1(CCL4L2) c2(NP_001278397) c3(1738) c4(27852, 40909, 53966, 14795, 67023) c5(dx, bm, en, aCO, b, LX, aF, sE, jz, w, W, Ku, iL, z, al, y, jQ, dv, bb, ae, h, f, q, aC, u, da, du, yV, I, jH, C, ht, J, gv, dt, P, xO, eX, Io, gE, jT, ac, Iz, aDJ, Lc, aaa, aq, bV, cT, bh, zD, lv); #c1(CCL5) c2(NP_001265665) c3(1739) c4(27853, 40910, 53967, 14796, 67024) c5(dx, en, axx, Io, bx, dD, aiW, DT, eH, sJ, w, aw, bu, OH, e, O, gO, dv, cy, Os, AX, yh, dl, aD, fH, pq, gl, ha, aeM, NM, aC, bK, sH, du, fO, bp, MO, xO, vM, x, qt, jT, iU, gg, dH, aoC, gs, gC, fc, bm, Ox, Fr, bY, sN, ag, pH, i, aCQ, bq, aA, bT, rn, bP, rN, fl, td, Kt, eu, Kc, ig, ma, NH, Ku, bf, U, y, yV, co, pp, eD, DM, f, aG, tv, aCS, k, B, cs, bv, IS, hj, DL, fY, V, ae, aDM, gv, IR, eX, bt, cl, qH, pi, anf, pk, dP, Za, fw, xe, aDL, zS, apT, aDS, ap, vq, ck, b, zH, aF, atU, eR, DJ, vY, z, abg, ey, jD, d, aDO, aDV, bb, gz, q, jV, fJ, aDN, aDP, dQ, ac, wT, Dq, ar, u, aE, ri, ff, da, PJ, gE, sQ, I, im, fs, atr, gL, ad, IX, aDU, aDR, aZ, et, Ut, jH, KK, hU, fD, aDK, iq, aDT, ajf, gd, ix, CL, o, fl, I, A, aDj, mz, MR, IW, gN, axA, agS, zM, iL, eM, Pl, al, bj, aDt, eb, fG, aX, bn, fq, h, aDQ, Gw, sV, fP, aCH, aV, jZ, wF, ax, m, be, dB, MU, W, P, ti, ll, ji, aDA, jl, by, qe, aM, nk, NG, iu, aDy, IW, rw, Dl, j, iB, bh, at, eG, adl, gl); #c1(CCL7) c2(NP_006264) c3(1740) c4(27854, 40911, 53968, 14797, 67025) c5(gK, b, X, dB, e, O, aDW, d, cy, ajn, ag, DM, gB, jV, sR, cs, vo, aV, NO, wF, LR, cV, aC, NZ, j, ad, P, rQ, x, be, nk, hU, gd, Dl, fP, vJ); #c1(CCL8) c2(NP_005614) c3(1741) c4(27855, 40912, 53969, 14798, 67026) c5(en, tG, X, adJ, mk, aDX, vg, U, al, O, d, m, cy, fq, AX, CR, e, fy, JF, fH, av, aV, o, V, aC, hZ, be, yO, gL, aDY, vc, nk, aj, jl, fJ, pc, jH, CX, P, gd, Dl, ai, aA, DM); #c1(CCM2) c2(NP_001025006) c3(1742) c4(27856, 40913, 53970, 14799, 67027) c5(g, ax, I, cV, aEa, B, jR, aDZ, aC, cT, w, Ol, oi, A, aA, u, dH); #c1(CCNAI) c2(NP_001104515) c3(1743) c4(27857, 40914, 53971, 14800, 67028) c5(B, aw, b, X, Lv, dB, wn, A, U, aoK, ps, e, y, d, co, am, t, h, hg, F, q, jG, Zv, u, iT, V, J, gv, P, T, fx, ck, G, UW, pl, i, bh, re); #c1(CCNA2) c2(NP_001228) c3(1744) c4(27858, 40915, 53972, 14801, 67029) c5(dx, bm, wa, nU, jE, b, X, aF, dB, zK, A, iL, cK, aEc, aeC, y, zM, fe, dv, t, ml, f, q, jV, bu, cU, fr, ar, B, hb, av, fy, u, dh, fi, me, i, aC, LR, J, fO, ft, I J, T, Lw, by, hR, fp, ac, du, sS, iR, lc, nJ, we, aEb, tl, fl, I, Mp, eG, h); #c1(CCNB1) c2(NP_114172) c3(1745) c4(27859, 40916, 53973, 14802, 67030) c5(bm, by, A, aw, b, jR, X, gG, jz, dB, w, lv, O, ct, U, e, y, jQ, d, cU, co, h, f, q, bu, aEd, fr, B, cB, cs, av, fy, u, iT, g, ma, kF, V, il, jh, qL, ft, gm, fO, J, W, bQ, T, Lw, iA, ad, fM, aeo, jE, Lc, gt, ch, lc, BV, fl, od, eG, re); #c1(CCNB2) c2(NP_004692) c3(1746) c4(27860, 40917, 53974, 14803, 67031) c5(d, iF, ml, yE, X, bp, by, W, qL, co, T, fl, ji, ar, O, fy, u, e, y); #c1(CCNB3) c2(NP_391990) c3(1747) c4(27861, 40918, 53975, 14804, 67032) c5(aiQ, fr, b, es); #c1(CCNC) c2(NP_001013417) c3(1748) c4(27862, 40919, 53976, 14805, 67033) c5(fi, wh, fl, aX, b, fr, dB, q, ad, G, cs, ft, o); #c1(CCND1) c2(NP_444284) c3(1749) c4(27863, 40920, 53977, 14806, 67034) c5(YZ, aoV, ml, aw, aEu, bx, jE, rR, Zy, sE, awh, dB, aN, Ip, x, w, ct, Ou, adr, aeC, O, wm, hO, bQ, cy, Os, kJ, aEa, t, yh, nZ, alD, fH, aoX, aEv, eEh, g, bd, og, lb, ft, Dt, gm, bp, gY, avh, Ce, jx, Gl, Mm, fx, Tw, dL, Yp, cg, wh, M, jM, f, fM, HC, bm, Qk, DO, aEo, anb, ie, IN, qP, i, fN, bq, aol, jl, aEm, aEl, EO, GD, id, iF, X, Hk, aEw, iP, jz, wy, kB, fU, Bg, iG, bo, bw, U, pa, aEe, y, tp, co, pw, px, pp, ag, aqK, fi, hg, cT, bu, gX, B, Mp, cs, Tk, av, fy, QD, OT, iT, aEq, d, jB, V, Ov, jh, by, Cq, qq, n, afn, gv, gF, aEt, Qz, bt, Qt, VP, iy, apg, hs, aA, YU, JY, fJ, GB, if, gt, aoy, hp, P, in, awz, jd, aEk, iA, ji, fD, aEs, pv, gG, aEg, OG, afE, ny, b, QB, aoU, gz, aEi, bv, Bi, aEp, ic, aoi, ey, pl, Mr, js, hh, Ag, yG, SI, zJ, Bc, re, hV, PA, q, es, ND, jF, ar, ff, aJ, fE, Yr, fv, jG, u, QM, da, cW, aEf, hb, VD, qL, LR, dT, ad, pB, G, qp, ew, pD, iD, auA, apm, Lu, fG, Lt, aen, aEr, jH, axG, nV, WO, hX, iR, Yg, py, aoA, Jj, Sk, ih, anf, aof, ex, CL, aEj, dn, I, yA, oP, zD, A, iL, aov, k, fr, pR, FL, gN, qY, VM, BY, agj, e, lv, JC, zK, nT, jR, yE, iK, auC, RX, QV, Ez, gR, il, jy, Qm, h, F, jQ, yx, oE, cU, aC, ik, oJ, cB, aAO, aAS, QJ, aq, fp, ma, si, tl, sh, cV, Be, YR, J, Dr, W, jo, T, fO, Ze, Oi, aX, nP, azo, aEn, aph, LI, Zf, jT, Lc, jp, ip, Tq, OW, eX, fP, Af, E, bh, at, eG, fs, rb, oT); #c1(CCND2) c2(NP_001750) c3(1750) c4(27864, 40921, 53978, 14807, 67035) c5(bm, A, aw, iL, b, X, eu, wy, MS, BY, ck, lv, iG, O, vp, U, e, y, d, jR, fe, jT, px, kJ, t, h, hV, q, bu, ra, do, ar, B, fv, av, fy, u, cl, g, Qb, fU, V, I, cV, jG, fO, J, bp, by, Ov, G, zU, T, Ca, mD, x, jC, Os, fp, Lt, nV, hX, iR, er, ie, aoA, os, ag, cT, qP, Ou, jk, od, at); #c1 (CCND3) c2(NP_001129489) c3(1751) c4(27865, 40922, 53979, 14808, 67036) c5(A, aw, b, X, i, pD, w, O, U, fx, y, d, awK, aX, kJ, h, hV, e, q, es, cU, ar, B, cB, u, o, n, V, dA, dB, gm, fO, J, W, co, T, QY, bt, iA, jT, fM, nV, ch, Eo, ag, Af, cZ, I, Ez); #c1(CCNDBP1) c2(NP_036274) c3(1752) c4(27866, 40923, 53980, 14809, 67037) c5(co, gt, bm, q, ad, W, T, cB, cs, x u); #c1(CCNE1) c2(NP_001229) c3(1753) c4(27867, 40924, 53981, 14810, 67038) c5(aw, b, X, w, di, bw, e, y, d, cU, aEx, bb, f, q, dl, fr, ar, O, av, u, ma, yg, J, fO, ft, qp, T, cV, x, fx, jT, nV, jR, fP, Af, i, avz); ID #c1(CCNE2) c2(NP_477097) c3(1754) c4(27868, 40925, 53982, 14811, 67039) c5(A, kF, Dx, b, X, eG, h, B, J, ad, ll, cs, av, u, y); #c1(CCNF) c2(NP_001752) c3(1755) c4(27869, 40926, 53983, 14812, 67040) c5(u, y, b); #c1 (CCNG1) c2(NP_954854) c3(1756) c4(27870, 40927, 53984, 14813, 67041) c5(wh, ma, aw, b, X, bm, bp, q, nJ, J, cU, fr, T, oJ, iL, Xt, ft, AP); #c1(CCNG2) c2(XP_011530701) c3(1757) c4(27871, 40928, 53985, 14814, 67042) c5(il, b, cV, X, fO, dB, mA, do, aC, jo, w, ik, ff, O, av, u, y); #c1(CCNH) c2(NP_001186118) c3(1758) c4(27872, 40929, 53986, 14815, 67043) c5(b, Pv, vZ, fw, fx, O, d, Ag, co, cr, jd, h, e, cs, aV, u, g, fO, I, dA, cx, Qz, gm, T, bp, ct, J, ad, fM, cq, fy, os, cT, Af, i, I); #c1(CCN1) c2(NP_006826) c3(1759) c4(27873, 40930, 53987, 14816, 67044) c5(fr, kF, T, o, ft); #c1(CCNJ) c2(NP_001127847) c3(1760) c4(27874, 40931, 53988, 14817, 67045) c5(u, y); #c1(CCNJL) c2(NP_078841) c3(1761) c4(27875, 40932, 53989, 14818, 67046) c5(c0); #c1(CCNK) c2(XP_011535577) c3(1762) c4(27876, 40933, 53990, 14819, 67047) c5(f0); #c1(CCNL1) c2(NP_064703) c3(1763) c4(27877, 40934, 53991, 14820, 67048) c5(d, fl, I, f, F, aqt, T, e); #c1(CCNL2) c2(XP_011540521) c3(1764) c4(27878, 40935, 53992, 14821, 67049) c5(q); #c1(CCN0) c2(NP_066970) c3(1765) c4(27879, 40936, 53993, 14822, 67050) c5(g, zr, b, ht, Ot, P, w, aZ, bl, zQ, u); #c1(CCNT1) c2(NP_001231) c3(1766) c4(27880, 40937, 53994, 14823, 67051) c5(en, cV, ch, k, gm, P, cK, jT); #c1(CCNY) c2(NP_001269781) c3(1767) c4(27881, 40938, 53995, 14824, 67052) c5(d, jH, co, b, e, gY, ar, fP, fy, bj, aE, o); #c1(CCP110) c2(NP_055526) c3(1768) c4(27882, 40939, 53996, 14825, 67053) c5(fg, N); #c1(CCR10) c2(NP_057686) c3(1769) c4(27883, 40940, 53997, 14826, 67054) c5(fG, aX, dk, yh, jz, eE, mk, P, gj, yf, yi, ye, yj, jQ); #c1(CCR1) c2(NP_001286) c3(1770) c4(27884, 40941, 53998, 14827, 67055) c5(A, b, X, sE, DT, mW, ig, w, NH, zM, z, vp, al, e, aW, d, m, cy, ae, yN, yX, AX, B, q, nv, dQ, cs, aD, pH, zR, Hs, bm, gl, o, I, aC, aiU, fO, gL, eu, IR, IX, P, nk, od, fl, aZ, ad, av, jU, aV, NG, aei, Y, aE, axA, gd, ix, IS, fD, eG, DM, gl); #c1(CCR2) c2(NP_001116513) c3(1771) c4(27885, 40942, 53999, 14828, 67056) c5(dx, dM, lr, dD, aiu, iU, Ka, eH, aDg, sJ, w, cO, bf, OH, fx, O, BO, dv, cy, aDh, e, nv, dl, awq, sE, aC, du, fO, dB, aEy, aEC, jT, dL, gg, dS, fN, OR, ag, cT, i, bq, aA, bP, mZ, fl, anY, He, ig, xU, y, ed, co, BL, pp, DM, f, bu, B, av, iT, Bm, fz, aCG, v, eX, aEB, en, qW, dO, acF, xe, aDw, fO, b, qz, dk, vY, z, jO, aO, d, bb, re, vf, q, X, aM, u, aE, ri, fh, da, I, ht, j, by, Io, et, ao, hT, ex, gd, o, fl, I, BK, bL, A, gU, aCJ, gE, ea, di, eO, al, aDt, aW, m, or, sG, aEz, Vr, aV, wF, LR, hZ, be, P, ti, HK, HL, nk, DG, zE, Y, lc, vW, DI, fP, aEA, gj, at, eG, gl); #c1(CCR3) c2(NP_001158152) c3(1772) c4(27886, 40943, 54000, 14829, 67057) c5(dx, bL, aED, b, TQ, ig, jz, DT, Ka, Kc, kB, ix, NH, Ku, al, aW, Io, ed, jl, dv, bb, aCU, fq, h, fP, eE, JF, aD, fH, gg, jQ, aE, fh, ae, aC, TK, du, dk, dB, P, ti, T, II, aZ, aDe, cy, fJ, dH, jH, dP, NG, hT, gd, akm, DI, pH, i, I, bq, aA, at, DM, aDF); #c1(CCR4) c2(NP_005499) c3(1773) c4(27887, 40944, 54001, 14830, 67058) c5(bm, JH, jz, DT, ig, NH, Iv, aEE, sN, O, jQ, m, aX, fq, yh, q, mR, as, fH, gg, CX, u, aE, fh, da, ax, aC, bK, wE, P, cy, jT, fJ, dH, aoC, hU, dP, NG, aEG, aV, aEF, fG, pH); #c1(CCR5) c2(NP_000570) c3(1774) c4(27888, 40945, 54002, 14831, 67059) c5(dx dM, aw, aZ, sd, aiW, iU, vB, Ka, eH, aDG, en, aEO, aEZ, aEK, cO, aCO, fx, O, vr, dv, cy, AX, zH, Oz, dl, hG, jm, sO, aD, fH, g, ha, sE, aC, bK, du, gJ, avb, gY, od, aDE, vM, aEC, jT, aEY, dH, gE, qt, fc, F, sJ, ip, aEL, ag, w, i, bq, aA, bT, rn, aEN, bP, aEX, vY, anY, Kt, fO, cY, eu, aFd, kB, ix, Ku, bw, U, sN, aEI, y, rN, pp, yX, aFb, DM, B, aDD, jD, gX, ky, cs, vo, FG, ji, bm, iT, Bm, V, ae, aCG, Bs, fl, cd, aEP, IR, Io, eX, ny, gC, bd, k, fJ, eF, Mv, acF, Oa, P, dY, xe, aDL, gj, gR, aEQ, iu, bX, Dg, ap, asL, ach, adJ, kE, b, LX, qz, atU, dk, tN, fl, ic, z, re, vk, Ag, aDV, bb, aDr, yN, fv, vj, qd, q, dQ, oO, ar, u, dh, ri, fh, aET, PJ, I, im, ER, kt, ht, gL, aEM, da, IX, vS, agl, rB, et, jU, jH, nV, ig, fD, aFa, aE, IS, aEV, aER, gl, I, vZ, cK, aEJ, azt, bL, A, iL, gU, lk, gn, axA, di, aES, eO, al, vl, sb, oy, m, o, aX, fq, h, ox, abh, aEU, qB, aV, jZ, aFc, ax, cV, aEH, hZ, be, J, GB, bR, aoN, ti, T, ll, bh, aDA, ad, HL, aeq, Y, lc, aDy, zM, DI, fP, aEW, ew, at, eG, oT); #c1(CCR6) c2(NP_004358) c3(1775) c4(27889, 40946, 54003, 14832, 67060) c5(B, b, zH, sE, jz, gN, jd, O, A, vZ, ic, z, bw, U, y, jQ, aAH, qf, co, cy, ag, Bc, fq, aCR, hV, yh, q, QE, HQ, qB, Ek, fy, u, da, PJ, V, cV, bx, be, fO, j, by, IJ, nk, bp, hU, jT, jU, yG, jH, nV, Eu, Y, P, fP, gd, ix, fl, aC, I, ji, aA); #c1(CCR7) c2(NP_001829) c3(1776) c4(27890, 40947, 54004, 14833, 67061) c5(dx, B, aw, N, cO, nU, O, M, dv, t, e, jq, fH, pq, og, lb, du, fO, bp, x, jT, dH, ag, cT, pt, aA, bT, X, jz, eu, ix, IW, bw, U, y, co, pw, AZ, f, LI, cs, bu, iv, av, fy, cj, V, ae, IR, pr, pJ, jC, fJ, JY, hi, fG, oM, ci, fn, WH, b, Pv, jL, dk, IN, d, jh, hV, q, jV, QE, ar, jG, u, aE, da, LR, gL, ad, IX, IJ, jH, nV, uJ, IS, fl, A, pF, JS, Ik, gn, aFe, BY, Iv, eM, al, jQ, m, MT, aX, ajn, h, F, cU, n, aV, ax, J, P, T, aox ji, jl, by, G, j, at); #c1(CCR8) c2(NP_005192) c3(1777) c4(27891, 40948, 54005, 14834, 67062) c5(P, cy, dk, Kp, DT, sN, gd, cT, fq, gg, eG); #c1(CCR9) c2(NP_001243298) c3(1778) c4(27892, 40949, 54006, 14835, 67063) c5(dx, jl, A, b, X, jz, ig, Iv, y, jQ, yg, dv, aX, t, B, aD, av, u, yd, m, aC, jL, du, J, P, cy, nk, dk, G, gd, rl, at, eG); #c1(CCRL2) c2(NP_001124382) c3(1779) c4(27893, 40950, 54007, 14836, 67064) c5(A, JH, b, zH, ig, sE, jz, gN, mk, ix, ic, z, U, jD, HQ, jQ, aCy, co, cy, Bc, fq, aCR, hV, yh, q, aC, do, B, fP, da, PJ, Pz, V, il, bx, yY, be, fO, j, IJ, bp, ji, Eu, jU, yG, jH, nV, hU, eF, aCx, Y, P, xe, ag, fl, I, Oi, aA, ap); #c1(CCRN4L) c2(NP_036250) c3(1780) c4(27894, 40951, 54008, 14837, 67065) c5(JH, b, jz, DT, NH, Iv, aEE, U, sN, jQ, m, aX, fq, yh, fJ, mR, as, fH, CX, aEG, aE, da, ax, V, aC, bK, wE, bp, P, cy, dL, qh, dH, aV, hU, dP, NG, fN, aEF, fG, pH, aA); #c1(CCSER1) c2(NP_001138537) c3(1781) c4(27895, 40952, 54009, 14838, 67066) c5(oy, td, b, Eo, ag, dd); #c1(CCS) c2(NP_005116) c3(1782) c4(27896, 40953, 54010, 14839, 67067) c5(ao, aX, V, cl, PY, ayi, acU, QI, bb, fK, aFf, U); #c1(CCT2) c2(NP_006422) c3(1783) c4(27897, 40954, 54011, 14840, 67068) c5(bb, cp); #c1(CCT3) c2(NP_001008800) c3(1784) c4(27898, 40955, 54012, 14841, 67069) c5(V, el, q, v, dt, P, U); #c1(CCT4) c2(NP_001243650) c3(1785) c4(27899, 40956, 54013, 14842, 67070) c5(PL, cV); #c1(CCT5) c2(NP_036205) c3(1786) c4(27900, 40957, 54014, 14843, 67071) c5(PL, IK, V, aFg, Bu, QC, yp, P, fl, aFh, dV, U, u); #c1(CCT6A) c2(NP_001009186) c3(1787) c4(27901, 40958, 54015, 14844, 67072) c5(d, U, V, e); #c1(CCT6B) c2(NP_001180458) c3(1788) c4(27902, 40959, 54016, 14845, 67073) c5(pD, b); #c1(CCT7) c2(NP_001009570) c3(1789) c4(27903, 40960, 54017, 14846, 67074) c5(V, bu, nd, P, bq, mK, U); #c1(CDI09) c2(NP_001153059) c3(1790) c4(27904, 40961, 54018, 14847, 67075) c5(oy, d, WE, fU, Sl, b, fr, Bg, ft, aC, P, T, x, ar, u, e); #c1(CDI4) c2(NP_001167576) c3(1791) c4(27905, 40962, 54019, 14848, 67076) c5(dx, fn, B, aw, Io, Ob, Gm, iU, aE, Ka, eH, sJ, w, cO, fR, OH, uA, dv, cy, Bl, aDw, gB, Pn, dl, do, aFA, ul, Pv, aFn, fH, Kd, gl, TP, mz, JP, fe, aC, ol, sH, du, gm, fO, dB, JQ, Q, fx, JN, oh, FG, dH, aDb, aoC, gs, akn, iL, dS, fc, aFB, hx, Ox, tO, ag, cT, NU, pv, bk, i, bq, aA, aEN, asL, id, Kt, iP, aFu, eu, Kc, mk, aFm, JE, U, ex, y, rN, DG, yE, DM, f, bu, aFv, JX, iJ, akk, DF, CG, Bm, o, Gr, V, ae, bx, nl, n, WL, gv, fq, aFs, aFo, bt, bb, bd, pi, fJ, be, xd, dO, dP, QE, dY, aDL, Im, iu, fW, TA, aG, aFI, WH, bn, b, zH, aF, eR, DJ, aDA, vY, fl, yU, tG, z, eV, yK, Xy, Iz, yN, zJ, jd, bX, q, jV, ap, CO, aFr, dQ, qe, ar, jG, u, dh, ri, fh, sz, sQ, I, qL, ahS, ju, fz, gL, aFy, aD, aFz, aFj, aZ, sN, et, aEC, jH, ao, hU, ig, fD, aFw, xU, gd, kC, aaM, aFk, aFi, aFp, fl, I, xa, bL, A, JC, kb, TI, kg, Jl, gN, Lu, aFq, fw, vg, gE, ZK, al, aFx, hP, vl, m, xT, jl, ty, kn, bj, h, Vr, ik, fy, fP, aV, jZ, aAq, ax, sj, sB, J, asM, W, bR, P, ti, T, ll, aFt, by, pc, jT, nk, zE, Ic, vc, tA, eX, Dl, j, aBz, wG, bh, at, LQ, Dq); #c1(CDI51) c2(NP_001034579) c3(1792) c4(27906, 40963, 54020, 14849, 67077) c5(A, aw, b, jz, w, Iv, axq, e, y, jQ, d, co, LS, B, q, bu, O, cs, gg, fy, u, dh, LR, J, ad, vc, T, aX, by, et, aFD, fD, bq); #c1(CDI63) c2(NP_004235) c3(1793) c4(27907, 40964, 54021, 14850, 67078) c5(dx, fl, aw, b, zH, fr, aF, iP, jL, Fc, O, qP, eO, bf, U, fD, y, dv, aX, ae, ty, jd, h, f, bu, iK, VM, av, u, da, du, V, I, azM, aC, hZ, LR, ft, aFE, P, jG, Jc, bq, iN, jC, fx, by, pi, tU, aM, jH, ao, hU, pS, oj, fP, Bm, i, I, Im, aA); #c1(CDI63L1) c2(NP_777601) c3(1794) c4(27908, 40965, 54022, 14851, 67079) c5(aX); #c1 (CDI64) c2(NP_001135873) c3(1795) c4(27909, 40966, 54023, 14852, 67080) c5(A, X, fG, ar, av, pz); #c1(CDI77) c2(NP_065139) c3(1796) c4(27910, 40967, 54024, 14853, 67081) c5(bL, en, cT, b, aFF, aF, aN, sJ, w, aFG, gE, O, A, y, jx, jh, aFJ, m, pz, AX, aFH, N, q, bu, pn, hN, ar, B, cs, fg, OA, fy, u, aE, n, iF, bm, V, I, cV, el, afc, Cz, fO, ad, IR, dU, P, fl, T, kX, by, jG, pq, yG, VQ, IX, pP, F, pF, Ck, ne, aFI, IN, jT, IS, afK, ew, h, pv); #c1(CDI80) c2(NP_005573) c3(1797) c4(27911, 40968, 54025, 14854, 67082) c5(em, A, m, cT, gE, aA, bT); #c1(CDI9) c2(NP_001171569) c3(1798) c4(27912, 40969, 54026, 14855, 67083) c5(WH, ach, afE, gE, kE, b, oz, eu, mW, Ip, ig, m, en, ur, eM, Ou, Zq, M, aX, aov, pp, t, h, px, aDm, jV, dl, ajK, ky, fy, iv, oO, aFL, jG, aV, gl, n, aFM, Ov, cV, aC, aFK, fO, gm, j, J, bR, P, ll, fH, cy, D, jT, fj, jH, aFN, Jh, bX, ie, G, asM, pa, oj, cT, axC, CL, ab, fl, oR, jl, fl, bT, zD); #c1(CD1A) c2(NP_001754) c3(1799) c4(27913, 40970, 54027, 14856, 67084) c5(en, b, cM, pw, fq, h, Pn, QE, zm, as, jG, aV, u, aE, QL, og, aFO, J, gj, P, sf, T, yj, qt, Y, aY, ex, dc, l); #c1(CD1B) c2(NP_001755) c3(1800) c4(27914, 40971, 54028, 14857, 67085) c5(da, en, b, cA, xe, cM, fq, h, q, Pn, QE, zm, cs, as, jG, aV, u, aE, QL, fi, og, aFO, aFP, awD, J, ad, I, P, T, yj, qt, Y, aY, Ck, ex, fc, Bm, dc, gj); #c1(CD1C) c2(NP_001756) c3(1801) c4(27915, 40972, 54029, 14858, 67086) c5(en, b, vp, cM, pp, fq, h, Pn, QE, zm, iv, as, jG, aV, u, aE, QL, og, aFO, J, I, P, T, yj, qt, Y, aY, Ck, ex, cT, dc, gj, bT); #c1(CD1D) c2(NP_001757) c3(1802) c4(27916, 40973, 54030, 14859, 67087) c5(mZ, en, Pb, Ob, WH, gE, fq, mk, fl, C, iL, bf, aw, vl, G, fR, cM, aFR, xT, cy, b, QE, Kp, h, cV, q, Pn, aFQ, zm, y, as, yW, aV, u, aE, QL, og, aFO, aC, bK, dc, fO, J, gL, da, alf, pr, P, mX, T, ll, akT, jT, pi, jG, ac, aM, yG, ig, aY, bm, I, jR, ex, cT, fP, bk, t, gj, bh, aA, wz, jU); #c1(CD1E) c2(NP_001036048) c3(1803) c4(27917, 40974, 54031, 14860, 67088) c5(en, b, cM, fq, h, im, Pn, QE, zm, as, jG, aV, u, aE, QL, og, aFO, J, gj, P, T, ao, aY, dc, l); #c1(CD200) c2(NP_001004196) c3(1804) c4(27918, 40975, 54032, 14861, 67089) c5(sX, aX, b, cY, bj, h, eu, fO, J, zM, fc, cT, ll, iv, x, cy, aV, u, bq, y); #c1(CD200R1) c2(NP_620161) c3(1805) c4(27919, 40976, 54033, 14862, 67090) c5(cU, sG, b, ami, bj, h, B, v, abN, NJ, do, A, zM, amh, Yr, aV, u, y, oT); #c1(CD207) c2(NP_056532) c3(1806) c4(27920, 40977, 54034, 14863, 67091) c5(fg, aFS, N, fP, QE); #c1(CD209) c2(NP_001138365) c3(1807) c4(27921, 40978, 54035, 14864, 67092) c5(JH, aFT, iU, ig, Iv, z, al, U, aCV, cy, fq, DM, aDx jD, aBs, sQ, V, aC, dB, gL, gY, P, ll, yG, jH, Dl, Bm, bh, gE, AX); #c1(CD22G) c2(NP_001290547) c3(1808) c4(27922, 40979, 54036, 14865, 67093) c5(A, b, IE, U, yV, m, jT, aX, q, aFL, aV, aos, aE, da, PJ, ax, V, im, aC, aeU, j, T, fO, vM, cy, Pk, dH, eG); #c1(CD22) c2(NP_001172028) c3(1809) c4(27923, 40980, 54037, 14866, 67094) c5(b, aF, m, jl, t, h, M, iv, oO, Yb, an, be, gm, j, J, as, vc, fO, jT, G, pa, cT, gR, gD, zD); #c1(CD244) c2(NP_001160135) c3(1810) c4(27924, 40981, 54038, 14867, 67095) c5(m, abg, aC, bK, h, J, mW, Zs, j, gl); #c1(CD247) c2(NP_000725) c3(1811) c4(27925, 40982, 54039, 14868, 67096) c5(b, iU, mW, ig, di, iL, eM, U, O, cp, m, aFU, f, bu, n, av, gl, ax, V, aC, j, by, P, T, jG, dH, aEb, cT); #c1(CD248) c2(NP_065137) c3(1812) c4(27926, 40983, 54040, 14869, 67097) c5(en, kE, b, fr, w, A, Zz, MT, aX, axd, cs, gO, g, fU, aFV, cV, aC, be, ft, dU, T, aei, xe, aFW); #c1(CD24) c2(XP_011533677) c3(1813) c4(27927, 40984, 54041, 14870, 67098) c5(A, aw, iL, b, k, X, gG, eu, kB, sJ, w, jE, kY, O, jy, Ir, U, hP, aeC, y, V, BO, fe, co, pp, kJ, t, f, q, bu, M, ar, B, fP, av, aV, u, jZ, oJ, yJ, PJ, fU, ahF, cV, sH, dB, J, j, by, m, Ba, T, bp, fx, vA, et, wh, ack, iY, fc, bm, nJ, ag, jT, atb, i); #c1(CD274) c2(NP_001254635) c3(1814) c4(27928, 40985, 54042, 14871, 67099) c5(en, aw, gG, dB, Ip, w, aCO, e, O, eE, do, fH, IV, gl, aC, fO, gm, bp, fx, jT, iz, sS, fc, bY, aFX, ag, cT, i, bT, Kt, cY, jz, ix, Ku, kY, bf, U, y, pp, B, bu, av, fy, bm, V, nl, jC, fJ, JY, P, ji, iu, anh, b, z, d, dl, q, X, ar, ff, jG, aCK, u, aE, il, gL, by, aZ, yG, rq, gd, fl, A, Ik, gn, mW, iL, gE, al, jQ, m, aX, kn, h, ik, n, cB, aV, jZ, J, jo, T, ll, aM, nk, UE, fP, bh, oT); #c1(CD27G) c2(NP_079516) c3(1815) c4(27929, 40986, 54043, 14872, 67100) c5(aFY, b, X, iP, dB, mW, sJ, w, iG, O, bf, U, A, e, y, d, m, aX, zu, asy, ag, re, ak, q, fr, B, cs, av, aV, u, gl, aFZ, V, cV, aC, j, ad, P, aE, T, asz, aur, ft, Ut, aM, DO, qQ, OJ, gd, fP, iT, bq, iu, ja); #c1(CD27) c2(NP_001233) c3(1816) c4(27930, 40987, 54044, 14873, 67101) c5(fn, WH, en, zr, b, LX, anb, iU, mW, aGb, bV, aoH, Ou, bf, y, yK, m, co, aX, px, aoR, t, aoF, j, yh, aDm, cy, O, Dc, jG, u, gl, aoh, aE, Ad, CZ, Ov, aC, be, fO, gm, gL, J, qO, P, ti, ll, afb, aGa, PZ, jT, ac, aM, rS, G, K, dh, Ot, cT, CL, gR, CV, bT, zD); #c1(CD28) c2(NP_001230007) c3(1817) c4(27931, 40988, 54045, 14874, 67102) c5(en, vk, sE, Ip, Zs, bf, cy, t, yh, Dc, aD, gl, aC, ol, gm, fO, BW, jT, pb, Ox, cT, axC, aFZ, bq, jl, bT, aEN, anY, Kt, dE, eu, ig, ix, Ku, v, U, yV, pw, pp, DM, f, aGe, NB, fy, iT, V, nl, cd, dP, P, xe, gR, abs, iu, kE, b, Pv, yK, aGd, re, zm, ar, u, nj, da, l, im, j, G, jU, cW, jH, mk, DR, xU, Bm, l, aFY, mW, iL, gE, aW, m, aX, kn, fq, aE, aV, Ac, aFM, wF, qO, Ea, sj, be, J, axl, ll, BL, aM, aGc, ii, Y, hq, cb, Dl, auy, iB, at, Nu, gl); #c1(CD2AP) c2(NP_036252) c3(1818) c4(27932, 40989, 54046, 14875, 67103) c5(bP, dD, xQ, bf, xz, et, aGh, aGg, oD, aq, aE, o, te, ma, wB, nl, gm, v, bd, wd, aGf, aM, hU, aGi, fD, hc); #c1(CD300A) c2(NP_001243770) c3(1819) c4(27933, 40990, 54047, 14876, 67104) c5(bq, ll, gE); #c1(CD300C) c2(NP_006669) c3(1820) c4(27934, 40991, 54048, 14877, 67105) c5(b); #c1(CD300LF) c2(NP_001276011) c3(1821) c4(27935, 40992, 54049, 14878, 67106) c5(NG, DT, NH, II, gE, Xz); #c1(CD302) c2(NP_001185692) c3(1822) c4(27936, 40993, 54050, 14879, 67107) c5(fH, B, T, fJ); #c1(CD320) c2(NP_001159367) c3(1823) c4(27937, 40994, 54051, 14880, 67108) c5(aGj, LA, LB, nh, ck); #c1(CD33) c2(NP_001076087) c3(1824) c4(27938, 40995, 54052, 14881, 67109) c5(b, aN, oR, jy, aK, e, y, d, t, h, f, jV, M, n, iv, oO, jG, fy, u, o, cj, FK, jH, gm, gL, J, P, pt, jT, iw, Qk, ie, G, dY, cT, oM, aA, ci); #c1(CD34) c2(NP_001020280) c3(1825) c4(27939, 40996, 54053, 14882, 67110) c5(dx, jK, ml, aw, zh, dB, HG, eW, w, aCP, bf, fR, pz, oU, O, BO, dv, cy, b, kT, t, CN, e, CK, mR, aD, fH, yG, n, Jl, fe, aC, nl, du, Ej, fO, fl, Q, BW, fy, qt, jT, ss, pq, pb, wh, xO, oQ, BX, dS, fc, De, ie, ip, ag, cT, pv, dh, oR, ael, wz, aEN, gE, X, arQ, jz, eu, pJ, aGq, xK, aAM, JE, bw, U, ex, y, CZ, co, agn, pp, yE, f, N, bu, Em, jS, iv, Tk, av, ajR, pP, iT, cj, auP, V, ae, afc, LR, J, pr, akg, ny, pt, aGr, Lx, aA, aqf, aGI, gR, oM, iu, ci, ap, fn, Tp, lH, uS, aGk, aGv, od, yU, ic, z, jy, pF, gZ, d, bb, SI, jd, Qu, hV, q, jV, es, QE, ar, VM, Tr, jG, u, nj, o, iP, il, qL, kt, qC, by, as, G, sf, agl, aGn, CF, XR, wy, ii, jH, nV, xL, oe, iR, yC, Ck, he, pa, fg, Ol, bq, bL, iL, Lw, Ln, gw, GE, BY, Iv, JC, eM, zK, jb, lr, jx, m, QV, aX, ajn, aGp, Ec, kn, h, jQ, gT, M, re, ik, oJ, Ll, aV, aq, iq, wo, aGu, cV, fJ, LG, W, dU, P, T, ll, Ez, jl, aGs, aGm, fM, aM, aeq, LQ, aGt, kA, aGo, bh, at, Nu); #c1(CD3G) c2(NP_001001547) c3(1826) c4(27940, 40997, 54054, 14883, 67111) c5(dx, jK, ak, aeB, aGy, dD, eH, eW, cO, bf, e, dv, om, kz, mR, n, mz, aC, du, hR, dL, gg, pq, qt, dS, fN, fD, dc, vJ, bq, aA, fl, axq, xK, U, xw, cM, Ei, RD, pp, f, cs, hj, bm, tQ, em, V, ae, cs, Fy, eX, cK, aaa, aY, aGx, P, ci, ap, aGC, b, z, ey, eV, d, bb, aGw, q, acO, aM, u, aE, o, kF, l, LR, gL, ad, et, ch, ue, rv, aGz, fr, UA, di, aGA, wf, al, aW, oy, qs, aX, fq, h, y, PT, ma, nQ, mc, J, axl, aFt, pF, sK, at, DG, aGB, gj, bh, eN, eG); #c1(CD37) c2(NP_001765) c3(1827) c4(27941, 40998, 54055, 14884, 67112) c5(en, jl, rD, b, t, J, cT, fl, G); #c1(CD38) c2(NP_001766) c3(1828) c4(27942, 40999, 54056, 14885, 67113) c5(gK, bn, td, aov, asx, Pv, jz, DT, pD, ig, Iv, aEa, bf, fR, G, nU, cp, m, b, co, cy, or, pp, ahj, t, h, eX, jV, gT, jQ, n, iv, jG, pq, WH, gl, o, cj, em, rq, gR, l, cV, aC, hZ, aGD, gm, gL, eu, CZ, amX, fO, Hh, J, cz, aM, jT, rQ, qt, aq, ie, P, aE, zZ, eB, cT, CL, cZ, aA, at, Nu, ci); #c1(CD3D) c2(NP_000723) c3(1829) c4(27943, 41000, 54057, 14886, 67114) c5(jT, aGE, anG, b, ig, Dc, z, eM, eu, J, aGH, aEb, aGG, gj, je, bT, aGF); #c1(CD3EAP) c2(NP_036231) c3(1830) c4(27944, 41001, 54058, 14887, 67115) c5(dx, Kt, di, bj, co, aX, alh, VX, fy, QD, xc, be, V, du, FC, fO, W, dv, jT, jU, tl, i); #c1(CD3E) c2(NP_000724) c4(27945, 41002, 54059, 14888, 67116) c5(A, cO, jz, eu, aGH, ig, aGI, eM, jQ, aGE, pp, B, ar, iv, azx, av, iR, aE, aC, dB, T, aGJ, aX, aY, tl); #c1(CD3G) c2(NP_000064) c3(1832) c4(27946, 41003, 54060, 14889, 67117) c5(fl, aC, h, Dc, eu, J, ig, P, eM, aGJ, aGK, jT); #c1(CD40) c2(NP_001241) c3(1833) c4(27947, 41004, 54061, 14890, 67118) c5(dx, ak, aw, Zq, WH, aGV, dD, oz, dB, eC, oO, vp, e, O, cp, BO, dv, cy, t, aFH, yh, dl, mR, fH, n, gG, aGW, nl, du, gJ, gm, avb, x, fx, jT, zQ, dH, GL, eH, xO, abv, dS, Ox, ie, ag, IN, axC, dh, i, bq, aA, bT, bP, jS, zr, fO, cY, eu, mk, ix, aoH, bf, si, y, co, BL, Ov, pp, hm, DM, f, cT, bu, aFL, B, cs, av, fy, fY, Bm, wK, fD, aGT, afc, v, aGO, aGS, pr, eX, bt, fJ, MW, eF, aoy, py, jo, fw, fG, qO, UT, iu, hc, ap, aGP, adJ, bA, afa, b, zH, anb, dk, z, aGM, aO, d, bb, fv, hV, q, zx, afb, X, pn, dQ, ar, jG, u, nj, o, fh, da, PJ, fs, I, UK, sX, aiU, LR, gL, ad, CM, G, rw, Io, jU, P, jH, nV, ig, iR, tW, aoA, he, xU, aGQ, gd, Ou, zO, fl, I, bp, zD, aGU, bL, A, xu, k, LF, gn, pD, xa, iL, Pl, m, Ot, aX, fq, h, aeY, zB, aE, cB, aV, jZ, iq, ma, hW, cV, aB, be, J, asM, HQ, T, j, aGN, jl, by, aM, aGR, ii, aDv, LQ, Ic, abX, aGL, Dl, fP, iB, at, eG, gf, aeZ); #c1(CD40LG) c2(NP_000065) c3(1834) c4(27948, 41005, 54062, 14891, 67119) c5(dx en, aw, zw, Zq, WH, aGV, aiW, dB, Oo, w, Ig, e, O, dv, cy, uS, t, aFH, yh, Oz, eE, mR, aHa, fH, gl, n, g, sE, jH, aC, du, gm, bp, vM, x, Eu, fx, jT, zQ, cq, abv, eW, fc, Ox, bY, aHc, ag, cT, axC, bk, i, bq, aA, bT, id, zr, zu, X, aHb, iP, eu, mk, fU, iG, vp, U, Jo, y, co, BL, RD, pp, Ot, aGM, DM, B, cs, bu, Em, aFL, jS, iv, av, fy, bm, aFZ, V, ae, zA, v, IR, eX, aGU, pi, fJ, eF, P, fG, ji, aGZ, fD, ap, gG, aGP, adJ, b, zH, aF, anb, z, ey, aGX, eV, d, bb, bX, hV, q, zx, ar, u, nj, o, fh, da, aGY, kF, l, sX, awD, fz, l, ad, CM, G, pD, Io, et, iw, ao, nV, hU, IS, iR, vT, uH, gd, IS, Bm, xa, bL, A, bf, xu, IW, mW, Iv, eM, jw, m, aX, kn, h, zB, hN, aoQ, aE, asW, aV, awC, ma, cV, sj, be, J, asM, dt, axl, T, fO, aGN, jl, gF, by, aM, nk, ii, zE, IX, abN, Dl, fP, bh, aT, at, MU, gf); #c1(CD44) c2(NP_000601) c3(1835) c4(27949, 41006, 54063, 14892, 67120) c5(dx, B, aw, iD, EM, sE, awh, Vz, w, cO, bf, aK, aeC, O, cp, BO, wo, dv, cy, ajF, kJ, Bl, t, gB, e, adH, dl, kP, acy, PH, gl, R, g, fe, aC, p, du, fO, gm, bp, ft, aiL, x, fx, jT, dL, gg, gQ, aHi, jE, aV, BX, fN, DO, os, ip, aEL, ag, cT, oi, vK, i, aA, jl, dB, Dr, GD, sa, fl, cY, ie, afY, oa, jz, eu, wy, mk, fU, kY, ajw, bw, U, Oh, y, SV, tp, co, pw, aoR, hm, adr, f, UV, bu, gX, Em, k, cs, av, fy, bm, iT, wP, is, fi, V, Cq, cd, akT, Hq, ny, bb, iA, JY, ahT, GB, aH, ack, aen, P, tl, ji, apU, ap, gG, An, b, zH, aHj, jL, Hr, Bh, ic, Fr, aoi, Mr, d, jh, Ii, Dx, aiT, jd, re, hV, aEq, q, jV, X, ar, ff, aHe, Um, fv, jG, Tv, u, nj, o, iP, Pz, I, ER, Fw, LR, gL, ad, IJ, Yi, pD, aZ, ct, aHf, M, aHg, jH, wV, nV, iR, jc, Bg, agb, yy, gD, ZL, yA, Iv, ZB, A, Tq, qd, fr, HJ, mW, Rd, ot, BY, og, HS, iL, gE, kF, jw, hP, yE, jQ, m, aX, Ll, Qm, aHd, h, F, aBd, cU, rR, cB, qB, fM, Tl, fQ, ma, ez, cV, be, Fs, J, aHh, W, jo, T, j, cr, by, ac, aM, VF, qp, pp, QN, LQ, Jh, hq, G, fP, Af, Yv, Oi, at, eG, fs, rb, gl); #c1(CD4G) c2(NP_002380) c3(1836) c4(27950, 41007, 54064, 14893, 67121) c5(B, aw, cO, vp, oU, O, Hg, sL, mg, Hs, g, ft, cV, cv, jT, fp, fc, YA, aHI, pW, fD, gD, bP, X, iP, iG, y, co, f, e, ky, JX, iv, oD, av, fy, bm, iT, dX, jB, qb, aHk, kU, aHo, ll, b, Fc, d, re, q, ar, tg, u, dh, o, Dg, LR, gL, aHn, CM, Fk, Aj, et, Ut, hU, rq, I, A, k, fr, acH, aW, c, aX, F, oE, DV, Ek, aV, m, hZ, be, P, T, aHm, jl, Bb); #c1(CD47) c2(NP_001768) c3(1837) c4(27951, 41008, 54065, 14894, 67122) c5(A, aw, b, zH, cY, F, Id, Em, wn, w, aaZ, kY, z, VX, y, MT, co, aX, pp, t, h, f, zh, q, jV, M, kz, k, B, cs, fH, aV, u, dh, iT, n, be, lb, hZ, LR, J, fO, pF, IR, IX, T, eq, bb, fx, jT, fJ, aHp, jE, DG, pS, fc, bm, PY, ag, cT, oi, IS, i, aU, re); #c1(CD48) c2(NP_001769) c3(1838) c4(27952, 41009, 54066, 14895, 67123) c5(A, b, Pv, sE, mW, eM, fR, y, m, kT, t, h, B, n, u, gl, aC, J, G, jT, lp, ne); #c1(CD4) c2(NP_000607) c3(1839) c4(27953, 41010, 54067, 14896, 67124) c5(bn, gn, fl, NH, C, gE, jD, d, c, ip, cs, e, qB, aV, u, aE, l, m, aC, akH, fO, gL, aHn, aoN, ll, ny, aHq, fG, BX, NG, P, aDL, pH, i, I, hM, HS);

c1(CD55) c2(NP_000565) c3(1840) c4(27954, 41011, 54068, 14897, 67125) c5(bm, A, b, k, X, cs, aHt, eM, U, aHp, fR, aW, yt, aHr, jT, jl, kT, f, q, aHu, y, iv, av, u, n, ci, ma, V, aHs, aC, p, sH, LR, J, gL, ad, xq, T, ll, cV, aHv, x, by, pi, jG, be, jH, nh, vu, aq, tO, cT, iB, at, eG, BK, jU, sU); #c1(CD59) c2(NP_001120695) c3(1841) c4(27955, 41012, 54069, 14898, 67126) c5(avO, dx, mL aZ, HG, dM, cO, bf, fR, aHp, e, gO, aHr, bQ, kT, aHw, om, mR, Uy, n, mz, fe, aC, du, gJ, aHv, x, jT, pq, of, qt, dS, Ox, cT, bk, fD, dc, vJ, bq, aA, bP, fl, X, dE, GO, ig, U, cM, yt, co, ajx, ml, f, bu, B, iv, av, fy, bm, d, V, yg, cd, Fy, dv, eX, Hh, aY, zS, ci, ap, b, ami, cK, ey, yK, nU, q, aHu, ar, as, HE, jG, sK, u, aE, o, l, gL, by, aHn, Fk, et, hU, mA, ue, fl, D, A, iL, axA, di, hA, eM, wf, aW, MT, aX, h, y, aq, jZ, ma, cV, an, be, J, T, jl, gF, aM, TU, FL at, gl); #c1(CD5) c2(NP_055022) c3(1842) c4(27956, 41013, 54070, 14899, 67127) c5(jT, jl, b, aC, jz, ie, gm, fO, J, cT, CL, aHx, jQ); #c1(CD5L) c2(NP_005885) c3(1843) c4(27957, 41014, 54071, 14900, 67128) c5(Fw, er, qr, ag, fP, Fg, WS, iu, o); #c1(CDG3) c2(NP_001244321) c3(1844) c4(27958, 41015, 54072, 14901, 67129) c5(b, k, cY, HG, w, Vy, aks, y, BO, aX, pp, pz, uB, CO, aHz, O, cs, ar, av, u, og, aHy, Fs, gL, ad, P, aC, pF, gt, dP, DO, l, X, pv); #c1(CD68) c2(NP_001035148) c3(1845) c4(27959, 41016, 54073, 14902, 67130) c5(dx, lr, dB, aN, eH, sJ, cO, bW, aK, BO, dv, cy, mz, aL, aC, bK, du, yO, bp, aFE, EG, Iq, dS, dh, fD, aA, aaA, bP, fl, anY, fO, X, iP, jz, Kc, kB, dV, y, V, co, pp, f, vQ, bu, dZ, av, rN, nl, cd, bQ, Hh, PY, oj, tl, TA, aHB, b, jC, zJ, jd, aug, apB, as, jG, u, nj, o, QL, Id, l, Xu, j, ad, da, iN, jH, ch, xU, gd, l, bL, A, qd, gw, C, gE, zK, al, iK, jx, aHA, aX, n, abk, jQ, an, P, T, ll, by, eJ, adb, fP, atR, at, eG); #c1(CDG9) c2(NP_001772) c3(1846) c4(27960, 41017, 54074, 14903, 67131) c5(WH, hq, eu, aE, lp, ix, bV, cO, bW, al, O, m, wZ, cy, pp, jd, t, B, F, q, qr, aHC, zb, Dc, jZ, n, nl, aC, Fw, be, j, P, BW, cK, jT, iz, sS, Jh, er, G, xU, ag, cT, fP, iB, WS, gl); #c1(CD6) c2(NP_001241679) c3(1847) c4(27961, 41018, 54075, 14904, 67132) c5(bP, fr, px jT, b, pH, cY, ie, bo, pz, FA, FT, NH, jV, pK, aiE, aHM, Bz, aiP, y, jh, atj, aX, jd, t, h, f, N, jA, ps, es, M, aiQ, aHI, RF, aHH, iv, oO, Zh, jG, aV, u, jZ, oJ, TV, aHN, Ji, G, aHK, an, gm, aHO, J, jx, as, aHG, sf, T, pD, aHL, FW, aeC, aHF, cq, aHJ, wh, aHE, n, NG, hX, aq, azy, DO, adu, aC, cT, fg, gR, Aa, QP, avL, aHD, ci, ib); #c1(CD72) c2(NP_001773) c3(1848) c4(27962, 41019, 54076, 14905, 67133) c5(t, G, Em, gl, m); #c1(CD74) C2(NP_001020329) c3(1849) c4(27963, 41020, 54077, 14906, 67134) c5(dx, A, b, pR, lk, dB, mW, ig, vY, w, cO, e, O, d, eE, co, aX, aEz, q, dl, ar, ff, fy, u, dh, em, iP, m, du, fO, bp, W, jo, dv, T, ll, oi, aEB, P, jH, jT, bY, gl, ag, cT, qP, l, eG, bT, ap); #c1(CD79A) c2(NP_001774) c3(1850) c4(27964, 41021, 54078, 14907, 67135) c5(en, Zq, anb, Zs, fl, aHP, Ou, co, jl, b, t, aoF, px, iv, u, CZ, Ov, aBI, gm, fO, J, P, jT, G, pa, cT, pl, h, bT); #c1(CD79B) c2(NP_000617) c3(1851) c4(27965, 41022, 54079, 14908, 67136) c5(Zq, z, m, jl, b, aHQ, hN, oO, fH, aHR, fO, gm, G, J, jT, fJ, iw, hX, aei, cT, aqh, zD); #c1(CD7) c2(NP_006128) c3(1852) c4(27966, 41023, 54080, 14909, 67137) c5(avb, t, h, yh, PY, G, iG, iv); #c1(CD80) c2(NP_005182) c3(1853) c4(27967, 41024, 54081, 14910, 67138) c5(en, dB, sJ, bf, e, O, cy, t, fH, gl, g, Ad, aC, bK, aHS, gJ, gm, fO, PZ, fx, jT, xO, cT, pH, i, yf, bT, fl, jz, ig, NH, U, y, co, DM, bu, av, fy, iT, V, bd, jC, fJ, P, xe, ji, hX, b, aF, d, re, q, zm, ar, jG, u, nj, il, gL, by, G, vw, jH, mk, iR, NG, rq, aHT, xX, fl, l, aHU, mW, iL, gE, jQ, m, aX, h, ik, aE, qB, aV, cV, J, bR, axl, T, ll, aM, Y, hq, PB, cb, Dl, at, MU); #c1(CD81) c2(NP_004347) c3(1854) c4(27968, 41025, 54082, 14911, 67139) c5(WH, oH, gE, al, O, aX, q, vQ, bm, Yb, ae, cV, kt, fO, gL, P, ll, mF, aA, qt, aHV, i, l, yA, Gl); #c1(CD82) c2(NP_001020015) c3(1855) c4(27969, 41026, 54083, 14912, 67140) c5(Dr, A, aw, b, cY, eu, di, e, U, Uq, hP, fx, y, d, jh, co, aX, iR, re, Si, aHW, q, bu, cU, X, aHY, B, cs, ar, av, fy, u, iT, R, yJ, qL, bm, V, cV, Be, Xk, dB, J, fO, ad, W, P, T, ff, ct, iA, by, auf, jE, nV, aHX, OJ, sh, ag, i, sg, aC, Ez, aA, eG); #c1(CD83) c2(NP_004224) c3(1856) c4(27970, 41027, 54084, 14913, 67141) c5(aEq, A, iq, b, fi, X, lk, mk, cO, U, xe, e, y, d, m, aX, t, h, B, q, QE, ar, av, aV, u, iT, yJ, ld, iP, Pz, cV, aC, amo, BT, fO, asM, gL, P, T, bp, aAB, Qt, BL, jG, Iq, Zv, Ty, hX, G, eo, ag, cT, tl, Ks, aA, iu, re); #c1(CD84) c2(NP_001171808) c3(1857) c4(27971, 41028, 54085, 14914, 67142) c5(aC, In); #c1(CD86) c2(NP_001193853) c3(1858) c4(27972, 41029, 54086, 14915, 67143) c5(dx, WH, en, aw, b, Y, aF, gE, jz, aE, aDy, mk, sJ, fl, NH, iL, z, bf, U, G, fx, O, jQ, m, aX, cb, t, h, fP, Pn, dl, zm, axC, sR, fy, pH, aV, u, nj, wF, aHZ, V, cV, aC, Oq, du, fO, lj, gL, gm, axl, T, ll, ny, cy, J, jT, aM, P, jH, yG, nV, ii, dP, NG, iR, hq, rq, PB, xe, abN, ag, cT, Dl, j, i, fl, l, at, DM); #c1(CD8A) c2(NP_001759) c3(1859) c4(27973, 41030, 54087, 14916, 67144) c5(jK, b, X, hP, y, m, jT, aX, ae, jd, t, h, F, q, Jp, bu, ik, fH, av, aV, u, iT, alc, bm, il, cV, aC, J, by, P, T, qH, fJ, alb, ale, aq, ala, cT, l, aA); #c1(CD88) c2(NP_001171571) c3(1860) c4(27974, 41031, 54088, 14917, 67145) c5(acE, m, Pv, J, mW, cT, jT, gl); #c1(CD93) c2(NP_036204) c3(1861) c4(27975, 41032, 54089, 14918, 67146) c5(jl, bb, u, bj, eR, bq, at, et, aW); #c1(CD96) c2(NP_005807) c3(1862) c4(27976, 41033, 54090, 14919, 67147) c5(or, h, aua, q, aiD, ald, iv, AP, nU); #c1(CD99) c2(NP_001116370) c3(1863) c4(27977, 41034, 54091, 14920, 67148) c5(apH, by, A, ale, b, fr, Hk, jt, aht, ana, fe, jR, Fm, ahU, y, jx, jv, pp, t, h, B, N, es, ar, n, Tk, alf, fy, u, g, fU, FK, cV, aC, J, asM, T, ft, JY, jT, qp, yN, adu, Bg, OJ, aex, bT); #c1(CD9) c2(NP_001760) c3(1864) c4(27978, 41035, 54092, 14921, 67149) c5(en, aw, kE, b, jz, EN, A, Iv, iL, Lr, zL, re, bT, jD, y, TH, co, aX, pz, h, hg, CR, jQ, bu, aEU, ar, B, cs, kX, Uq, fy, u, o, ff, dj, fU, hW, SV, ae, cV, Be, kt, J, fO, ad, P, T, ll, ji, jl, by, jG, iR, Oa, eo, cT, iT, i, od, aEN, alg, HS); #c1(CDADC1) c2(NP_001180407) c3(1865) c4(27979, 41036, 54093, 14922, 67150) c5(oy); #c1(CDAN1) c2(NP_612486) c3(1866) c4(27980, 41037, 54094, 14923, 67151) c5(ali, bb, alj, ajc, fP, BU, Oj, adH, GG, mn, aCa, alh, gc, Bx, gh, alk, pq); #c1(CDCI23) c2(NP_006014) c3(1867) c4(27981, 41038, 54095, 14924, 67152) c5(fr, kB, w, bo, bf, y, jx, co, aX, re, B, q, es, cl, bm, fs, l, ft, P, fx, by, Ut, aM, u, ag, all, aA); #c1(CDCI4A) c2(XP_011540643) c3(1868) c4(27982, 41039, 54096, 14925, 67153) c5(u, y, b, bu); #c1(CDCI48) c2(NP_001070649) c3(1869) c4(27983, 41040, 54097, 14926, 67154) c5(alm, pR, w, aw, k); #c1(CDCI6) c2(NP_003894) c3(1870) c4(27984, 41041, 54098, 14927, 67155) c5(x u, q); #c1(CDC208) c2(NP_001139206) c3(1871) c4(27985, 41042, 54099, 14928, 67156) c5(jB); #c1(CDC23) c2(NP_004652) c3(1872) c4(27986, 41043, 54100, 14929, 67157) c5(og, b, hV, J, M, nV, x); #c1(CDC25A) c2(NP_001780) c3(1873) c4(27987, 41044, 54101, 14930, 67158) c5(A, b, X, i, O, z, U, e, y, d, Ag, jT, am, h, f, F, q, bu, ar, B, cs, av, fy, u, asd, xc, V, cV, aza, ad, W, T, Qt, by, pq, bm, jR, ag, cZ, l, re); #c1(CDC258) c2(NP_001274445) c3(1874) c4(27988, 41045, 54102, 14931, 67159) c5(B, b, X, w, ak, A, e, O, d, jh, co, kJ, h, f, q, ik, fy, u, il, T, iA, jT, xO, ag, i, l); #c1(CDC25C) c2(NP_001274511) c3(1875) c4(27989, 41046, 54103, 14932, 67160) c5(A, aw, b, X, O, U, e, y, d, co, zJ, f, q, bu, cU, jT, B, cs, av, jM, u, aE, n, iF, xc, ae, J, fO, ad, P, zi, iA, by, jE, bm, ag, cT, i, l); #c1(CDC27) c2(NP_001107563) c3(1876) c4(27990, 41047, 54104, 14933, 67161) c5(u, y); #c1(CDC34) c2(NP_004350) c3(1877) c4(27991, 41048, 54105, 14934, 67162) c5(b, il, sg, ik, u, aln); #c1(CDC37) c2(NP_008996) c3(1878) c4(27992, 41049, 54106, 14935, 67163) c5(aAf, A, b, f, q, fO, ad, MS, cT, T, B, aJ, cs); #c1(CDC37L1) c2(NP_060383) c3(1879) c4(27993, 41050, 54107, 14936, 67164) c5(T); #c1(CDC42BPA) c2(NP_003598) c3(1880) c4(27994, 41051, 54108, 14937, 67165) c5(aBO, el, nU, aBK, cO, bw, u, y); #c1(CDC42BPB) c2(NP_006026) c3(1881) c4(27995, 41052, 54109, 14938, 67166) c5(el, jT, u, y, b); #c1(CDC42BPG) c2(NP_059995) c3(1882) c4(27996, 41053, 54110, 14939, 67167) c5(bw, Bm); #c1(CDC42EPI) c2(NP_689449) c3(1883) c4(27997, 41054, 54111, 14940, 67168) c5(aC, O); #c1(CDC42EP3) c2(NP_006440) c3(1884) c4(27998, 41055, 54112, 14941, 67169) c5(A, co, GF, ar, bf, jC, at, iR, o); #c1(CDC42SE2) C2(NP_001033791) c3(1885) c4(27999, 41056, 54113, 14942, 67170) c5(Bc, cU, iA, pp); #c1(CDC45) c2(XP_005261342) c3(1886) c4(28000, 41057, 54114, 14943, 67171) c5(cT, co, K); #c1(CDC5L) c2(NP_001244) c3(1887) c4(28001, 41058, 54115, 14944, 67172) c5(fr, ao, aoW, bp, ft); #c1(CDC6) c2(NP_001245) c3(1888) c4(28002, 41059, 54116, 14945, 67173) c5(A, cT, b, aoK, e, y, d, jl, re, B, q, alo, bm, iT, kF, T, QZ, ac, cW, u, alp, l); #c1(CDC73) c2(NP_078805) c3(1889) c4(28003, 41060, 54117, 14946, 67174) c5(A, aw, b, dB, eH, HC, D, bw, cp, ec, DE, B, yx, jF, ff, aAO, aAS, alq, YR, qq, azo, dt, T, W, TU, bq, alr, arC); #c1(CDC7) c2(XP_011540528) c3(1890) c4(28004, 41061, 54118, 14947, 67175) c5(oy, d, ao, aX, BX, b, dA, X, h, f, e, ip, ny, amb, kY, aj, ai, u, av, y, ez); #c1(CDCA2) c2(NP_689775) c3(1891) c4(28005, 41062, 54119, 14948, 67176) c5(d, aX, b, bq, e, ac); #c1(CDCA3) c2(NP_112589) c3(1892) c4(28006, 41063, 54120, 14949, 67177) c5(l, b); #c1(CDCA5) c2(NP_542399) c3(1893) c4(28007, 41064, 54121, 14950, 67178) c5(lc, eZ, Xd, fr, Pv, iL, xw, iy, m, co, aX, b, k, aE, o, ae, cV, bK, v, ft, T, bb, hT, Xe); #c1(CDCA7) c2(NP_114148) c3(1894) c4(28008, 41065, 54122, 14951, 67179) c5(ao, b, dA, jR, jG, aW); #c1(CDCA7L) c2(NP_001120842) c3(1895) c4(28009, 41066, 54123, 14952, 67180) c5(P, bj, q, jR); #c1(CDCP1) c2(NP_073753) c3(1896) c4(28010, 41067, 54124, 14953, 67181) c5(A, aw, b, X, pR, dB, eH, fl, U, y, co, B, dl, ar, cs, lV, u, V, jG, J, bp, ad, dU, T, by, av, ag, bq); #c1(CDH10) c2(NP_006718) c3(1897) c4(28011, 41068, 54125, 14954, 67182) c5(cz, ao, at, bb, cO); #c1(CDH11) c2(NP_001788) c3(1898) c4(28012, 41069, 54126, 14955, 67183) c5(GK, A, aw, b, zH, X, als, dB, w, cO, zK, bf, O, y, oy, fe, bb, ip, B, zx, dl, fr, ik, aW, cB, cs, gg, u, o, be, dA, aC, adh, ft, LR, ad, GB, jo, T, bq, aeC, k, GM, asg, at, gl); #c1(CDH13) c2(NP_001207417) c3(1899) c4(28013, 41070, 54127, 14956, 67184) c5(eX, aw, dB, eH, w, cO, aqL, adr, e, O, M, t, jm, lV, Fg, aC, gm, bp, alu, jT, alt, ie, yE, bq, aA, Hb, X, kY, U, y, co, ag, B, bu, av, fy, bm, iT, is, iF, V, nu, gv, iA, py, aY, cz, ap, b, apC, qa, d, jh, re, q, ar, jG, u, aE, da, by, G, xq, ct, jH, Mp, lA, A, di, oy, aX, h, F, cU, ik, cB, RB, J, W, dU, P, T, jl, ad, Sp, at, E, bh, pv); #c1(CDH15) c2(NP_004924) c3(1900) c4(28014, 41071, 54128, 14957, 67185) c5(b, WW, dB, cO, U, y, Fp, bb, nU, aW, alx, as, av, u, kF, V, an, SF, arl, alw, cf, ag, qO, T, alv); #c1(CDH16) c2(NP_001191673) c3(1901) c4(28015, 41072, 54129, 14958, 67186) c5(ahF, hV, dB, Uq, WO, T, ff, sh); #c1(CDH17) c2(NP_001138135) c3(1902) c4(28016, 41073, 54130, 14959, 67187) c5(B, alz, b, X, qa, ak, iL, U, A, e, d, tp, co, aX, cn, hV, q, bu, ar, zb, cB, qu, bm, V, cz, T, by, aly, JY, jE, py, aY, ag); #c1(CDH18) c2(NP_001161139) c3(1903) c4(28017, 41074, 54131, 14960, 67188) c5(dp, dA); #c1(CDH19) c2(NP_001257957) c3(1904) c4(28018, 41075, 54132, 14961, 67189) c5(cA, bq); #c1(CDH1) c2(NP_004351) c3(1905) c4(28019, 41076, 54133, 14962, 67190) c5(dx, jp, ml, aw, bx, gG, dB, PM, e, Up, jR, cy, ajF, kJ, dl, jM, R, g, fe, du, gm, bp, ft, Ce, Jj, x, fx, YY, gg, ja, jE, aEs, os, ag, cT, i, Dr, is, axq, X, iP, jf, iG, bw, U, Oh, y, jh, tp, co, pw, ip, yE, DM, B, vQ, bu, ams, gX, O, cs, av, fy, bm, iT, yJ, iF, V, jh, bt, iA, GB, gt, py, in, alB, qO, rr, ji, apU, Ig, ny, b, jq, Bh, alD, xg, Mr, d, Ag, jd, re, hV, q, alC, ar, ff, jG, u, il, qL, avo, gL, ad, ct, jH, wV, nV, fA, iR, GM, zZ, wP, Ns, zO, I, GK, A, k, fr, pR, gN, Rd, BY, og, hl, HS, iL, hP, iK, jx, aX, h, F, qr, Uq, cU, avj, ik, oJ, fM, Kw, QJ, Be, Fs, J, W, jo, T, fO, Ze, jl, fT, by, qe, VF, alA, Zb, Nq, Dl, Af, E, eG, AZ, rb); #c1(CDH20) c2(XP_005266739) c3(1906) c4(28020, 41077, 54134, 14963, 67191) c5(W, cA, ar); #c1(CDH22) c2(XP_011527296) c3(1907) c4(28021, 41078, 54135, 14964, 67192) c5(l); #c1(CDH23) c2(NP_001165401) c3(1908) c4(28022, 41079, 54136, 14965, 67193) c5(alH, cy, nQ, bq, ml, nu, akS, qa, ow, y, alG, Bx, alE, u, nW, alF); #c1(CDH26) c2(NP_068582) c3(1909) c4(28023, 41080, 54137, 14966, 67194) c5(oy, cy); #c1(CDH2) c2(NP_001783) c3(1910) c4(28024, 41081, 54138, 14967, 67195) c5(GK, A, b, dk, w, HS, cO, O, zY, y, d, co, aX, ip, B, e, q, bu, ik, zb, cs, qu, mR, fy, u, o, dj, Be, fO, ad, GB, T, ar, x, rV, fx, aly, Zb, Nq, GM, Ns, oi, i, bq, ji, aA, at); #c1(CDH3) c2(NP_001784) c3(1911) c4(28025, 41082, 54139, 14968, 67196) c5(jp, b, dB, iG, bf, U, e, y, d, arl, alJ, ar, aW, alx, av, u, V, W, SF, aX, jH, all, ag, T, alv, eG); #c1(CDH4) c2(NP_001239267) c3(1912) c4(28026, 41083, 54140, 14969, 67197) c5(bb, b, hP, bu, T, by, et); #c1(CDH5) c2(NP_001786) c3(1913) c4(28027, 41084, 54141, 14970, 67198) c5(hV, aX, dN, uS, cV, nV, rb, nc, f, yC, bT, w, alK, O, bW, mR, av, u, ey, y); #c1(CDH6) c2(XP_011512223) c3(1914) c4(28028, 41085, 54142, 14971, 67199) c5(co, aw, dA, X, QB, hV, q, dB, jo, nV, T, bq, av); #c1(CDH7) c2(NP_387450) c3(1915) c4(28029, 41086, 54143, 14972, 67200) c5(cA, ak, aX); #c1(CDH8) c2(NP_001787) c3(1916) c4(28030, 41087, 54144, 14973, 67201) c5(rQ, xJ, dB, cz, bk, bq, bj); #c1(CDH9) C2(XP_011512224) c3(1917) c4(28031, 41088, 54145, 14974, 67202) c5(oy, jJ, qf, dA, dB, cz, di, rV, qu, bf, Hs); #c1(CDHR1) c2(NP_001165442) c3(1918) c4(28032, 41089, 54146, 14975, 67203) c5(alM, nQ, ml, nv, alL, nR, nW, aW); #c1(CDHR2) c2(NP_001165447) c3(1919) c4(28033, 41090, 54147, 14976, 67204) c5(cs, bm, b, ad); #c1(CDHR3) c2(NP_689963) c3(1920) c4(28034, 41091, 54148, 14977, 67205) c5(ix, cy, qe); #c1(CDHR5) c2(NP_001165439) c3(1921) c4(28035, 41092, 54149, 14978, 67206) c5(bf, U, au, V); #c1(CDIPT) c2(NP_006310) c3(1922) c4(28036, 41093, 54150, 14979, 67207) c5(bi, alN, aP, afu); #c1(CDK10) c2(NP_443713) c3(1923) c4(28037, 41094, 54151, 14980, 67208) c5(aX b, q, pt, cO, oM, u, y); #c1(CDK11B) c2(NP_001778) c3(1924) c4(28038, 41095, 54152, 14981, 67209) c5(aX, asx fr, cV, v, ft, bo, u); #c1(CDK12) c2(NP_055898) c3(1925) c4(28039, 41096, 54153, 14982, 67210) c5(X, av); #c1(CDK13) c2(NP_003709) c3(1926) c4(28040, 41097, 54154, 14983, 67211) c5(U, alP, q, alO, V); #c1(CDK14) c2(NP_001274064) c3(1927) c4(28041, 41098, 54155, 14984, 67212) c5(oy, d, q, e); #c1(CDK15) c2(NP_001248364) c3(1928) c4(28042, 41099, 54156, 14985, 67213) c5(aX, b, f, MS, fl, alQ); #c1(CDK16) c2(NP_001163931) c3(1929) c4(28043, 41100, 54157, 14986, 67214) c5(pk, aX, b, ml, f, MS, fl, QZ, alQ); #c1(CDK17) c2(NP_002586) c3(1930) c4(28044, 41101, 54158, 14987, 67215) c5(EM, bj); #c1(CDK18) c2(NP_002587) c3(1931) c4(28045, 41102, 54159, 14988, 67216) c5(O); #c1(CDK19) c2(NP_001287892) c3(1932) c4(28046, 41103, 54160, 14989, 67217) c5(wh, V, fr, ft, bo, U); #c1(CDK1) c2(NP_203698) c3(1933) c4(28047, 41104, 54161, 14990, 67218) c5(by, gk, aw, b, X, aN, hS, w, e, fw, O, ct, U, A, fx, y, iy, d, jR, co, aX, zJ, Lw, h, f, F, q, jV, bu, cU, B, cB, cs, av, fy, u, o, iF, V, lb, v, fO, J, P, T, pt, bb, iA, ad, cq, Xw, jT, nV, eF, py, bm, nJ, ag, oi, i, oM, at, eG); #c1(CDK20) c2(NP_001034892) c3(1934) c4(28048, 41105, 54162, 14991, 67219) c5(b, w, P, ix, yM, av, kV); #c1(CDK2AP1) c2(NP_004633) c3(1935) c4(28049, 41106, 54163, 14992, 67220) c5(d, A, V, b, X, B, e, fl, T, av, aV, U); #c1(CDK2AP2) c2(NP_005842) c3(1936) c4(28050, 41107, 54164, 14993, 67221) c5(aEq, fU, aX, V, b, f, Fo, q, jR, by, cT, A, T, i, ar, U, jT, u, st, y, dB); #c1(CDK2) c2(NP_001789) c3(1937) c4(28051, 41108, 54165, 14994, 67222) c5(gK, B, sE, w, e, O, yg, cy, ajF, t, g, aC, gm, fO, ft, x, fx, jT, cq, wh, Qk, DO, os, ag, cT, qP, i, X, iP, jz, eu, wy, kB, iG, bw, U, y, co, pw, f, agm, bu, cs, av, fy, bm, OT, iT, V, jC, JY, P, nJ, gO, kD, b, wn, d, jh, jd, re, hV, q, ar, RF, jG, u, aE, ff, aHM, jE, il, by, G, ew, wV, nV, azy, alR, iR, wP, A, k, fr, gw, jR, al, jQ, aX, awz, h, F, cU, ik, oJ, cB, Ek, fU, cV, Fs, J, W, jo, T, ll, ad, fM, VF, st, HM, Yv, rb); #c1(CDK3) c2(NP_001249) c3(1938) c4(28052, 41109, 54166, 14995, 67223) c5(b, jk, re, q, w, iT); #c1(CDK4) c2(NP_000066) c3(1939) c4(28053, 41110, 54167, 14996, 67224) c5(gK, B, aw, jp, jt, dB, lp, w, bf, e, O, cU, LL, kJ, t, DB, cl, oP, g, fe, aC, cs, gm, bp, ft, iJ, Lw, fx jT, fp, BX, DO, ag, cT, qP, i, aA, ib, alU, axq, X, iP, wy, kB, kY, bo, U, avy, y, co, px, ip, yE, f, bu, alS, iv, Tk, av, fy, bm, iT, V, jh, cx, QP, ny, Qt, jC, iA, py, QG, fw, Le, qO, ji, kD, ck, b, QB, QR, au, ic, z, d, Ag, bb, jd, re, hV, q, es, OC, ar, aJ, Zh, jG, u, dh, o, kP, fs, wp, ad, alT, G, aHE, iD, oi, ct, aeC, hX, kM, Dj, aE, l, yA, A, iG, k, fr, jR, yw, iK, QV, aX, l, jk, h, F, jA, gT, az, cB, cV, Fs, J, agh, W, T, fO, jl, fM, aM, qp, st, XH, Af, rb); #c1(CDK5) c2(NP_001157882) c3(1940) c4(28054, 41111, 54168, 14997, 67225) c5(dx, acE, hV, b, Xd, fr, alV, A, yn, bf, xw, bj, y, co, bb, eZ, si, f, oE, k, aO, cB, cs, Gj, fy, u, dh, o, fh, da, GS, kF, l, cV, bK, ft, du, v, fO, J, ais, dv, eX, Lw, nP, ad, hw, ac, ao, nV, hT, B, ag, i, l); #c1(CDK5R1) c2(XP_011523740) c3(1941) c4(28055, 41112, 54169, 14998, 67226) c5(f, avb, b, Xd, fr, Pv, dB, A, iL, Lw, xw, iy, m, aX, eZ, nU, alW, k, B, cB, hT, u, aE, o, fs, ae, cV, bK, v, ft, P, bb, hw, ao, alY, lc, HN, alX, Xe); #c1(CDK5R2) c2(NP_003927) c3(1942) c4(28056, 41113, 54170, 14999, 67227) c5(Pv, hT, o); #c1(CDK5RAP1) c2(NP_001265096) c3(1943) c4(28057, 41114, 54171, 15000, 67228) c5(do); #c1(CDK5RAP2) c2(NP_001011649) c3(1944) c4(28058, 41115, 54172, 15001, 67229) c5(ais, QZ, ait, alZ); #c1(CDK5RAP3) c2(NP_788276) c3(1945) c4(28059, 41116, 54173, 15002, 67230) c5(fi, V, b, f, q, po, ar, cs, x, U, ad); #c1(CDK6) c2(XP_006715898) c3(1946) c4(28060, 41117, 54174, 15003, 67231) c5(A, jT, b, X, BY, w, z, O, iA, y, d, jh, co, aX, kJ, t, h, B, e, q, bu, ar, ait, cB, av, fy, u, aE, wP, fx, ax cV, aC, aow, j, gm, P, nV, fO, vM, jC, J, by, NB, fM, dH, wV, qp, st, xr, py, hX, DO, G, jR, ag, cT, i, yG); #c1(CDK7) c2(NP_001790) c3(1947) c4(28061, 41118, 54175, 15004, 67232) c5(A, b, X, w, O, Oh, y, co, B, kk, av, aV, u, fU, l, cx, bp, J, T, x, ac, os, ag, i, l); #c1(CDK8) c2(NP_001251) c3(1948) c4(28062, 41119, 54176, 15005, 67233) c5(cU, wh, aX, V, b, fr, dB, ad, Eo, gX, P, cs, Oi, U, ft, iA); #c1(CDK9) c2(NP_001252) c3(1949) c4(28063, 41120, 54177, 15006, 67234) c5(en, b, k, cY, aF, jt, w, cO, bw, A, y, h, f, q, es, dQ, B, fy, u, awc, bm, cV, J, P, ll, aZ, cK, jT, ch, jR, ji, aJa, DM); #c1(CDKAL1) c2(NP_060244) c3(1950) c4(28064, 41121, 54178, 15007, 67235) c5(dx, td, b, cO, bf, U, ey, dv, bb, eX, mm, aE, da, mz, kF, V, l, dA, du, P, bQ, bq, fx aM, jH, Ah, mA, fP, i, mD, aA, at); #c1(CDKL1) c2(NP_004187) c3(1951) c4(28065, 41122, 54179, 15008, 67236) c5(b, by, P, yM, bu, kV); #c1(CDKL2) c2(NP_003939) c3(1952) c4(28066, 41123, 54180, 15009, 67237) c5(aCw, Bu); #c1(CDKL3) c2(NP_001107047) c3(1953) c4(28067, 41124, 54181, 15010, 67238) c5(nU, n); #c1(CDKL4) c2(NP_001009565) c3(1954) c4(28068, 41125, 54182, 15011, 67239) c5(agw, Qx); #c1(CDKL5) c2(NP_001032420) c3(1955) c4(28069, 41126, 54183, 15012, 67240) c5(Xd, hS, amh, dl, nU, NJ, aq, Qx, aJd, aJe, hW, bK, nz, yH, cz, dt, QZ, aJf, aJc, IC, hT, na, agw, aJb, ahw); #c1(CDKN1A) c2(NP_000380) c3(1956) c4(28070, 41127, 54184, 15013, 67241) c5(dx, B, aw, aZ, rR, Vz, IM, HG, Ip, sJ, w, et, kJ, e, O, M, dv, LL, ajF, iR, t, DB, dl, FN, aui, ji, tE, fH, wh, Zv, gl, R, g, WZ, eg, lb, du, gm, bp, ft, fl, x, fx, jT, pq, ja, ata, hx, ag, cT, aEv, aex, i, aC, pt, aA, bT, afd, aJg, kM, cE, X, Hq, oa, jz, kB, LK, GM, iG, bw, U, y, co, ip, yE, fi, f, bu, xg, aFQ, k, cc, cs, Qw, av, fy, bm, iT, iF, vR, V, qq, Qz, gv, YS, ny, Qt, cy, iA, fJ, aEr, JY, GB, aJh, gt, py, er, P, nJ, jd, oM, OG, ck, ahU, b, vh, in, Bi, z, ey, Mr, d, jh, fv, Be, re, hV, q, jV, IY, kz, ar, RF, hb, Yr, HE, jG, Tv, u, dh, cl, da, iP, jE, il, VF, qL, LR, ad, G, rB, Nh, rO, et, Lt, aen, anO, jH, nV, pS, ch, ID, kh, ahV, Dj, yr, cX, bq, I, yA, af, GK, A, qd, fr, Lv, mW, aFe, BY, xf, lv, iL, gE, aJi, jx, m, QV, Ez, aX, fq, qn, F, atx qr, cU, aA J, ik, oJ, cB, Ig, jQ, aq, ma, cV, be, dB, J, W, jo, T, fO, Oi, jl, eq, by, fM, wU, Lc, ale, zM, fP, IN, bh, eG, h); #c1(CDKN1B) c2(NP_004055) c3(1957) c4(28071, 41128, 54185, 15014, 67242) c5(dx, YZ, by, en, aw, gG, Vz, HG, w, bf, O, e, Up, gO, M, dv, cy, aJm, t, fp, dl, jm, fH, R, g, og, agb, ft, du, fO, gm, bp, azo, od, Jj, fx, jT, HR, NB, pq, BX, a Jl, os, ag, cT, aex, i, bq, jC, avz, dB, Dr, fl, X, fE, oa, jz, fU, dV, iG, OO, bw, U, Oh, y, co, ip, yE, f, bu, dZ, B, cs, av, fy, bm, OT, iT, iF, jB, vR, V, aHK, qq, jR, afn, Fy, Qz, bt, Qt, Qj, iA, fJ, DE, qW, aH, iP, anG, er, P, in, ji, kD, ny, b, oi, Fr, d, bb, jF, re, hV, PA, g, jV, ra, ar, ff, aJ, oO, n, jG, u, n, tw, hb, il, dT, ad, Km, G, QK, iD, yG, cW, nV, hX, iR, Bg, Sk, fl, I, OS, af, aJo, zD, bL, A, k, fr, pR, gN, di, lv, iL, gE, jw, Bz, aJj, jx, aX, VD, h, atx, cU, ik, oJ, cB, Ek, jQ, aq, aJk, ma, si, cV, YR, Fs, J, W, jo, T, II, jl, nP, Ap, aJn, aM, VF, gp, js, eG, lc, Nq, fP, Af, Oi, at, Nu); #c1(CDKN1C) c2(NP_000067) c3(1958) c4(28072, 41129, 54186, 15015, 67243) c5(dx, B, w, bf, e, O, dv, t, Me, cl, Dd, fe, du, gm, bp, od, fx, ZU, fc, ie, ag, i, mD, fl, X, iP, jz, aJp, bw, U, y, co, f, bu, LB, av, fy, bm, jB, V, qq, cx, Hq, alM, bq, mF, aol, W, QG, gR, iA, aJq, ci, b, LA, jy, gF, d, q, ar, u, jj, il, by, G, et, nV, bO, rv, I, hd, A, lv, JC, jQ, c, aX, I, jk, h, F, ik, n, cB, aV, fQ, cV, J, dt, T, jl, Bb, aM, Nq, vt); #c1(CDKN2A) c2(NP_000068) c3(1959) c4(28073, 41130, 54187, 15016, 67244) c5(jp, ml, Zy, iX, dB, Ip, JH, aoK, pz, e, kJ, QQ, cl, xl, a JO, arS, TP, fe, aC, aow, ft, a JT, Wp, kN, pq, pb, jE, bm, DO, ag, bq, aA, Mq, ahQ, Dr, GD, X, oa, eu, sF, iG, bo, bw, vl, ash, cM, rY, AZ, N, aFQ, Mp, a JH, fy, fY, aju, is, V, afz, aJV, jC, fJ, xd, ahT, OS, aY, To, aAN, qd, ji, gh, kD, ap, afE, jy, Ag, oB, fv, oO, a JF, da, fs, il, gL, ad, Yi, rB, aeC, WZ, ao, nV, py, aoA, mA, agb, aJR, yA, uE, af, zD, aES, aJK, fr, gn, jc, C, iL, gE, CT, asP, jQ, m, awz, Ir, rR, NO, gO, an, be, J, jo, E, Zd, aJN, VF, YX, Vh, Af, jh, rb, dx, amF, awh, HG, auJ, qP, aJE, O, yg, azb, DB, yh, a JP, EM, Xi, QB, Zv, n J, a Ju, aeM, nl, du, agh, bp, aoS, Ce, x, Lw, fp, MS, wh, BX, aJM, mD, bT, alU, ie, afY, iP, mk, ix Dj, kY, cA, U, co, pw, f, aJS, bu, iJ, aEs, yV, Ov, aJY, gv, wV, ny, aJU, aen, anG, OW, SR, Le, tl, ajF, aKc, aKe, Qy, oi, z, zL, BQ, d, bb, aJL, ra, jd, g, yu, alC, RF, Xp, fE, iR, o, ff, jj, qL, LR, dT, sf, aZ, et, jH, adz, azy, kM, GM, aof, Ou, fl, fh, anE, aJL bf, k, aJG, FL, pD, Rd, al, Ld, Ll, bn, jk, cB, aKa, LK, ez, Fs, avw, T, ll, aph, nk, st, fA, B, aw, iD, jt, adr, iy, Vx, aEa, axK, aKf, fH, g, po, fO, fx, hR, av, bY, a Jr, cT, QD, sa, apF, cY, a Jy, jz, kB, bW, Hi, tp, px DP, aJv, iv, Tk, hD, iT, aEq, hf, qq, v, Qz, alf, Hq, bt, gC, iA, JY, aJX, aJs, in, VE, auR, iu, b, jq, jL, Bh, auc, Mr, Ne, apG, re, hV, ND, OC, aKb, ri, aHM, atr, Fo, JJ, et, cW, jM, aJA, hX, SJ, Bg, agf, OU, gw, og, Iv, zY, jx, QV, bj, Bi, gT, cU, ik, iK, Be, gm, W, Xj, jl, fM, aM, ale, adu, Yv, Ez, at, eG, hx gG, aJw, w, dv, cy, t, aze, R, aBE, aJW, gY, aJZ, YY, cq, QJ, auk, fN, Qk, os, yE, agm, i, dc, Ah, aHb, wy, aAM, IW, avy, y, Ml, ip, vQ, cs, mm, avg, iF, jB, aJx, aub, Zg, aJC, GQ, aoy, iY, er, jR, fG, aEk, Xk, ci, OG, An, apG, auX, anb, eR, ic, ey, aO, yK, aJB, jV, es, jF, ar, VM, HE, jG, u, I, by, G, Ca, aAB, Nh, auY, a JD, aoO, aJJ, kh, aJt, aE, ih, wP, I, bL, A, aKd, ot, BY, di, hP, aX, h, F, aBd, M, aJQ, n, vp, aV, fU, si, cV, BG, GB, P, aox, bh, fT, pF, ac, jT, qp, QN, YQ, ck, XH, IN, Oi, iE); #c1(CDKN2AIP) c2(NP_060102) c3(1960) c4(28074, 41131, 54188, 15017, 67245) c5(f, b); #c1 (CDKN2B) c2(NP_004927) c3(1961) c4(28075, 41132, 54189, 15018, 67246) c5(dx, B, aw, Zy, dB, Ip, w, bf, ps, e, O, yg, dv, cy, kT, t, yh, cl, EM, TP, g, aeM, aC, du, po, bp, Yl, aoS, Q, fx, hR, mm, M, Qk, ie, ns, ag, cT, qP, i, mD, aA, Ah, Dr, aEg, X, DO, afY, iP, jz, kB, dV, iG, bW, bw, U, Hi, y, aiH, co, yE, pz, f, N, vQ, bu, dZ, iv, av, fy, cj, jB, V, qq, gv, Fy, bq, jC, iA, pJ, JY, dP, iY, er, jR, fG, gR, ji, wl, ci, ap, OG, Ig, b, jq, anb, eR, Bh, ic, jy, ey, aO, d, jh, bb, fv, jd, re, hV, g, jV, ra, ar, oO, auv, jG, u, aE, fh, aHM, il, ad, G, iD, oi, et, nV, aJz, iR, kM, aoA, mA, agb, aJR, uE, zD, bL, A, k, fr, gn, pD, di, Iv, gE, CT, hP, vl, jQ, aX, I, h, sF, F, gr, cU, ik, n, cB, fU, ez, cV, Fs, J, gm, W, P, T, fO, Ez, jl, nP, by, fM, aM, jT, nk, st, tl, bh, at, Bi, aJt); #c1(CDKN2C) c2(NP_001253) c3(1962) c4(28076, 41133, 54190, 15019, 67247) c5(wa, b, X, anb, w, bV, y, aX, DE, ip, jd, f, g, n, jF, O, VM, iv, fH, fy, u, cl, iF, jB, cV, aC, YR, qq, Fs, J, fO, gv, W, P, ny, fJ, nV, BX, DO, jR, yE, bh, aA, OS); #c1 (CDKN2D) c2(NP_001791) c3(1963) c4(28077, 41134, 54191, 15020, 67248) c5(JH, b, X, jz, jc, ix, Iv, bw, aJE, y, jQ, co, f, bu, fr, O, cB, iv, HE, av, aV, u, ri, n, da, aC, qq, v, T, aox Lw, fx, fp, aAF, ao, jR, Bh, mD, pJ, ll); #c1(CDKN3) c2(NP_001124323) c3(1964) c4(28078, 41135, 54192, 15021, 67249) c5(dx, B, axx, w, et, bf, e, O, dv, cy, t, do, fe, lb, du, fO, azo, fx, jT, fp, eg, jE, DO, yE, cT, i, fl, X, jz, iG, y, px, pp, ag, f, bu, iv, av, fy, bm, iT, iF, jB, aDM, qq, Qt, Fr, mF, er, jR, b, oi, ic, aO, d, jh, apG, re, g, jV, jF, ar, u, il, by, rO, iR, xU, cX, fl, bL, A, k, fr, aFe, ahV, og, Iv, iL, gE, jx c, aX, I, h, F, aC, ik, n, cB, jQ, ez, cV, be, J, W, P, T, ft, aM, VF, Ic, eG, ja); #c1(CDNF) c2(NP_001025125) c3(1965) c4(28079, 41136, 54193, 15022, 67250) c5(bj); #c1(CDO1) c2(NP_001792) c3(1966) c4(28080, 41137, 54194, 15023, 67251) c5(gK, V, b, u, MW, gG, yh, CL fG, w, I, z, di, U, hP, y); #c1(CDON) c2(XP_011541167) c3(1967) c4(28081, 41138, 54195, 15024, 67252) c5(MW, Cl, aai, aKg); #c1 (CDR1) c2(NP_004056) c3(1968) c4(28082, 41139, 54196, 15025, 67253) c5(b, mW, aN, y, m, rY, h, tF, PV, n, u, gl, fO, pF, MW, P, II, bh, pi, cT, bq, ci, pv); #c1(CDR2) c2(NP_001793) c3(1969) c4(28083, 41140, 54197, 15026, 67254) c5(B0, b, jh, X, asi, P, MW, cT, akT, av, aV, u, Qx); #c1(CDS2) c2(NP_003809) c3(1970) c4(28084, 41141, 54198, 15027, 67255) c5(pk, cO); #c1(CDT1) c2(NP_112190) c3(1971) c4(28085, 41142, 54199, 15028, 67256) c5(b, u, X, t, gm, alp, ew, av, aKh); #c1(CDV3) c2(NP_001127894) c3(1972) c4(28086, 41143, 54200, 15029, 67257) c5(U, V); #c1(CDX1) c2(NP_001795) c3(1973) c4(28087, 41144, 54201, 15030, 67258) c5(apH, b, bx Ty, U, hP, h, bu, ar, cB, cs, kN, kq, R, fi, V, aKi, by, W, T, bt, x, ad, ag, dn, eG); #c1(CDX2) c2(NP_001256) c3(1974) c4(28088, 41145, 54202, 15031, 67259) c5(aw, bx, gG, auJ, e, cp, kJ, t, R, iv, bp, Ce, x, Yp, pb, abv, YA, ag, aKj, fi, cY, bw, U, Oh, y, co, B, bu, gX, cs, av, fy, bm, is, aal, ali, V, afz, bt, Qt, iA, Mp, JY, py, tl, ji, aKk, b, kN, MS, au, Og, d, g, X, ar, fv, jG, u, il, qL, atr, ad, Tt, et, aKl, aJA, Bg, dn, I, yA, af, A, FL, jc, hA, hP, aX, h, F, cU, ik, aV, fU, Be, J, W, T, by, qp, G, fP, Oi); #c1(CDX4) c2(NP_005184) c3(1975) c4(28089, 41146, 54203, 15032, 67260) c5(h, hP, J, iv); #c1(CDY1B) c2(NP_001003894) c3(1976) c4(28090, 41147, 54204, 15033, 67261) c5(wn, NT, UW, fO); #c1 (CDY2B) c2(NP_001001722) c3(1977) c4(28091, 41148, 54205, 15034, 67262) c5(pM, wn, UW); #c1(CDYL2) c2(NP_689555) c3(1978) c4(28092, 41149, 54206, 15035, 67263) c5(bb, et); #c1(CDYL) c2(NP_001137442) c3(1979) c4(28093, 41150, 54207, 15036, 67264) c5(l, fU); #c1 (CEACAM16) c2(NP_001034302) c3(1980) c4(28094, 41151, 54208, 15037, 67265) c5(aKn, aKm, gm); #c1 (CEACAM19) c2(NP_001121365) c3(1981) c4(28095, 41152, 54209, 15038, 67266) c5(u, y); #c1(CEACAM1) c2(NP_001020083) c3(1982) c4(28096, 41153, 54210, 15039, 67267) c5(A, b, sE, dB, BY, U, fx y, cp, aX, wP, Be, amK, hV, g, bu, cU, ar, B, cs, fv, fy, u, pW, aO, V, I, gL, ad, W, T, bp, x, bh, iA, pi, VF, wV, nV, bm, fw, ag, i, aA); #c1(CEACAM21) c2(XP_006725457) c3(1983) c4(28097, 41154, 54211, 15040, 67268) c5(bk); #c1(CEACAM3) C2(NP_001264092) c3(1984) c4(28098, 41155, 54212, 15041, 67269) c5(Qv, aw, b, X, iP, eu, Ty, oR, ji, U, hP, fx, y, d, co, zu, re, e, q, bu, cU, gX, aoQ, cl, cB, cs, dQ, av, fy, u, iT, gG, V, VD, cV, Dg, J, bp, ad, W, G, Ce, T, Qt, x, nP, by, JY, dY, ag, YS, bk, i, fl, Oi, ar); #c1(CEACAM4) c2(NP_001808) c3(1985) c4(28099, 41156, 54213, 15042, 67270) c5(if, V, b, fv, f, ad, W, G, T, cs, ar, U, jG, jU); #c1(CEACAM5) c2(NP_001278413) c3(1986) c4(28100, 4057, 54214, 15043, 67271) c5(B, aw, gG, Ty, w, pz, aKp, O, e, dl, cl, aoQ, R, Dt, gm, bp, Ce, x, fx, YA, ag, i, zu, X, iP, eu, ot, bw, U, Oh, y, co, agn, pp, f, bu, gX, cs, av, fy, bm, iT, is, fi, jB, aEd, YV, V, Xr, YS, bt, Qt, iQ, JY, dY, ji, bn, kE, b, A, aKo, d, jh, Be, re, PA, g, es, ra, dQ, as, ar, jG, u, dh, il, Dg, by, G, iO, et, jU, jH, nV, fl, af, Qv, pu, iL, hP, aX, VD, cU, ik, cB, fU, cV, an, J, W, T, II, nP, ad, Rd, zM, Oi); #c1(CEACAM6) c2(NP_002474) c3(1987) c4(28101, 41158, 54215, 15044, 67272) c5(A, aw, b, X, gG, oR, bw, U, pz, y, aX, t, f, F, bu, Mr, ar, B, cs, fv, fy, u, pW, V, J, fO, ad, W, G, T, aZ, x, by, pi, jO, jH, if, ag, fP, bk, ji); #c1 (CEACAM7) c2(NP_001278414) c3(1988) c4(28102, 41159, 54216, 15045, 67273) c5(Qv, aw, b, X, iP, eu, Ty, ji, U, hP, BQ, y, d, co, zu, re, e, g, bu, cQ, gX, dQ, cl, cB, cs, aoQ, av, fy, u, iT, fi, V, VD, cV, Dg, bp, ad, W, G, Ce, T, Qt, x, nP, by, JY, dY, ag, YS, i, fl, Oi, ar, fx); #c1(CEACAM8) c2(NP_001807) c3(1989) c4(28103, 41160, 54217, 15046, 67274) c5(aw, X, G, akm, n, fR); #c1(CEBPA) c2(NP_001274353) c3(1990) c4(28104, 41161, 54218, 15047, 67275) c5(f, b, fr, F, eH, A, ic, bw, bf, e, y, d, M, co, jl, ip, t, h, B, N, q, jV, dl, jT, n, iv, jG, u, o, jB, bm, aKq, I, cV, hf, fO, gm, bp, J, eX, aKr, ft, dL, yA, yG, iw, jE, at, iR, cf, ie, xK, fg, fN, aA, Vs, ci, ap); #c1(CEBP8) c2(NP_005185) c3(1991) c4(28105, 41162, 54219, 15048, 67276) c5(fh, A, b, fN, jE, aF, cs, eu, cc, w, akL, wh, O, zK, bf, U, e, y, d, m, co, zJ, AX, f, q, jV, aC, azx, aKs, Hk, gg, u, oJ, jB, og, V, I, lb, bK, be, J, gL, ad, W, vc, T, II, jT, fp, jU, aM, ao, nV, dP, bm, er, P, B, ag, cT, fl, aA, pv, bp, h, ap); #c1(CEBPD) c2(NP_005186) c3(1992) c4(28106, 41163, 54220, 15049, 67277) c5(A, b, aF, KN, w, di, ic, U, e, y, d, bb, h, B, q, Kz, cc, cB, u, o, em, V, aC, bK, el, v, gO, P, T, eX, cK, iR, iT, E, aA, at, re); #c1(CEBPE) c2(NP_001796) c3(1993) c4(28107, 41164, 54221, 15050, 67278) c5(t, h, ie, G, jV, J, aKt, n); #c1(CEBPG) c2(NP_001239225) c3(1994) c4(28108, 41165, 54222, 15051, 67279) c5(cX, h, T, bp, b); #c1(CEBPZ) c2(NP_005751) c3(1995) c4(28109, 41166, 54223, 15052, 67280) c5(b, aBP, aY, h, iv, zh, J, j, cV, gR, dc, Jh, cM); #c1(CECRI) c2(NP_803124) c3(1996) c4(28110, 41167, 54224, 15053, 67281) c5(iw, bb, ae, im, fs, kJ, CN, eu, aKu, aC, hN, bw, at, O); #c1(CECR2)

c2(NP_001276976) c3(1997) c4(28111, 41168, 54225, 15054, 67282) c5(afb, anW, K, aKv); #c1(CELA1) c2(NP_001962) c3(1998) c4(28112, 41169, 54226, 15055, 67283) c5(bh, xd, bk, OR); #c1(CELA3B) c2(XP_011539434) c3(1999) c4(28113, 41170, 54227, 15056, 67284) c5(bn, aKy, gB, aKx, bk, aKw); #c1(CELF1) c2(NP_001166110) c3(2000) c4(28114, 41171, 54228, 15057, 67285) c5(jE, el, xj, P, cc, aA, bm); #c1(CELF2) c2(NP_001020247) c3(2001) c4(28115, 41172, 54229, 15058, 67286) c5(fl, aKA, aKz, xj, K, ag, do, kz, cO, x, at, u, el, y, aG); #c1(CELF4) c2(NP_001020258) c3(2002) c4(28116, 41173, 54230, 15059, 67287) c5(V, I, bK, hS, bq, aA, FY); #c1(CELF5) c2(NP_001166144) c3(2003) c4(28117, 41174, 54231, 15060, 67288) c5(qf); #c1 (CELF6) c2(NP_001166155) c3(2004) c4(28118, 41175, 54232, 15061, 67289) c5(cz); #c1(CEL) c2(NP_001798) c3(2005) c4(28119, 41176, 54233, 15062, 67290) c5(aKl, dx f, dN, iU, vB, sJ, et, bf, aK, e, dv, cy, aKH, YP, ju, du, gm, Ce, jT, av, a KB, sN, cT, aKP, a KG, aA, X, bw, U, eK, aof, eX, agm, aKF, cs, gg, bm, V, ae, aKK, MW, aKJ, bq, cl, pi, W, asJ, eF, amj, dY, ap, bn, b, aKD, eY, BH, d, q, ar, aKC, ov, aKN, LR, j, ad, nd, JJ, qV, Yy, alH, ch, kM, gd, zO, I, aKO, iL, aKE, aHA, aEO, eh, cB, IG, oS, dt, P, T, Kv, pF, iv, aM, aKL, Y, aKM, Oi, aT at); #c1(CELSRI) c2(NP_055061) c3(2006) c4(28120, 41177, 54234, 15063, 67291) c5(IJ, bb, aO, fh); #c1(CELSR3) c2(NP_001398) c3(2007) c4(28121, 41178, 54235, 15064, 67292) c5(ao, A, Ir, 1C, B, pD); #c1(CEMIP) C2(NP_001280227) c3(2008) c4(28122, 41179, 54236, 15065, 67293) c5(aw, b, cs, dB, ad, W, ar, Bx bq, u, y); #c1(CEMP1) C2(NP_001041677) c3(2009) c4(28123, 41180, 54237, 15066, 67294) c5(fv); #c1(CEND1) c2(NP_057648) c3(2010) c4(28124, 41181, 54238, 15067, 67295) c5(dt, mF, cV); #c1(CENPA) c2(NP_001035891) c3(2011) c4(28125, 41182, 54239, 15068, 67296) c5(fl, V, b, Jh, q, j, ar, kY, ji, U, u, av, y); #c1(CENPB) c2(NP_001801) c3(2012) c4(28126, 41183, 54240, 15069, 67297) c5(vc, j); #c1(CENPC) c2(NP_001803) c3(2013) c4(28127, 41184, 54241, 15070, 67298) c5(jT, ak, bj, j); #c1(CENPE) c2(NP_001273663) c3(2014) c4(28128, 41185, 54242, 15071, 67299) c5(ck, bb, b, cV, q, j, QZ, avF, u); #c1(CENPF) c2(NP_057427) c3(2015) c4(28129, 41186, 54243, 15072, 67300) c5(d, jp, A, bb, b, Zc, B, F, cT, fl, rb, yM, YV, aeC, u, e, y); #c1(CENPH) c2(NP_075060) c3(2016) c4(28130, 41187, 54244, 15073, 67301) c5(V, b, bu, T, nT, U, by); #c1 (CENPJ) c2(NP_060921) c3(2017) c4(28131, 41188, 54245, 15074, 67302) c5(aKR, MS, Bd, Bi, h, hV, aow, eu, ais, aC, cT, og, jU, J, QZ, avF, aKQ, u, WS, ait, pv); #c1(CENPK) c2(NP_001253967) c3(2018) c4(28132, 41189, 54246, 15075, 67303) c5(b, kY); #c1(CENPN) c2(NP_001094095) c3(2019) c4(28133, 41190, 54247, 15076, 67304) c5(fl); #c1(CENPO) c2(NP_001186732) c3(2020) c4(28134, 41191, 54248, 15077, 67305) c5(ak); #c1(CENPQ) c2(NP_060602) c3(2021) c4(28135, 41192, 54249, 15078, 67306) c5(at); #c1(CENPU) c2(NP_078905) c3(2022) c4(28136, 41193, 54250, 15079, 67307) c5(w, O, In); #c1(CENPV) c2(NP_859067) c3(2023) c4(28137, 41134, 54251, 15080, 67308) c5(BO, h, jz, ih, Fn, zO, bn, jQ, Nu, cq); #c1(CENPW) c2(NP_001012525) c3(2024) c4(28138, 41195, 54252, 15081, 67309) c5(aeq, b, hT, ad, xr, cs, aE); #c1(CEP112) c2(NP_001032402) c3(2025) c4(28139, 41196, 54253, 15082, 67310) c5(bq, aV); #c1 (CEPI20) c2(NP_001159698) c3(2026) c4(28140, 41197, 54254, 15083, 67311) c5(ap); #c1(CEP128) c2(XP_006720119) c3(2027) c4(28141, 41198, 54255, 15084, 67312) c5(at); #c1(CEP131) c2(NP_001009811) c3(2028) c4(28142, 41199, 54256, 15085, 67313) c5(am);

c1(CEP135) c2(NP_079285) c3(2029) c4(28143, 41200, 54257, 15086, 67314) c5(aKS, ais, ait); #c1(CEP152) c2(NP_055800) c3(2030) c4(28144, 41201, 54258, 15087, 67315) c5(b, f, aKV, ais, aKT, ait, aAg, WS, aKU); #c1 (CEP162) c2(NP_055710) c3(2031) c4(28145, 41202, 54259, 15088, 67316) c5(at); #c1(CEP164) c2(NP_001258862) c3(2032) c4(28146, 41203, 54260, 15089, 67317) c5(aKW, ahN, vU); #c1(CEP170) c2(NP_001035863) c3(2033) c4(28147, 41204, 54261, 15090, 67318) c5(aV); #c1(CEP192) c2(NP_15518) c3(2034) c4(28148, 41205, 54262, 15091, 67319) c5(b); #c1(CEP19) c2(NP_116287) c3(2035) c4(28149, 41206, 54263, 15092, 67320) c5(rd, aA, aKX); #c1(CEP250) c2(NP_009117) c3(2036) c4(28150, 41207, 54264, 15093, 67321) c5(nQ, b, N, na, fg, ow, u, ac); #c1(CEP290) c2(NP_079390) c3(2037) c4(28151, 41208, 54265, 15094, 67322) c5(r, GO, ea, cO, aLb, SD, aLa, aKZ, fC, ml, nU, asa, nR, JP, nQ, nW, v, cz, Nx, et, rQ, vU, TD, aKY, aLc); #c1(CEP41) c2(NP_001244087) c3(2038) c4(28152, 41209, 54266, 15095, 67323) c5(Wk, aLd); #c1(CEP55) c2(NP_001120654) c3(2039) c4(28153, 41210, 54267, 15096, 67324) c5(by, co, aw, V, b, qL, F, q, bu, fl, T, ji, X, kF, ad, u, y); #c1(CEP57) c2(NP_001230705) c3(2040) c4(28154, 41211, 54268, 15097, 67325) c5(aLe, A, b, 8, cB, Yn, u, y); #c1(CEP63) c2(NP_001035842) c3(2041) c4(28155, 41212, 54269, 15098, 67326) c5(ais, QZ, xr, iR, aLf); #c1(CEP68) c2(NP_055962) c3(2042) c4(28156, 41213, 54270, 15099, 67327) c5(tY, cy); #c1(CEP72) c2(NP_060610) c3(2043) c4(28157, 41214, 54271, 15100, 67328) c5(aC, jH); #c1(CEP76) c2(NP_001258918) c3(2044) c4(28158, 41215, 54272, 15101, 67329) c5(b); #c1(CEP83) c2(NP_057206) c3(2045) c4(28159, 41216, 54273, 15102, 67330) c5(n0, aLg); #c1(CEP85L) c2(NP_001035940) c3(2046) c4(28160, 41217, 54274, 15103, 67331) c5(NG, N, dB, fg, Xz, NH, Eg, ap); #c1 (CEP89) c2(NPJI6205) c3(2047) c4(28161, 41218, 54275, 15104, 67332) c5(et); #c1(CER1) c2(NP_005445) c3(2048) c4(28162, 41219, 54276, 15105, 67333) c5(eu); #c1 (CERS6) c2(NP_073603) c3(2049) c4(28163, 41220, 54277, 15106, 67334) c5(aw, cV, nE, ji, u, y); #c1(CERKL) c2(NP_001025482) c3(2050) c4(28164, 41221, 54278, 15107, 67335) c5(nQ, ml, do, aLh, nE, nR, nW); #c1 (CERS1) C2(NP_001277194) c3(2051) c4(28165, 41222, 54279, 15108, 67336) c5(b, cV, f, F, P, fP); #c1(CERS2) c2(XP_011507753) c3(2052) c4(28166, 41223, 54280, 15109, 67337) c5(bm, A, aX, u, B, Q, fD, et, y); #c1 (CERS3) c2(NP_001277270) c3(2053) c4(28167, 41224, 54281, 15110, 67338) c5(Ep, aLi, dw); #c1(CERS4) c2(NP_078828) c3(2054) c4(28168, 41225, 54282, 15111, 67339) c5(A); #c1(CERS6) c2(NP_001243055) c3(2055) c4(28169, 41226, 54283, 15112, 67340) c5(IV, f, u, y); #c1(CES1) c2(NP_001020365) c3(2056) c4(28170, 41227, 54284, 15113, 67341) c5(dx, b, dD, gE, oH, eY, dd, z, U, dv, jl, aKN, ni, t, h, q, gX, Wf, jG, V, I, du, J, bp, G, ac, cg, LW, ex, di, aA, at); #c1(CES2) c2(NP_003860) c3(2057) c4(28171, 41228, 54285, 15114, 67342) c5(gK, ck, b, fr, Ey, dd, U, O, hV, gX, hN, ar, gP, cs, u, nk, V, cV, gm, ft, P, nV, x, On, LW, re, Dj, ih); #c1(CES3) c2(NP_001172105) c3(2058) c4(28172, 41229, 54286, 15115, 67343) c5(dx, gK, du, dv, at); #c1(CETN1) c2(NP_004057) c3(2059) c4(28173, 41230, 54287, 15116, 67344) c5(B, b, HN, Ik, apC, dB, aN, mk, A, U, y, VC, co, aX, bn, fq, h, hV, g, bu, eE, iK, Xx, aD, u, da, fi, gG, V, cs, v, ad, T, cy, fx, by, er, DO, ag, i, iu); #c1(CETN2) c2(NP_004335) c3(2060) c4(28174, 41231, 54288, 15117, 67345) c5(iF, k, jd, u, Dj, cB, vt); #c1(CETN3) c2(NP_004356) c3(2061) c4(28175, 41232, 54289, 15118, 67346) c5(jd, iF, f, u, k); #c1(CETP)

c2(NP_000069) c3(2062) c4(28176, 41233, 54290, 15119, 67347) c5(dx, dN, dD, aN, eH, xb, hM, bW, dv, cy, nv, dl, nm, Ha, oN, mz, sH, du, jT, yj, hR, dS, fN, os, tO, Wp, fD, bq, aA, ug, wa, ZG, bf, i, eX, bm, ye, em, V, cx cd, Fy, dO, oo, vH, ap, uy, wm, eR, au, bb, q, AK, o, fh, Tl, I, sX, fz, dK, wL, et, ZO, ao, vT, ZL, I, bL, ka, ZQ, di, eO, aW, oy, m, jl, az, ev, bd, P, gF, ac, aM, aLj, ii, acK, Ic, at); #c1(CFAP126) c2(NP_001013647) c3(2063) c4(28177, 41234, 54291, 15120, 67348) c5(jH); #c1(CFAP36) c2(NP_001269690) c3(2064) c4(28178, 41235, 54292, 15121, 67349) c5(b); #c1(CFAP44) c2(NP_060808) c3(2065) c4(28179, 41236, 54293, 15122, 67350) c5(bg); #c1(CFAP52) c2(NP_001074025) c3(2066) c4(28180, 41237, 54294, 15123, 67351) c5(g); #c1(CFAP53) c2(NP_659457) c3(2067) c4(28181, 41238, 54295, 15124, 67352) c5(hS, aLk, mk); #c1(CFAP57) c2(XP_011539101) c3(2068) c4(28182, 41239, 54296, 15125, 67353) c5(aLI); #c1 (CFAP58) C2(NP_001008723) c3(2069) c4(28183, 41240, 54297, 15126, 67354) c5(at); #c1(CFAP61) c2(NP_056400) c3(2070) c4(28184, 41241, 54298, 15127, 67355) c5(cO); #c1(CFAP69) c2(NP_001034795) c3(2071) c4(28185, 41242, 54299, 15128, 67356) c5(gm); #c1(CFAP97) c2(NP_001278962) c3(2072) c4(28186, 41243, 54300, 15129, 67357) c5(en, zE, f, kB, B, cO, I, O, jT, u, y); #c1(CFB) C2(NP_001701) c3(2073) c4(28187, 41244, 54301, 15130, 67358) c5(da, aF, ZP, UA, axA, aLn, dW, GV, axt, bj, aW, aLo, m, agM, o, jl, ml, nv, fP, aV, Uy, aE, pW, FD, aAq, I, aC, P, aLm, qD, eq, jH, aY, G, dY, agN, dX, ace, iB, aA, at); #c1(CFC1B) c2(NP_001072998) c3(2074) c4(28188, 41245, 54302, 15131, 67359) c5(aLp, Cj, aLg); #c1(CFC1) c2(NP_115934) c3(2075) c4(28189, 41246, 54303, 15132, 67360) c5(aLt, em, jT, f, ae, aLu, b, at, aLs, ig, aLq, aLr, z, I, n, FG, hR, et, aLv, O, qT); #c1(CFD) c2(NP_001919) c3(2076) c4(28190, 41247, 54304, 15133, 67361) c5(jl, hU, pp, aLw, ch, awD, pW, aLx aLy, aA, at, eG, aW); #c1(CFDP1) c2(NP_006315) c3(2077) c4(28191, 41248, 54305, 15134, 67362) c5(ao, nl, aX, bS, b, aC, re, f, v, alV, T, iT, KL, oD, at, o); #c1(CFH) c2(NP_000177) c3(2078) c4(28192, 41249, 54306, 15135, 67363) c5(aba, dx by, B, aw, dB, eC, sJ, w, Eh, aLH, aLM, xl, dv, wd, AX, fP, aLC, dl, aLG, vT, Pv, aLT, cq, Uy, cc, aLS, aC, aHS, du, vx, eR, x, rW, pq, aLO, kM, aHI, cT, dX, i, ace, vJ, bq, aA, rn, sU, bP, wa, Bu, Kt, mk, ma, aLB, vp, GV, Co, y, co, pp, aDT, adr, ml, f, IW, bu, li, O, cs, oD, fy, pW, gD, em, fD, ae, gb, ajl, v, BV, aLR, zi, cK, aLF, anr, W, pk, dy, aLL, aLz, P, JO, aLP, ji, bX, ap, b, aF, agL, fl, nv, z, aO, agM, bb, pi, oB, q, dW, ar, sK, aE, o, cl, I, aLJ, gL, aLD, IX, xq, et, aLN, iw, aLE, hU, aaN, aLQ, aLK, Ht, uH, aaM, Bm, Au, I, aU, Ku, azt, Ef, A, bf, kg, UA, EM, aLA, axA, di, eO, wf, bj, aW, c, IE, jl, Ir, DV, hN, Ek, aV, sH, hr, fU, Ed, nQ, m, sB, dt, hR, jo, Ei, T, Bb, ad, aM, aLI, arr, At, agN, aBz, at); #c1(CFHR1) c2(NP_002104) c3(2079) c4(28193, 41250, 54307, 15136, 67364) c5(m, fl, aw, b, qb, ZP, ie, ql, di, II, fD, Ek, bb, gD, jl, Uy, h, aW); #c1(CFHR2) c2(NP_005657) c3(2080) c4(28194, 41251, 54308, 15137, 67365) c5(aW); #c1 (CFHR3) c2(NP_001160096) c3(2081) c4(28195, 41252, 54309, 15138, 67366) c5(m, fl, b, qb, et, ZP, di, pW, fD, Ek, qD, Uy, aW); #c1(CFHR4) c2(NP_001188480) c3(2082) c4(28196, 41253, 54310, 15139, 67367) c5(m, aW); #c1 (CFHR5) c2(NP_110414) c3(2083) c4(28197, 41254, 54311, 15140, 67368) c5(bP, Ek, aw, aLW, hU, acQ, m, fD, aLV, aLU, qD, jl, et, rW, aW, gO); #c1(CFI) c2(NP_000195) c3(2084) c4(28198, 41255, 54312, 15141, 67369) c5(aw, b, aLB, GV, aLY, aW, aem, q, bu, bm, aLS, qb, bp, P, Bb, aLX, aLZ, agl, Uy, Bu, bk, fD, qD, eG); #c1(CFL1) c2(NP_005498) c3(2085) c4(28199, 41256, 54313, 15142, 67370) c5(IJ, A, wa, y, BO, co, aX, jd, f, q, jF, ar, B, cs, fy, u, n, yJ, cV, iv, J, fO, ad, T, x, cy, jh, aA, eG); #c1(CFL2) c2(NP_068733) c3(2086) c4(28200, 41257, 54314, 15143, 67371) c5(At, BC, A6, aMa, oD); #c1(CFLAR) c2(NP_001120656) c3(2087) c4(28201, 41258, 54315, 15144, 67372) c5(fr, A, aw, pF, b, cY, iP, jz, dB, hS, w, iG, aEE, bw, U, re, fx, y, cy, d, co, LL, ajn, QE, h, B, e, g, bu, X, aze, ar, O, hb, cs, fH, av, aV, u, dh, iT, n, Yj, jQ, kG, V, aeM, cV, aC, ft, LR, gm, fO, J, jo, ti, T, ji, x, aX, iA, ad, pi, f J, jH, jT, fy, P, by, ag, cT, oi, apy, i, od, ci, iE); #c1(CFP) c2(NP_002612) c3(2088) c4(28202, 41259, 54316, 15145, 67373) c5(bL, iU, aMe, xw, aW, hw, f, q, iZ, cM, aMc, bm, o, Bm, aMb, ajl, P, jr, aLF, aMd, sg, pW, ji); #c1(CFTR) c2(NP_000483) c3(2089) c4(28203, 41260, 54317, 15146, 67374) c5(aMz, en, aw, aMB, gG, aMr, vB, eH, HC, sJ, bn, bf, fx, gC, cy, b, aMo, aMF, Bl, gB, e, Zj, aKH, Mu, kz, aMw, aMq, ju, hi, IV, aMi, asd, aC, p, afh, aaq, tz, DT, asH, Lb, aMA, aMJ, mO, aMx EZ, OR, aei, sN, ag, xr, bk, i, bT, aMC, AL Kt, Kc, bw, U, ey, y, aMm, yy, co, hi, DM, f, akf, bu, aMH, B, cs, gg, fy, iT, aBv, le, aMD, aMI, aMk, Wh, MW, eX, aMt, a My, gH, pi, aAo, aMG, aMn, aKy, dP, kJ, UT, fW, gz, aMu, am, aKD, aML, wn, z, aMh, d, dl, aem, ZR, fv, re, aua, aMM, g, dQ, aMj, ar, u, aE, aMf, NT, JP, I, awy, gL, by, as, aZ, azh, alH, pY, kh, ex, yr, gd, kC, IT, aMp, I, aKw, QU, A, aML TO, In, aCZ, avJ, D, rj, oy, V, o, wG, wN, zB, aMv, aME, aFc, xc, an, aMK, dt, P, ti, T, aMs, aMg, qe, aM, eJ, nk, fP, Yv, at, eG); #c1(CGA) c2(NP_000726) c3(2090) c4(28204, 41261, 54318, 15147, 67375) c5(Dr, PG, A, aw, am, X, Dv, EM, wy, aMP, Hq, aiM, NT, dV, bW, fx y, ZA, cU, Nm, co, b, aga, Bi, B, UV, jV, aMN, ra, dZ, Ex, aMO, cB, av, I, u, Lg, PJ, Ps, fU, NW, iw, aMR, qC, cz, W, afJ, axl, bQ, T, Bd, tj, iA, hN, fM, aL, fy, aMQ, aq, od, LC, cV, yE, Lo, agk, i, la, aMS, aU, afG, Xm, bV); #c1(CGB1) c2(NP_203695) c3(2091) c4(28205, 41262, 54319, 15148, 67376) c5(Dd); #c1(CGB2) c2(NP_203696) c3(2092) c4(28206, 41263, 54320, 15149, 67377) c5(Dd); #c1 (CGB5) c2(NPJ49032) c3(2093) c4(28207, 41264, 54321, 15150, 67378) c5(A, b, X, Dv, dB, wy, dV, fx y, d, Hq, aga, re, B, UV, jV, e, cO, dZ, Dd, tg, av, ag, iT, Lg, if, fU, kF, T, iA, u, Lo, agk, i, od); #c1(CGB7) c2(XP_011525821) c3(2094) c4(28208, 41265, 54322, 15151, 67379) c5(A, b, X, Dv, dB, wy, dV, fx, y, d, Hg, aga, re, B, UV, jV, e, cU, dZ, Dd, av, aq, iT, Lg, if, fU, T, iA, u, Lo, agk, i, od); #c1(CGN) c2(XP_005245422) c3(2095) c4(28209, 41266, 54323, 15152, 67380) c5(d, cy, e); #c1(CGNL1) c2(NPJI6255) c3(2096) c4(28210, 41267, 54324, 15153, 67381) c5(ak); #c1(CGRRF1) c2(NP_006559) c3(2097) c4(28211, 41268, 54325, 15154, 67382) c5(cU, aA, do, bj, iA); #c1(CH25H) c2(NP_003947) c3(2098) c4(28212, 41269, 54326, 15155, 67383) c5(l, dv, o); #c1(CHAC1) c2(NP_001136248) c3(2099) c4(28213, 41270, 54327, 15156, 67384) c5(b, X, Dt, av, u, y); #c1(CHAD) c2(XP_011522516) c3(2100) c4(28214, 41271, 54328, 15157, 67385) c5(d, e); #c1 (CHAF1A) c2(NP_005474) c3(2101) c4(28215, 41272, 54329, 15158, 67386) c5(g, pE, A, b, cV, pL, aw, ad, dl, O, cs, av, u, y); #c1(CHAF1B) c2(NP_005432) C3(2102) c4(28216, 41273, 54330, 15159, 67387) c5(aq, u, o, avv); #c1(CHAMP1) c2(NP_001157617) c3(2103) c4(28217, 41274, 54331, 15160, 67388) c5(Kw, ao, nV, cy, EZ, lb, t, hV, J, G, P, mR, iu, fq, ar, O, pi, qe); #c1(CHAT) c2(NP_001136401) c3(2104) c4(28218, 41275, 54332, 15161, 67389) c5(GL, iP, aN, AA, ahV, xb, iM, bf, xw, aK, e, abp, d, xz, cy, dc, tF, Gs, cM, cs, aq, dh, o, Am, xC, xD, aC, akH, xS, Fp, xs, T, cV, Aj, ad, aM, xQ, rK, aY, eB, aMT, bq, aT); #c1(CHCHD10) c2(NP_998885) c3(2105) c4(28219, 41276, 54333, 15162, 67390) c5(ao, kW, axZ, bS); #c1(CHCHD1) c2(NP_976043) c3(2106) c4(28220, 41277, 54334, 15163, 67391) c5(kW); #c1(CHCHD3)

c2(NP_060282) c3(2107) c4(28221, 41278, 54335, 15164, 67392) c5(IV, rQ); #c1(CHCHD5) c2(NP_115685) c3(2108) c4(28222, 41279, 54336, 15165, 67393) c5(Eo); #c1(CHCHD6) c2(NP_115719) c3(2109) c4(28223, 41280, 54337, 15166, 67394) c5(b); #c1(CHCHD7) c2(NP_001011668) c3(2110) c4(28224, 41281, 54338, 15167, 67395) c5(aeC); #c1(CHD1) c2(XP_005271923) c3(2111) c4(28225, 41282, 54339, 15168, 67396) c5(A, b, B, bu, ag, T, bf, u, y, aM); #c1(CHD2) c2(NP_001036037) c3(2112) c4(28226, 41283, 54340, 15169, 67397) c5(wn, IC, nU, hS, di, avY, aMU); #c1(CHD3) c2(NP_001005271) c3(2113) c4(28227, 41284, 54341, 15170, 67398) c5(ag, nz, aiv); #c1(CHD4) c2(NP_001284482) c3(2114) c4(28228, 41285, 54342, 15171, 67399) c5(iA, w); #c1(CHD6) c2(NP_115597) c3(2115) c4(28229, 41286, 54343, 15172, 67400) c5(en, b, X, A, U, e, y, d, co, aX, q, bu, O, av, iR, EX, V, cV, J, by, T, kS, st, u, DO, i, Ez, eG); #c1(CHD7) c2(NP_060250) c3(2116) c4(28230, 41287, 54344, 15173, 67401) c5(KC, aw, eu, aMZ, yD, hM, kJ, U, aNa, cr, or, kH, ahl, rl, aua, aMV, aNb, Gs, cs, aC, US, tz, ad, dt, UT, hR, a MY, avY, hQ, aNc, a MW, zE, acK, BU, K, cC, ag, mx, amS, aMX, aNd); #c1(CHD8) c2(NP_001164100) c3(2117) c4(28231, 41288, 54345, 15174, 67402) c5(rQ, Wk, nU, cz, aNe, avY); #c1(CHDH) c2(NP_060867) c3(2118) c4(28232, 41289, 54346, 15175, 67403) c5(dx, ats, eX aw, b, cO, eR, eH, di, z, bf, dN, ZH, arY, dv, bb, aNf, f, om, tE, cs, u, aO, I, xf, du, ad, dt, afh, bq, QZ, cr, hR, aM, rQ, hQ, aai, acw, Nq, Ns, fD, ahp, aA, at, y, ap); #c1(CHEK1) c2(NP_001231775) c3(2119) c4(28233, 41290, 54347, 15176, 67404) c5(ji, A, b, X, O, aFe, aBx, kY, Lq, bw, U, BQ, y, d, co, aX, ajF, ag, QZ, h, f, e, q, bu, cU, fr, ar, B, cB, cs, av, cq, u, ajt, n, g, Dp, fU, V, cV, Dg, fO, J, afn, ad, ais, T, Qz, pt, x, jl, iA, by, ac, pq, jT, fy, Dj, jd, fl, iT, i, I, oM, WS, re); #c1(CHEK2) c2(NP_001244316) c3(2120) c4(28234, 41291, 54348, 15177, 67405) c5(dx, aNi, B, aw, avk, w, cO, e, O, yg, ajF, nZ, cl, fH, R, g, og, aC, du, bp, ft, Ce, x, fx, jT, eg, BX, aNg, gN, jh, ag, cT, i, GD, X, fE, wy, kY, bw, U, y, jb, co, pw, ip, f, agm, bu, Up, cs, av, fy, bm, Bd, V, aub, avf, afn, Qz, iA, f J, pk, nJ, gO, fD, Ig, b, aNj, ic, aoi, BQ, Ne, d, Ag, jd, g, jV, age, ar, ff, n, jG, u, I, dT, ad, uw, et, et, WZ, Mp, fj, A, fr, di, hP, aX, h, F, cU, ik, rR, ajt, fU, cV, aNh, J, GB, T, by, fM, iB, Bi); #c1(CHERP) c2(NP_006378) c3(2121) c4(28235, 41292, 54349, 15178, 67406) c5(aNl, aNk, lb, bK, J, jV, acO, axl, pK); #c1(CHFR) C2(NP_001154816) c3(2122) c4(28236, 41293, 54350, 15179, 67407) c5(aw, b, X, U, e, y, d, co, apG, re, f, bu, cU, ar, cs, ik, av, QJ, u, iT, V, il, bp, ad, T, iA, by, fy); #c1(CHGA) c2(NP_001288619) c3(2123) c4(28237, 41294, 54351, 15180, 67408) c5(eX, aw, EM, jt, HC, bV, cO, bW, e, b, aNn, aNq, aC, bp, od, Jj, fx jT, aL, aNm, yE, i, la, aA, bP, Jy, em, oa, aiM, bf, y, co, ag, f, akf, aMN, B, aNr, Tk, fy, iF, Bd, fD, aMR, afJ, aU, VP, Fr, ahT, anG, aMQ, cf, aNp, ap, Dr, am, vh, tj, Bh, d, jF, es, ra, ar, u, aE, o, aMO, sz, ZA, I, qC, by, uw, jU, iw, ao, aKb, Bg, D, afG, Xm, QU, A, PJ, di, jR, Nm, qs, aNo, ty, h, hN, Ex, cB, IG, Ps, fU, cV, YR, W, axl, T, nP, fM, aM, eJ, qp, LG, fP, Yv, Bi); #c1(CHGB) c2(NP_001810) c3(2124) c4(28238, 41295, 54352, 15181, 67409) c5(eJ, ao, ck, b, iF, h, kJ, MT, yE, cT, di, o, cV, Dd, u, y, ap); #c1(CHI3L1) c2(XP_011507410) c3(2125) c4(28239, 41296, 54353, 15182, 67410) c5(dx, aw, dD, sE, sJ, w, e, O, dv, cy, jq, aD, g, aC, du, bp, fc, bY, ag, qP, bk, bq, aA, wz, bP, zr, X, mk, U, y, V, co, Ot, f, cs, av, yJ, wK, vR, rN, aNt, gv, bt, dO, Mq, zS, ap, b, aF, z, aO, d, bb, g, ar, u, dh, da, aDu, Zz, I, LR, ad, aZ, jU, jH, yr, I, bL, A, k, di, gE, al, aW, aNs, aV, fU, hZ, be, ti, T, qe, zM, fP, bh, at); #c1(CHIC1) c2(NP_001034929) c3(2126) c4(28240, 41297, 54354, 15183, 67411) c5(X, av); #c1(CHIC2)

c2(NP_036242) c3(2127) c4(28241, 41298, 54355, 15184, 67412) c5(NG, h, zh, J, NH, Xz); #c1(CHIT1) c2(NP_001243054) c3(2128) c4(28242, 41299, 54356, 15185, 67413) c5(dx A, aF, sE, Fc, sJ, di, bf, JK, y, dC, cy, h, aJ, aD, dH, u, aNu, ae, du, aAA, gL, pi, qe, aM, nk, pP, aNw, aFk, I, aNv, at, wz); #c1(CHKA) c2(NP_997634) c3(2129) c4(28243, 41300, 54357, 15186, 67414) c5(IJ, A, b, X, U, O, co, f, q, B, cs, av, fy, u, V, cV, ad, aNx, P, x, jT, Qk, Nq, ag, Ns, y); #c1(CHKB) c2(NP_005189) c3(2130) c4(28244, 41301, 54358, 15187, 67415) c5(aNy, zo, ami, J, do, aaY, x, fy, ps, xl); #c1(CHL1) c2(NP_001240317) c3(2131) c4(28245, 41302, 54359, 15188, 67416) c5(nU, b, fe, hM, jC, xw, adr, O, co, aX, aBP, re, KA, f, M, ar, ff, cs, hV, av, QJ, aq, iT, fU, FK, cV, me, avS, ad, W, jo, T, fO, FW, nP, cz, aiy, jT, Xu, cK, XH, Yv, vt, h); #c1(CHM) c2(NP_000381) c3(2132) c4(28246, 41303, 54360, 15189, 67417) c5(Gt, fr, Bj, yn, U, bj, aW, cp, IZ, zo, ml, cM, V, nQ, cV, nW, dc, ft, iN, pk, aY, aih, fl, GJ); #c1(CHML) c2(NP_001812) c3(2133) c4(28247, 41304, 54361, 15190, 67418) c5(cy, nQ, dY, ow, aD, Gg, aV, Bj); #c1(CHMP1A) c2(NP_001076783) c3(2134) c4(28248, 41305, 54362, 15191, 67419) c5(b, dB, pt, aNz, bw, QZ, oM, Vf, ff); #c1(CHMP1B) c2(NP_065145) c3(2135) c4(28249, 41306, 54363, 15192, 67420) c5(kW, Y, ak, dB, awT, Q, awO, oD, EX, n); #c1(CHMP2B) c2(NP_001231573) c3(2136) c4(28250, 41307, 54364, 15193, 67421) c5(fl, bS, Rr, PY, ai, yK, bb, aNA, aNC, OA, dh, o, fh, aNB, cV, sB, v, T, aj, pq, ao, Ck, yM); #c1(CHMP3) c2(NP_001005753) c3(2137) c4(28251, 41308, 54365, 15194, 67422) c5(A, B, bp, P, fl, ag); #c1(CHMP4A) c2(NP_054888) c3(2138) c4(28252, 41309, 54366, 15195, 67423) c5(P, RQ); #c1(CHMP4B) c2(NP_789782) c3(2139) c4(28253, 41310, 54367, 15196, 67424) c5(P, aND, RQ); #c1(CHMP4C) c2(NP_689497) c3(2140) c4(28254, 41311, 54368, 15197, 67425) c5(X, av); #c1(CHMP5) c2(NP_001182465) c3(2141) c4(28255, 41312, 54369, 15198, 67426) c5(h, J, iv); #c1(CHN1) c2(NP_001020372) c3(2142) c4(28256, 41313, 54370, 15199, 67427) c5(aNF, aNG, QV, arP, cV, aNE, aNH, eo, NA, kB, aHM); #c1(CHN2) c2(NP_001035025) c3(2143) c4(28257, 41314, 54371, 15200, 67428) c5(aaQ, aX, b, l, cV, bm, eu, wf, cy, u); #c1(CHODL) c2(NP_001191103) c3(2144) c4(28258, 41315, 54372, 15201, 67429) c5(fy, kz, co, b); #c1(CHORDC1) c2(NP_001137545) c3(2145) c4(28259, 41316, 54373, 15202, 67430) c5(oy, bb, dA, at, bj, o); #c1(CHP1) c2(NP_009167) c3(2146) c4(28260, 41317, 54374, 15203, 67431) c5(en, kE, b, Pv, jz, EN, aNl, Iv, iL, zL, bj, jD, jQ, jl, re, CR, q, aEU, cs, DY, iT, te, dj, hW, SV, ae, cV, kt, J, P, II, nP, jT, Oa, OJ, Yb, yq, alg, aEN); #c1(CHP2) c2(NP_071380) c3(2147) c4(28261, 41318, 54375, 15204, 67432) c5(X, av, T, b); #c1(CHPF) c2(NP_078812) c3(2148) c4(28262, 41319, 54376, 15205, 67433) c5(q); #c1(CHPT1) c2(NP_064629) c3(2149) c4(28263, 41320, 54377, 15206, 67434) c5(aNN, fr, A, aw, b, fN, X, aNL, jz, eu, jf, jR, U, aNO, y, jQ, d, co, aX, DE, kn, f, n, bu, M, gX, hN, mR, O, cs, aNK, ar, av, fy, u, cl, g, em, fU, V, cV, lb, aNJ, dB, J, ad, fB, jo, T, afa, auw, x, nP, ft, jG, aNP, aNQ, iw, jE, aNM, bm, tW, cf, he, Le, by, cX jN, fl, aA, gf); #c1(CHRAC1) c2(NP_059140) c3(2150) c4(28264, 41321, 54378, 15207, 67435) c5(u, y); #c1 (CHRD) C2(NP_001291401) c3(2151) c4(28265, 41322, 54379, 15208, 67436) c5(ahi, aai, b, X, aB, KA, aNR, q, K, aNS, afb, av, AP); #c1(CHRDL1) c2(NP_001137455) c3(2152) c4(28266, 41323, 54380, 15209, 67437) c5(aNT, P, w, Ah, at, dh); #c1(CHRFAM7A) c2(XP_011520455) c3(2153) c4(28267, 41324, 54381, 15210, 67438) c5(ak, bS, iP, bg, hS, xb, aNU, xw, aNV, f, aeY, tF, CG, o, Yk, Wh, afb, jr, cz, rQ, akA, tW, he, jN, rv, nU); #c1(CHRM1)

c2(XP_011543044) c3(2154) c4(28268, 41325, 54382, 15211, 67439) c5(aNX, bb, aNW, Bu, DO, cy, hS, o, x, If, DY, oN, fh); #c1(CHRM2) c2(XP_011514073) c3(2155) c4(28269, 41326, 54383, 15212, 67440) c5(KS, id, vD, abd, hS, cA, cM, aoa, cy, wr, ak, mL, mR, Gj, aV, aE, o, Yk, dj, hW, Gl, hR, IV, Uu, aY, ch, Bu, dc, bq); #c1(CHRM3) c2(NP_000731) c3(2156) c4(28270, 41327, 54384, 15213, 67441) c5(gn, hS, di, cA, bf, U, ey, aX, ak, cB, cs, aV, dj, aNY, V, I, ad, ti, x, cy, hR, aM, to, BB, Bu, yy, jN, I, bh, aA); #c1(CHRM4) c2(NP_000732) c3(2157) c4(28271, 41328, 54385, 15214, 67442) c5(c0, hW, aNU); #c1(CHRM5) c2(XP_005254198) c3(2158) c4(28272, 41329, 54386, 15215, 67443) c5(bb, dd, cB); #c1(GHRNA10) C2(NP_065135) c3(2159) c4(28273, 41330, 54387, 15216, 67444) c5(Yk); #c1(CHRNA1) c2(NP_000070) c3(2160) c4(28274, 41331, 54388, 15217, 67445) c5(Yk, co, pw, aOe, xB, xQ, I, aOa, iB, aNZ, aGf, ap); #c1(CHRNA2) c2(NP_000733) c3(2161) c4(28275, 41332, 54389, 15218, 67446) c5(ih, oC, ak, aOe, Yk, aOc, aOd, hS, vu, aA, Gj, IV); #c1(CHRNA3) c2(NP_000734) c3(2162) c4(28276, 41333, 54390, 15219, 67447) c5(b, Fc, dd, co, hi, hB, bu, aOg, ar, Wf, hi, OA, QJ, aq, o, Yk, aP, aOb, IM, bp, by, Wj, IV, fy, aqp, Qk, jN, i, I, ji, aA, aOf); #c1(CHRNA4) c2(NP_000735) c3(2163) c4(28277, 41334, 54391, 15220, 67448) c5(by, aOe, b, Gm, hY, cO, aOh, aN, bg, hS, qa, aOk, cA, bf, xw, bj, e, cM, aRv, avQ, co, l, tF, fq, GL, hB, ahd, bu, aOd, Vr, ar, bK, IL, OA, QJ, aqp, CG, o, d, Gr, hW, aOb, nl, Jt, cs, xz, ad, I, P, xq, wX, oE, jr, fx, cz, fU, aM, to, xQ, aOj, fy, aOi, Fp, aY, u, ag, hn, ih, akA, i, dc, iB, bM, dR); #c1(CHRNA5) c2(NP_000736) c3(2164) c4(28278, 41335, 54392, 15221, 67449) c5(Gt, b, GL, alV, qa, dd, e, d, jh, co, do, ar, Wf, IV, aqp, aOb, bp, Js, Wj, T, ih, jN, I, ji, aA, aOf); #c1(CHRNA6) c2(NP_001186208) c3(2165) c4(28279, 41336, 54393, 15222, 67450) c5(Yk, Gr, aOb, Gm, bp, cO, agp); #c1(CHRNA7) c2(NP_000737) c3(2166) c4(28280, 41337, 54394, 15223, 67451) c5(f, GL, BF, LA, bg, hS, xb, HS, aNU, xw, Fp, aNV, ak, aeY, LB, tF, axC, hY, aq, CG, oN, jN, yJ, cV, sH, nu, bp, Wh, T, afb, jr, x, cz, rQ, akA, tW, he, aOI, aal, o, rv, nU); #c1(CHRNB1) c2(NP_000738) c3(2167) c4(28281, 41338, 54395, 15224, 67452) c5(iB, Yk, aOa, aOm, aGf); #c1(CHRNB2) c2(NP_000739) c3(2168) c4(28282, 41339, 54396, 15225, 67453) c5(to, aOd, avQ, aOe, Yk, ih, ag, aOn, Fp, cz, dl, hS, do, xg, HS, df, hw, o); #c1(CHRNB3) c2(NP_000740) c3(2169) c4(28283, 41340, 54397, 15226, 67454) c5(oy, Yk, Wj, aOb, bp, aqp, CG); #c1(CHRNB4) c2(NP_000741) c3(2170) c4(28284, 41341, 54398, 15227, 67455) c5(Yk, co, OA, aOb, aY, bp, dd, dc, I, ji, IV, aA, cM, RB); #c1(CHRND) c2(NP_000742) c3(2171) c4(28285, 41342, 54399, 15228, 67456) c5(Yk, xQ, aOa, iB, aNZ, aGf, ap); #c1(CHRNE) c2(NP_000071) c3(2172) c4(28286, 41343, 54400, 15229, 67457) c5(pw, DG, XZ, xB, xQ, aOa, aOm, iB, aNZ, aGf, aOn); #c1(CHRNG) C2(NP_005190) c3(2173) c4(28287, 41344, 54401, 15230, 67458) c5(xQ, Vx, Yk, aOp, cl, aCT, ap); #c1(CHST10) c2(NP_004845) c3(2174) c4(28288, 41345, 54402, 15231, 67459) c5(aX); #c1(CHST11) c2(NP_001167453) c3(2175) c4(28289, 41346, 54403, 15232, 67460) c5(A, aOq, cT, gA, jN, bf, u, eV, y, kP); #c1(CHST12) c2(NP_001230724) c3(2176) c4(28290, 41347, 54404, 15233, 67461) c5(gA, aOg, eV); #c1(CHST13) c2(NP_690849) c3(2177) c4(28291, 41348, 54405, 15234, 67462) c5(gA, aOq, eV); #c1(CHST14) c2(NP_569735) c3(2178) c4(28292, 41349, 54406, 15235, 67463) c5(aOt, Ex, aOr, AP, aOs); #c1(CHST15) c2(NP_001257694) c3(2179) c4(28293, 41350, 54407, 15236, 67464) c5(w, av, at, k); #c1(CHST1) c2(NP_003645) c3(2180) c4(28294, 41351, 54408, 15237, 67465) c5(to, rM, jN); #c1(CHST2) c2(NP_004258) c3(2181) c4(28295, 41352, 54409, 15238, 67466) c5(to, jH, an, fl, fr, ft, do, ar, jN); #c1(CHST3) c2(XP_006718138) c3(2182) c4(28296, 41353, 54410, 15239, 67467) c5(A, b, jj, aOv, di, aOw, bw, aOx y, cp, cU, qs, bQ, dN, B, q, aMN, afH, ar, oJ, azP, av, u, HI, fs, I, aOy, p, dt, afJ, wg, T, bq, iA, aOu, gT, W, wh, ID, ex, od, eG, ap); #c1(CHST4) c2(NP_005760) c3(2183) c4(28297, 41354, 54411, 15240, 67468) c5(ar, af, aOz, bb, b); #c1(CHST5) c2(NP_078809) c3(2184) c4(28298, 41355, 54412, 15241, 67469) c5(af, ar, ac); #c1(CHST6) c2(XP_011521387) c3(2185) c4(28299, 41356, 54413, 15242, 67470) c5(PZ, aOB, Ad, aOC, aOA); #c1(CHST8) c2(XP_011525528) c3(2186) c4(28300, 41357, 54414, 15243, 67471) c5(aA, dA, cy, aGa); #c1(CHST9) c2(NP_001243245) c3(2187) c4(28301, 41358, 54415, 15244, 67472) c5(h); #c1(CHSY1) c2(NP_055733) c3(2188) c4(28302, 41359, 54416, 15245, 67473) c5(aOD, sm); #c1(CHSY3) c2(NP_787052) c3(2189) c4(28303, 41360, 54417, 15246, 67474) c5(aOF, aOE); #c1(CHTF18) c2(NP_071375) c3(2190) c4(28304, 41361, 54418, 15247, 67475) c5(f); #c1(CHTOP) c2(NP_001193541) c3(2191) c4(28305, 41362, 54419, 15248, 67476) c5(fg, aB, N, pz, bq); #c1(CHORC1) c2(NP_001190992) c3(2192) c4(28306, 41363, 54420, 15249, 67477) c5(cz); #c1(CIAO1) c2(NP_004795) c3(2193) c4(28307, 41364, 54421, 15250, 67478) c5(aC, bf, aM); #c1(CIAPIN1) c2(NP_064709) c3(2194) c4(28308, 41365, 54422, 15251, 67479) c5(by, g, b, pR, J, bu, ag, ar, R, JY); #c1(CIB1) c2(NP_006375) c3(2195) c4(28309, 41366, 54423, 15252, 67480) c5(YZ, B, aw, Vz, w, e, U, cy, DE, fH, R, gm, fO, ft, fl, Jj, fx jT, pq, yE, cT, aex, i, jC, avz, dB, Dr, fl, X, jz, aJn, iG, OO, U, Sk, y, co, ag, f, bu, cs, av, fy, bm, OT, iT, if, jB, V, aHK, qq, bt, Qt, Fr, f J, P, jR, ji, kD, b, oi, Qj, d, re, hV, q, jV, ar, ff, Km, jG, iR, il, by, iD, yG, cW, nV, hX, u, agb, Bx, aJo, zD, bL, A, k, fr, pR, ow, Iv, Bz, aJj, jx, aX, VD, h, atx cU, n, cB, jQ, aq, fU, si, cV, Fs, J, W, jo, T, II, jl, ad, VF, Nu, Ic, Ng, eG); #c1(CIB2) c2(NP_006374) c3(2196) c4(28310, 41367, 54424, 15253, 67481) c5(B, b, X, jz, aOG, A, ow, Iv, bf, fx, y, jQ, d, co, jl, mF, f, g, e, aOH, Dd, cl, av, ZU, u, n, jB, fe, gm, W, od, fy, gF, aM, rQ, QG, ie, hd, fl, i, Bx, I, ci); #c1(CIC) c2(NP_055940) c3(2197) c4(28311, 41368, 54425, 15254, 67482) c5(An, b, k, aiQ, eG, w, ur, jR, U, kV, y, m, QV, SI, nU, es, cU, O, u, aMf, cl, fe, V, aC, Fs, afb, aDs, hU, K, aOI); #c1(CIDEB) c2(NP_001305736) c3(2198) c4(28312, 41369, 54426, 15255, 67483) c5(A); #c1(CIDEC) c2(NP_001186480) c3(2199) c4(28313, 41370, 54427, 15256, 67484) c5(fN, bm, q, QX, bf, gj, Hh, aOJ, Mb, dL, aA, aM); #c1(CIITA) c2(NP_000237) c3(2200) c4(28314, 41371, 54428, 15257, 67485) c5(dM, aw, iL, b, pR, XL aE, ig, s J, pw, di, Og, jC, Oh, hP, e, y, cp, d, m, aOK, aX, or, pp, aOw, eX, g, O, fH, aV, u, gl, o, fh, V, cV, aC, Xn, gm, gL, eu, P, T, fO, bb, jT, fJ, dH, jH, aoc, fc, iz, jZ, bO, fP, fO, fq, bq, cl); #c1(CILP2) c2(NP_694953) c3(2201) c4(28315, 41372, 54429, 15258, 67486) c5(l, aO); #c1 (CILP) c2(NP_003604) c3(2202) c4(28316, 41373, 54430, 15259, 67487) c5(aC, rG, aiu, afp); #c1(CINP) c2(NP_116019) c3(2203) c4(28317, 41374, 54431, 15260, 67488) c5(cB); #c1(CIPC) c2(NP_219494) c3(2204) c4(28318, 41375, 54432, 15261, 67489) c5(oy); #c1(CIR1) c2(NP_004873) c3(2205) c4(28319, 41376, 54433, 15262, 67490) c5(bf, cV, aM); #c1(CIRBP) c2(NP_001287744) c3(2206) c4(28320, 41377, 54434, 15263, 67491) c5(jH, A, Vb, b, aF, Ow, f, jL, cU, B, Wk, iA, at, u, dh, y, fh); #c1(CIRH1A) c2(NP_116219) c3(2207) c4(28321, 41378, 54435, 15264, 67492) c5(gD, gB, aOM, aOL); #c1(CISD1) c2(NP_060934) c3(2208) c4(28322, 41379, 54436, 15265, 67493) c5(bf, bq, I, aM); #c1(CISD2) c2(NP_001008389)

c3(2209) c4(28323, 41380, 54437, 15266, 67494) c5(a00, Nh, aOP, awS, Au, bf, aON, adQ); #c1(CISH) c2(NP_037456) c3(2210) c4(28324, 41381, 54438, 15267, 67495) c5(dx, bL, ach, uk, b, fr, aOR, gG, jz, dB, wy, aOQ, BY, A, iL, cO, U, e, y, aCV, d, dv, aX, ae, iR, re, B, N, q, Be, jQ, pB, av, Hs, u, iT, wP, V, I, Ib, du, ft, P, QI, aFj, II, VP, aC, fx, jT, fp, cW, aLZ, wV, aV, py, fc, aOS, Rd, ih, cX, FJ, fq, i, gj, T, aA, rn); #c1(CITED1) c2(NP_001138357) c3(2211) c4(28325, 41382, 54439, 15268, 67496) c5(W, jB, nV, aX, bm, aOT, ND, ra, og, fe, T, Ni, Nf, u, y); #c1 (CITED2) c2(NP_001161860) c3(2212) c4(28326, 41383, 54440, 15269, 67497) c5(PG, fr, jj, IJ, jw, y, oy, awK, cy, Mw, jk, bu, cc, cs, av, u, Fg, fh, I, ad, x, cr, by, Ap, aOV, wR, hQ, aOU, mx, at); #c1(CIT) c2(NP_001193928) c3(2213) c4(28327, 41384, 54441, 15270, 67498) c5(ajs, aIX, aY, ak, T, tQ, dc, cA, akX, av, GJ, bj, aE, cM, ans); #c1(CIZ1) c2(NP_001124490) c3(2214) c4(28328, 41385, 54442, 15271, 67499) c5(aOX, b, es, WA, aOW, bM, Wy, u, Wz); #c1(CKAP2) c2(NP_001091995) c3(2215) c4(28329, 41386, 54443, 15272, 67500) c5(b, bu, W, ar, by, u, y); #c1(CKAP2L) c2(NP_689728) c3(2216) c4(28330, 41387, 54444, 15273, 67501) c5(eG, TP); #c1(CKAP4) c2(NP_006816) c3(2217) c4(28331, 41388, 54445, 15274, 67502) c5(jp, akQ, DP, aw, aPi, Ty, Ir, adr, e, aPh, arV, arI, yh, arS, aPf, fe, gm, aOZ, ft, fx, aPg, aPj, aPc, ag, i, Dr, X, atd, Ak, mk, kY, U, y, tp, atj, f, B, av, fy, aEs, iT, V, bt, cy, yA, tI, ck, b, Mr, d, zJ, re, hV, ar, u, da, iI, LR, sf, aPe, nV, aPh, kM, Ns, aOY, Mp, A, fr, Lv, FL, avB, zK, MT, aX, F, ik, rR, fU, Be, QV, aPa, dt, Po, co, T, aPd, AP, qp, Nq, amS, Ez, rb); #c1(CKAP5) c2(NP_001008938) c3(2218) c4(28332, 41389, 54446, 15275, 67503) c5(u); #c1(CKB) c2(NP_001814) c3(2219) c4(28333, 41390, 54447, 15276, 67504) c5(b, X, gE, U, ps, aW, co, vC, bu, mR, cs, as, ar, av, o, fU, V, an, J, ad, x, cf, bq, rn); #c1(CKLF) c2(NP_001035228) c3(2220) c4(28334, 41391, 54448, 15277, 67505) c5(M, fq, aV, cy, b); #c1(CKM) c2(NP_001815) c3(2221) c4(28335, 41392, 54449, 15278, 67506) c5(aPI, aPk, el, x, bq, at, dh, ac); #c1(CKMT1A) c2(XP_005254555) c3(2222) c4(28336, 41393, 54450, 15279, 67507) c5(fi); #c1(CKMT1B) c2(XP_011519498) c3(2223) c4(28337, 41394, 54451, 15280, 67508) c5(I, fi); #c1(CKMT2) c2(NP_001093206) c3(2224) c4(28338, 41395, 54452, 15281, 67509) c5(h, b); #c1(CKS1B) c2(NP_001817) c3(2225) c4(28339, 41396, 54453, 15282, 67510) c5(A, b, anb, dB, atK, e, y, d, co, aX, t, q, bm, aJn, fO, by, G, T, pD, jT, jE, u, eG, aJo); #c1(CKS2) c2(NP_001818) c3(2226) c4(28340, 41397, 54454, 15283, 67511) c5(A, kF, V, b, jd, t, gG, bu, G, og, i, U, by, fx); #c1(CLASP1) c2(NP_001135745) c3(2227) c4(28341, 41398, 54455, 15284, 67512) c5(at, u); #c1(CLASP2) c2(NP_001193973) c3(2228) c4(28342, 41399, 54456, 15285, 67513) c5(aY, ix); #c1(CLCA2) c2(XP_011540750) c3(2229) c4(28343, 41400, 54457, 15286, 67514) c5(A, b, aPm, f, B, QJ, u, y); #c1(CLCA4) c2(XP_011539317) c3(2230) c4(28344, 41401, 54458, 15287, 67515) c5(u, bk, y, aPm); #c1(CLCF1) c2(NP_001159684) c3(2231) c4(28345, 41402, 54459, 15288, 67516) c5(aAU, V, b, XQ, aPo, aPn, dt, hS, U, et, aMf, aOI); #c1(CLC) c2(NP_001819) c3(2232) c4(28346, 41403, 54460, 15289, 67517) c5(aAU, V, b, ig, h, XQ, dt, hS, dQ, aDA, U, ba, et, aMf, aOI); #c1(CLCN1) c2(NP_000074) c3(2233) c4(28347, 41404, 54461, 15290, 67518) c5(avQ, zI, aPt, aPq, nI, eI, aOI, dt, hS, aPr, aPs, oD, akK, aPp, aMf, bk); #c1(CLCN2) c2(NP_001164558) c3(2234) c4(28348, 41405, 54462, 15291, 67519) c5(jH, avQ, aPw, Jy, hY, bK, aPv, cJ, akA, Id, aCD, hS, aPu, bk, jr, IL, jU, u, CG, O); #c1(CLCN3) c2(NP_001230301) c3(2235) c4(28349, 41406, 54463, 15292, 67520) c5(ed, A, b, B, q, bu, sp, w, bm, O); #c1(CLCN4) c2(NP_001243873) c3(2236) c4(28350, 41407, 54464, 15293, 67521) c5(aeF, hS, cs, ad); #c1(CLCN5) c2(NP_001121370) c3(2237) c4(28351, 41408, 54465, 15294, 67522) c5(aAU, bP, aw, I, VD, aPx, aPA, amJ, kZ, aPz, eC, Lm, TW, sU, aAW, aPy, dR, et, Ry, AO, amL); #c1(CLCN6) c2(NP_001277) c3(2238) c4(28352, 41409, 54466, 15295, 67523) c5(sp, di, I); #c1 (CLCN7) c2(NP_001107803) c3(2239) c4(28353, 41410, 54467, 15296, 67524) c5(nQ, aPC, zI, aPB, LG, zM, akg, O, cp); #c1(CLCNKB) c2(XP_011538921) c3(2240) c4(28354, 41411, 54468, 15297, 67525) c5(akd, qs, XL, na, aPD, aPE, XQ, Fw, aPG, yz, aPF, adM, aeP, di, fD, TW, et, Ry); #c1(CLDN10) c2(NP_001153572) c3(2241) c4(28355, 41412, 54469, 15298, 67526) c5(dI, m, aw, q, b); #c1 (CLDN11) c2(NP_005593) c3(2242) c4(28356, 41413, 54470, 15299, 67527) c5(by, hW, b, X, bu, fI, aX, av, aV); #c1(CLDN14) c2(NP_036262) c3(2243) c4(28357, 41414, 54471, 15300, 67528) c5(aIH, aAU, aPH); #c1(CLDN15) c2(NP_001172009) c3(2244) c4(28358, 41415, 54472, 15301, 67529) c5(asg); #c1(CLDN16) c2(NP_006571) c3(2245) c4(28359, 41416, 54473, 15302, 67530) c5(bP, aPI, b, X, et, gJ, aPz, di, fD, av, Hs, u, TW, y); #c1(CLDN18) c2(NP_001002026) c3(2246) c4(28360, 41417, 54474, 15303, 67531) c5(jH, by, co, MI, QN, b, ag, Be, bp, bu, qL, T, YB, iL, fy, ar, kN, YY, vn, jU, js); #c1(CLDN1) c2(NP_066924) c3(2247) c4(28361, 41418, 54475, 15304, 67532) c5(aw, b, X, jB, w, gE, bw, U, e, y, jb, d, co, gC, auW, ag, Bc, rr, gB, q, bu, cU, gX, ik, cs, ar, av, u, aEq, fi, aqP, V, wE, gL, ad, W, T, II, aPJ, x, aPK, by, jH, Y, bm, azy, jd, fP, qO, aOM, eG, aOL); #c1(CLDN23) c2(NP_919260) c3(2248) c4(28362, 41419, 54476, 15305, 67533) c5(na, by, bb, bu); #c1(CLDN2) c2(NP_001164566) c3(2249) c4(28363, 41420, 54477, 15306, 67534) c5(bn, aw, b, ka, ki, au, xa, U, hP, e, y, d, IE, bu, az, ar, cs, fy, u, jB, V, ad, W, T, pi, jU, jH, fP); #c1(CLDN5) c2(NP_001124333) c3(2250) c4(28364, 41421, 54478, 15307, 67535) c5(aEq, d, ao, aFY, bb, dN, X, er, J, UV, P, ag, zm, T, afb, bq, ar, av, u, e, y); #c1(CLDN6) c2(NP_067018) c3(2251) c4(28365, 41422, 54479, 15308, 67536) c5(OG, co, QN, b, bm, f, q, jR, ar, ji, fy, u, y); #c1(CLDN7) c2(NP_001171952) c3(2252) c4(28366, 41423, 54480, 15309, 67537) c5(by, A, aw, b, X, dB, gE, bw, U, Uq, vn, e, y, jb, d, gB, co, gC, ag, Bc, rr, B, q, bu, cU, gX, ar, cs, av, fy, u, aEq, fi, qL, V, Be, avo, gv, W, T, x, aPK, ad, jH, jx, nV, Y, bm, azy, jd, qO, jB, bh, aOM, af); #c1(CLDN8) c2(NP_955360) c3(2253) c4(28367, 41424, 54481, 15310, 67538) c5(ag, dB, Ug); #c1(CLDN9) c2(NP_066192) c3(2254) c4(28368, 41425, 54482, 15311, 67539) c5(A); #c1(CLEC10A) c2(NP_006335) c3(2255) c4(28369, 41426, 54483, 15312, 67540) c5(P, ao, jT, aX, b, aC, ak, gm, TA, wy, ig, zm, T, y, ji, at, u, aPL); #c1 (CLEC11A) c2(NP_002966) c3(2256) c4(28370, 41427, 54484, 15313, 67541) c5(jH, wV, pV, b, X, rr, cy, aPN, wP, fP, qB, aPM, av, fM, pq); #c1(CLEC12A) c2(NP_001193939) c3(2257) c4(28371, 41428, 54485, 15314, 67542) c5(b, Ov, aC, h, gR, Ou, jT); #c1(CLEC14A) c2(NP_778230) c3(2258) c4(28372, 41429, 54486, 15315, 67543) c5(I, f, Eo, dU, cO, mQ); #c1(CLEC16A) c2(NP_001230332) c3(2259) c4(28373, 41430, 54487, 15316, 67544) c5(iq, Jo, ig, PI, bf, IS, yV, m, bb, yW, aV, u, aE, ax, rN, I, aC, dH, iz, IE, fP, fD, bq, bT); #c1(CLEC1B) c2(NP_001092901) c3(2260) c4(28374, 41431, 54488, 15317, 67545) c5(eN, td, b, I, aC, di, at, aE); #c1(CLEC2A) c2(NP_001124183) c3(2261) c4(28375, 41432, 54489, 15318, 67546) c5(be); #c1(CLEC2B) c2(NP_005118) c3(2262) c4(28376, 41433, 54490, 15319, 67547) c5(bm); #c1(CLEC2D) c2(NP_001004419) c3(2263) c4(28377, 41434, 54491, 15320, 67548) c5(b, aDO, dQ, yU, aE, O, iz); #c1(CLEC2L) c2(NP_001073980) c3(2264) c4(28378, 41435, 54492, 15321, 67549) c5(I); #c1(CLEC3B) c2(NP_003269) c3(2265) c4(28379, 41436, 54493, 15322, 67550) c5(V, re, ad, ar, cs, U, aPO); #c1(CLEC4A) c2(NP_057268) c3(2266) c4(28380, 41437, 54494, 15323, 67551) c5(aC, P, Ku); #c1(CLEC4C) c2(NP_569708) c3(2267) c4(28381, 41438, 54495, 15324, 67552) c5(m); #c1(CLEC4D) c2(NP_525126) c3(2268) c4(28382, 41439, 54496, 15325, 67553) c5(P, if, adJ, G, b, t, h, aAd, zh, gm, J, cT, aHz, aZ, jI, jG, jT, Zn, jU, zD); #c1(CLEC4E) c2(NP_055173) c3(2269) c4(28383, 41440, 54497, 15326, 67554) c5(aA, aZ); #c1(CLEC4G) c2(NP_001231785) c3(2270) c4(28384, 41441, 54498, 15327, 67555) c5(sQ); #c1(CLEC4M) c2(NP_001138376) c3(2271) c4(28385, 41442, 54499, 15328, 67556) c5(sQ, pT, hv, gL, P, gE, at); #c1(CLEC5A) c2(NP_037384) c3(2272) c4(28386, 41443, 54500, 15329, 67557) c5(be, qd, aC, AX, aDx, UE, Io); #c1(CLEC6A) c2(NP_001007034) c3(2273) c4(28387, 41444, 54501, 15330, 67558) c5(aC, sE); #c1(CLEC7A) c2(NP_072092) c3(2274) c4(28388, 41445, 54502, 15331, 67559) c5(da, Io, am, sE, m, aAc, fq, fP, av, aAf, aBs, aPQ, aC, Dp, Zr, P, aGU, jU, jH, mb, aAd, aPP); #c1(CLEC9A) c2(NP_997228) c3(2275) c4(28389, 41446, 54503, 15332, 67560) c5(eW); #c1(CLECL1) c2(NP_001240679) c3(2276) c4(28390, 41447, 54504, 15333, 67561) c5(aV); #c1(CLGN) c2(NP_004353) c3(2277) c4(28391, 41448, 54505, 15334, 67562) c5(nJ); #c1(CLIC1) c2(NP_001279) c3(2278) c4(28392, 41449, 54506, 15335, 67563) c5(jh, b, jH, P, bu, m, x, jc, Yr, by, u, aE, O, JY); #c1(CLIC3) c2(NP_004660) c3(2279) c4(28393, 41450, 54507, 15336, 67564) c5(eQ, fx, i); #c1(CLIC5) c2(NP_001107558) c3(2280) c4(28394, 41451, 54508, 15337, 67565) c5(vW); #c1(CLIC6) c2(NP_444507) c3(2281) c4(28395, 41452, 54509, 15338, 67566) c5(aPR); #c1(CLINT1) c2(NP_001182484) c3(2282) c4(28396, 41453, 54510, 15339, 67567) c5(hW, he, cp); #c1(CLIP1) c2(NP_001234926) c3(2283) c4(28397, 41454, 54511, 15340, 67568) c5(ao, I, X, fH, aE, cz, aIM, iL, gE, bf, ey, u, fJ, aM); #c1(CLIP2) c2(NP_003379) c3(2284) c4(28398, 41455, 54512, 15341, 67569) c5(ao, I, cz, aIM, iL, gE, bf, ey, Pk, aE, aM); #c1(CLK1) c2(NP_001155879) c3(2285) c4(28399, 41456, 54513, 15342, 67570) c5(en, v, asx); #c1(CLK2) c2(NP_001281267) c3(2286) c4(28400, 41457, 54514, 15343, 67571) c5(jh, by, nU, bu); #c1(CLLU1) c2(NP_001020404) c3(2287) c4(28401, 41458, 54515, 15344, 67572) c5(cT, A); #c1(CLMN) c2(NP_079010) c3(2288) c4(28402, 41459, 54516, 15345, 67573) c5(at, cV); #c1(CLMP) c2(NP_079045) c3(2289) c4(28403, 41460, 54517, 15346, 67574) c5(cT, at, aPS, ak); #c1(CLN3) c2(NP_000077) c3(2290) c4(28404, 41461, 54518, 15347, 67575) c5(b, aPW, LF, ea, w, aPU, y, aPV, aPT, mI, f, bu, cs, u, nj, nQ, cV, bK, nW, LG, v, T, x, ad, hT, SK, sp, ajg); #c1(CLN5) c2(NP_006484) c3(2291) c4(28405, 41462, 54519, 15348, 67576) c5(apU, aPZ, b, fy, aPX, bK, hT, LG, v, hS, sp, T, aPe, aQa, nU, aPY, u, y); #c1(CLN6) c2(NP_060352) c3(2292) c4(28406, 41463, 54520, 15349, 67577) c5(aPX, f, aQb, LG, v, sp, zk, aQa, zp); #c1(CLN8) c2(NP_061764) c3(2293) c4(28407, 41464, 54521, 15350, 67578) c5(aQc, aPZ, nU, Id, hS, sp, wz); #c1(CLNK) c2(NP_443196) c3(2294) c4(28408, 41465, 54522, 15351, 67579) c5(bh, ao, qB, Fg, gv); #c1(CLNS1A) c2(NP_001284) c3(2295) c4(28409, 41466, 54523, 15352, 67580) c5(aX); #c1(CLOCK) c2(NP_004889) c3(2296) c4(28410, 41467, 54524, 15353, 67581) c5(dx, B, aw, Gt, aQf, dB, ns, w, nt, nq, nr, nn, bf, no, np, OH, e, O, dv, cy, b, dI, aQd, aQj, agQ, aC, du, jT, fN, DO, cT, aQe, dc, aA, aqL, cA, U, NL, cM, ak, cs, aQg, tQ, em, V, nu, eX, aY, jP, ap, am, jJ, ga, ic, gZ, d, aQi, nm, NJ, vu, ff, jG, u, o, iI, cz, Nh, oi, aaN, tW, hT, mA, ih, A, di, gE, Jz, aX, I, aQk, wr, F, tF, y, dj, hW, cV, Fs, jo, aM, aQh, fP, eG, oT); #c1(CLP1) c2(NP_001136069) c3(2297) c4(28411, 41468, 54525, 15354, 67582) c5(AA, oD, QZ, kq, Au); #c1(CLPP) c2(NP_006003) c3(2298) c4(28412, 41469, 54526, 15355, 67583) c5(aQI, f, aQm, aQn, Bx); #c1(CLPS) c2(NP_001239527) c3(2299) c4(28413, 41470, 54527, 15356, 67584) c5(I, ch, f, bf, aA, aM); #c1(CLPTM1) c2(NP_001269104) c3(2300) c4(28414, 41471, 54528, 15357, 67585) c5(A, aX, b, Nq, Ns, co, fy, apU); #c1 (CLPTM1L) c2(NP_110409) c3(2301) c4(28415, 41472, 54529, 15358, 67586) c5(ck, b, ag, X, wy, A, ic, bw, bf, U, e, y, d, jh, co, aX, ip, kJ, re, F, ar, O, cs, av, fy, u, o, V, aeM, bp, ad, ji, ie, tI, amS, iT, i, Lr, Oi, yA, at); #c1(CLRN1) c2(NP_001182723) c3(2302) c4(28416, 41473, 54530, 15359, 67587) c5(aQg, nQ, nW, aQp, aQe, na, ow, nE); #c1(CLSPN) c2(XP_011540241) c3(2303) c4(28417, 41474, 54531, 15360, 67588) c5(ak, b, re, f, T, iT, av, u, y, cq); #c1(CLSTN1) c2(NP_001289812) c3(2304) c4(28418, 41475, 54532, 15361, 67589) c5(A, V, b, cV, B, q, fO, Ot, w, U, pp, zr); #c1(CLSTN2) c2(NP_071414) c3(2305) c4(28419, 41476, 54533, 15362, 67590) c5(fP, bm, oN, Gm); #c1(CLTA) c2(NP_001070145) c3(2306) c4(28420, 41477, 54534, 15363, 67591) c5(m, sG, nW, aC, oi, Nx, T, jT); #c1(CLTC) c2(NP_004850) c3(2307) c4(28421, 41478, 54535, 15364, 67592) c5(P, A, b, Ic, B, dB, q, dY, gm, ag, jo, w, K, afb, O, aI, jT, u, y, cI); #c1(CLTCL1) c2(NP_001826) c3(2308) c4(28422, 41479, 54536, 15365, 67593) c5(jd, cI); #c1(CLUAP1) c2(NP_055856) c3(2309) c4(28423, 41480, 54537, 15366, 67594) c5(b, fr, bp, ad, cs, x); #c1(CLU) c2(NP_001822) c3(2310) c4(28424, 41481, 54538, 15367, 67595) c5(dx, aNi, f, aw, dD, dB, aN, eC, w, cO, bf, aK, e, O, gO, cU, dv, aca, gB, dI, kz, gP, fH, Hs, Qx, g, aC, bK, nW, du, bp, ft, ME, x, fx, jT, pb, Ip, ag, i, qD, sU, gk, cY, eu, hS, kY, IW, U, y, aQr, co, aoR, ak, bu, B, cs, av, fy, bm, iT, V, ae, Ue, v, gv, VP, iA, fJ, aH, dO, er, PY, nJ, fK, zS, wX, re, ap, ck, b, zH, m, ic, z, Ne, d, jh, IY, Be, bX, CR, q, X, ar, aJ, wj, u, dh, o, sr, fs, hb, I, Mi, ad, jr, iO, ct, et, Jd, jH, ch, DR, eo, fh, oC, A, k, fr, Lv, EN, di, JC, bj, vI, aW, RX, aX, amK, avV, F, qr, Ir, tF, sH, LK, ez, nQ, cV, bd, W, bR, T, ji, aFt, jI, by, aM, at, pp, aax, HM, bh, aT, aG, MU); #c1(CLUL1) c2(NP_001275965) c3(2311) c4(28425, 41482, 54539, 15368, 67596) c5(u); #c1(CLVS1) c2(NP_775790) c3(2312) c4(28426, 41483, 54540, 15369, 67597) c5(q, o); #c1(CLYBL) c2(NP_996531) c3(2313) c4(28427, 41484, 54541, 15370, 67598) c5(P, co, fR, qK); #c1(CMA1) c2(NP_001827) c3(2314) c4(28428, 41485, 54542, 15371, 67599) c5(dx, fh, fr, id, b, sO, hY, aQt, cr, sJ, w, di, IW, wf, O, A, y, co, bb, Ec, fq, cK, f, aiJ, bu, Cu, B, bv, gg, u, aQs, vR, fs, I, cV, by, du, gm, fO, ft, aD, vc, T, bq, cy, gF, hR, et, qe, sK, jT, aoC, fM, ch, er, sN, vH, fP, cf, mD, at); #c1(CMAS) c2(NP_061156) c3(2315) c4(28429, 41486, 54543, 15372, 67600) c5(b, pp, im, fN, pR, anG, w, U, dL, fM); #c1(CMC1) c2(NP_872329) c3(2316) c4(28430, 41487, 54544, 15373, 67601) c5(aQu, dA, aFF, Dw, Dz, CA); #c1(CMC2) c2(NP_064573) c3(2317) c4(28431, 41488, 54545, 15374, 67602) c5(u, ae); #c1 (CMC4) c2(NP_001018024) c3(2318) c4(28432, 41489, 54546, 15375, 67603) c5(atn, if, KA, qz, J, gm, Iv, bU, cg); #c1(CMIP) c2(NP_085132) c3(2319) c4(28433, 41490, 54547, 15376, 67604) c5(aX, yQ, I, KG, bd, Wh, bq, ahk); #c1(CMKLR1) c2(NP_001135815) c3(2320) c4(28434, 41491, 54548, 15377, 67605) c5(aQv, ca, aC, fN, dZ, dV, bq, aA, fy, VJ); #c1(CMPK2) c2(NP_001243406) c3(2321) c4(28435, 41492, 54549, 15378, 67606) c5(MW, hV, G, b, am, aei, t, re, f, ie, J, dt, ag, P, iT, z, O, u, jG, y); #c1(CMSS1) c2(NP_001161396) c3(2322) c4(28436, 41493, 54550, 15379, 67607) c5(Fg); #c1(CMTM3) c2(NP_853531) c3(2323) c4(28437, 41494, 54551, 15380, 67608) c5(Lv, by, ck, T, bu); #c1(CMTM5) c2(NP_001032365) c3(2324) c4(28438, 41495, 54552, 15381, 67609) c5(M, T, J, b); #c1(CMTM7) c2(NP_612419) c3(2325) c4(28439, 41496, 54553, 15382, 67610) c5(T, iT, cO); #c1(CMTM8) c2(NP_849199) c3(2326) c4(28440, 41497, 54554, 15383, 67611) c5(qf, ak, bb, dA); #c1(CMTR1) c2(NP_055865) c3(2327) c4(28441, 41498, 54555, 15384, 67612) c5(ar, u, cI, y, bq); #c1(CMTR2) c2(NP_060818) c3(2328) c4(28442, 41499, 54556, 15385, 67613) c5(kF, aX, rb); #c1(CMYA5) c2(NP_705838) c3(2329) c4(28443, 41500, 54557, 15386, 67614) c5(azR, oy, kG, dA, di, o); #c1(CNBD1) c2(NP_775809) c3(2330) c4(28444, 41501, 54558, 15387, 67615) c5(1); #c1(CNBP) c2(NP_001120664) c3(2331) c4(28445, 41502, 54559, 15388, 67616) c5(dx, eX, b, sO, eH, di, ey, xI, aao, f, q, VI, aaZ, mg, jG, u, aPs, em, I, el, du, gm, ad, axI, dv, Hh, gF, dL, Ha, re, aPt, bm, xP, fN, aA, at, on); #c1(CNDP1) c2(NP_116038) c3(2332) c4(28446, 41503, 54560, 15389, 67617) c5(bP, an, nU, I, b, aQw, gJ, fD, bh, bf, ey, at, et, aE); #c1(CNDP2) c2(NP_001161971) c3(2333) c4(28447, 41504, 54561, 15390, 67618) c5(dj, b, I, Dv, h, q, J, by, ag, rR, fD, jy, bf, bu, et, aE, aM); #c1(CNGA1) c2(NP_001136036) c3(2334) c4(28448, 41505, 54562, 15391, 67619) c5(aQx, mI, nW); #c1(CNGA3) c2(NP_001073347) c3(2335) c4(28449, 41506, 54563, 15392, 67620) c5(nQ, mI, KU, aQB, mU, aQz, aQy, aQA, aCr, nR); #c1(CNGB1) c2(NP_001129111) c3(2336) c4(28450, 41507, 54564, 15393, 67621) c5(aQD, aDX, cy, mI, aQC, aDY, ow, ss, nE, aIE, nW); #c1(CNGB3) c2(NP_061971) c3(2337) c4(28451, 41508, 54565, 15394, 67622) c5(nQ, aQE, aQB, mU, nv, aQy, cO, mI, aW); #c1(CNIH3) c2(NP_689708) c3(2338) c4(28452, 41509, 54566, 15395, 67623) c5(cy, eG); #c1(CNKSR1) c2(NP_001284576) c3(2339) c4(28453, 41510, 54567, 15396, 67624) c5(b, aQE, SK, re, nU, hS, BY, X, hM, iT, T, av, u, y); #c1(CNKSR2) c2(NP_001162118) c3(2340) c4(28454, 41511, 54568, 15397, 67625) c5(bK, aA, aW); #c1(CNKSR3) c2(NP_775786) c3(2341) c4(28455, 41512, 54569, 15398, 67626) c5(oy, aX, aCU, bj, ak, jz, q, jC, cy, jQ, Nu, te); #c1(CNN1) c2(NP_001290) c3(2342) c4(28456, 41513, 54570, 15399, 67627) c5(fr, f, q, ft, mR, cO, x, vp); #c1(CNN2) c2(NP_004359) c3(2343) c4(28457, 41514, 54571, 15400, 67628) c5(BO, A, B, dB); #c1(CNNM1) c2(NP_065081) c3(2344) c4(28458, 41515, 54572, 15401, 67629) c5(oD, bb, aX, Au); #c1(CNNM2) c2(NP_060119) c3(2345) c4(28459, 41516, 54573, 15402, 67630) c5(dt, A, ahj, KA, nU, aQG, WW, di, B, bj); #c1(CNNM4) c2(NP_064569) c3(2346) c4(28460, 41517, 54574, 15403, 67631) c5(RO, pk, aQI, nW, aQH, RN, Ur); #c1(CNOT1) c2(NP_001252541) c3(2347) c4(28461, 41518, 54575, 15404, 67632) c5(b, fO, P, w, Fg, iL, O, aIM); #c1(CNOT2) c2(NP_055330) c3(2348) c4(28462, 41519, 54576, 15405, 67633) c5(ad, ach, at, cs, cO); #c1(CNOT3) c2(NP_055331) c3(2349) c4(28463, 41520, 54577, 15406, 67634) c5(nI, nQ, nW, f, W, cO, av, fy, ca); #c1(CNOT4) c2(NP_001008226) c3(2350) c4(28464, 41521, 54578, 15407, 67635) c5(co); #c1(CNOT6) c2(NP_001290170) c3(2351) c4(28465, 41522, 54579, 15408, 67636) c5(JH, jz, DT, NH, Iv, aEE, aEF, cp, m, aX, fq, yh, jQ, mR, as, fH, CX, aEG, aE, da, ax, aC, bK, wE, P, cy, fJ, dH, aV, hU, dP, NG, sN, fG, pH); #c1(CNOT6L) c2(NP_653172) c3(2352) c4(28466, 41523, 54580, 15409, 67637) c5(cy); #c1(CNOT7) c2(NP_037486) c3(2353) c4(28467, 41524, 54581, 15410, 67638) c5(aq, U, u, V); #c1(CNOT8) c2(NP_001288003) c3(2354) c4(28468, 41525, 54582, 15411, 67639) c5(u, II); #c1(CNP) c2(NP_149124) c3(2355) c4(28469, 41526, 54583, 15412, 67640) c5(dx, mZ, sO, aNU, rU, vY, w, ds, cO, cM, dv, cy, k, q, aV, bm, o, GS, hW, du, Fs, bd, iD, aQJ, su, HL, aY, dc, di); #c1(CNPY2) c2(NP_055070) c3(2356) c4(28470, 41527, 54584, 15413, 67641) c5(bu); #c1(CNPY3) c2(NP_006577) c3(2357) c4(28471, 41528, 54585, 15414, 67642) c5(kV, v); #c1(CNR1) c2(NP_001153731) c3(2358) c4(28472, 41529, 54586, 15415, 67643) c5(dx, gK, f, Gt, eH, dd, bf, VG, O, aQK, dv, kJ, zb, fH, IV, uL, si, mz, aqQ, aC, du, gY, IL, GI, hR, fy, Ey, aei, fN, aQM, dc, bq, aA, vD, rd, cA, If, U, xw, cM, rr, ak, B, bv, cp, em, V, Bs, v, eX, fJ, aY, ji, jP, ap, ach, bn, b, GL, jJ, dk, qa, ic, z, gZ, bb, Ox, g, fv, Gj, aM, u, cI, I, qA, hv, cz, aaB, aQN, jH, DY, ch, he, ih, HV, Ib, A, k, gE, di, HS, bw, wf, aI, bj, Wj, aX, sG, iI, aqE, oE, iZ, y, fP, aV, jZ, RB, ma, hW, cV, sj, gF, vv, Sp, to, jT, aQL, xM, wq, XH, jN, bh, at, eG); #c1(CNR2) c2(XP_011538931) c3(2359) c4(28473, 41530, 54587, 15416, 67644) c5(dx, f, gE, z, Em, A, yU, ic, cO, bw, aI, y, cp, dv, kn, h, ak, g, vQ, oE, bn, ky, cM, fv, IV, aV, u, dh, o, be, si, I, afx, aC, Bs, du, v, j, J, GI, cV, bq, MO, jU, ao, nV, aY, Ic, hn, fc, zT, fP, jN, dc, bh, bT, ap); #c1(CNRIP1) c2(NP_001104571) c3(2360) c4(28474, 41531, 54588, 15417, 67645) c5(cy, b, fr, ft, W, at, u, y); #c1(CNST) c2(NP_001132931) c3(2361) c4(28475, 41532, 54589, 15418, 67646) c5(ig); #c1(CNTF) c2(NP_000605) c3(2362) c4(28476, 41533, 54590, 15419, 67647) c5(cG, ea, w, ds, dV, O, bf, ey, gZ, cM, yE, mI, k, q, Vr, dZ, ky, aW, fH, OA, aV, bm, si, aqQ, nQ, cV, nW, fI, v, cx, W, Jj, J, fJ, ac, aM, ao, Y, aY, tW, er, PY, fc, aaI, dc, aA, HS); #c1(CNTFR) c2(NP_001193940) c3(2363) c4(28477, 41534, 54591, 15420, 67648) c5(ao, aqQ, cx, o, iB, aQO, O); #c1(CNTLN) c2(NP_001107867) c3(2364) c4(28478, 41535, 54592, 15421, 67649) c5(g, nX, r, bb, b, X, fq, F, N, g, cy, Nx, QZ, bf, av, hR, u, y, aM); #c1(CNTN1) c2(NP_001242993) c3(2365) c4(28479, 41536, 54593, 15422, 67650) c5(d, At, co, iI, e, aQP, ik, ar, oD, ji, bq, O); #c1(CNTN2) c2(NP_005067) c3(2366) c4(28480, 41537, 54594, 15423, 67651) c5(b, k, X, EM, jz, gn, anB, hS, w, Iv, aJE, gm, apW, AD, aX, zm, O, av, jQ, pw, rN, ajc, aC, be, Fs, J, eu, P, QZ, bb, nb, rS, PB, aQQ, Nu); #c1(CNTN3) c2(NP_065923) c3(2367) c4(28481, 41538, 54595, 15424, 67652) c5(aoa, A, B, J, fO, cz, mO, gj, cK, at, u, y); #c1(CNTN4) c2(NP_001193884) c3(2368) c4(28482, 41539, 54596, 15425, 67653) c5(oy, is, ao, ak, ez, dA, AP, nU, cz, Vr, xr, rQ, kV); #c1(CNTN5) c2(NP_001230199) c3(2369) c4(28483, 41540, 54597, 15426, 67654) c5(fI, nU, hW, sX, hT, AA, dU, vY, rQ, KB, cO, bb, auz, bq, o); #c1(CNTN6) c2(NP_001276010) c3(2370) c4(28484, 41541, 54598, 15427, 67655) c5(nU, hW, ak, AA, dU, A, KB, bq, rb); #c1(CNTNAP1) c2(NP_003623) c3(2371) c4(28485, 41542, 54599, 15428, 67656) c5(b, oX, oR, jy, oZ, pz, eV, O, t, h, n, iv, jG, u, ae, Fs, J, cz, G, jT, pc, oQ, oW, ie, pa, ag, oY, ci, pv); #c1(CNTNAP2) c2(NP_054860) c3(2372) c4(28486, 41543, 54600, 15429, 67657) c5(OG, ak, bf, b, eO, aQR, hS, qa, di, iL, cO, cA, hW, Wh, O, cp, bb, yQ, t, aQV, nU, bh, zb, hZ, qu, o, JB, aQS, ahk, KH, dA, bK, nu, gv, aQU, IL, ahm, FW, aQX, KE, fU, wj, rQ, aQT, hT, xo, cz, Wk, aQW); #c1(CNTNAP3) c2(NP_387504) c3(2373) c4(28487, 41544, 54601, 15430, 67658) c5(b); #c1(CNT-NAP4) c2(NP_207837) c3(2374) c4(28488, 41545, 54602, 15431, 67659) c5(hW, at, u, ez, bf); #c1(CNTNAP5) c2(NP_570129) c3(2375) c4(28489, 41546, 54603, 15432, 67660) c5(oy, ak, aX, yQ, dA, hT, cz, bb, aw); #c1(CNTRL) c2(XP_005251736) c3(2376) c4(28490, 41547, 54604, 15433, 67661) c5(aX, b, aC, N, fg, u, O); #c1(CNTROB) c2(NP_001032221) c3(2377) c4(28491, 41548, 54605, 15434, 67662) c5(kF, u, aiL, y); #c1(COA1) c2(NP_060694) c3(2378) c4(28492, 41549, 54606, 15435, 67663) c5(BU, avY); #c1(COA5) c2(NP_001008216) c3(2379) c4(28493, 41550, 54607, 15436, 67664) c5(acU, cK, ay, sK); #c1(COASY) c2(NP_001035997) c3(2380) c4(28494, 41551, 54608, 15437, 67665) c5(aQY, adt, jC, xw, aQZ, h, f, bm, iT, Bd, cV, adh, Fb, axi, EZ, u, nc, avP, zM, adi, bk, i, re, adq); #c1(COBL) c2(NP_001274367) c3(2381) c4(28495, 41552, 54609, 15438, 67666) c5(cV, tv, di, o, cO, Fg, aE, ac); #c1(COBLL1) c2(NP_001265387) c3(2382) c4(28496, 41553, 54610, 15439, 67667) c5(aA, at, bb); #c1(COCH) c2(XP_011534841) c3(2383) c4(28497, 41554, 54611, 15440, 67668) c5(er, Fx, aRh, an, aRd, qC, f, aRc, v, aRa, aKH, na, aRe, aRb, Bx, as, aRf, aRg); #c1(COG1) c2(NP_061184) c3(2384) c4(28498, 41555, 54612, 15441, 67669) c5(aRk, pD, aRj, aRi, Td, o); #c1(COG2) c2(NP_001138508) c3(2385) c4(28499, 41556, 54613, 15442, 67670) c5(fh, bb, dD, aah, bq, at, o, ap); #c1(COG3) c2(NP_113619) c3(2386) c4(28500, 41557, 54614, 15443, 67671) c5(atW); #c1(COG4) c2(NP_001182068) c3(2387) c4(28501, 41558, 54615, 15444, 67672) c5(aRI, Td, nW, Pa); #c1(COG5) c2(NP_006339) c3(2388) c4(28502, 41559, 54616, 15445, 67673) c5(aRm, SY); #c1(COG6) c2(NP_001138551) c3(2389) c4(28503, 41560, 54617, 15446, 67674) c5(oy, anC, JH, aRn, aRo, Pa, LE, Ij, da, eq, Xx, jH); #c1(COG7) c2(NP_705831) c3(2390) c4(28504, 41561, 54618, 15447, 67675) c5(QZ, KG, LE, aRp); #c1(COG8) c2(NP_115758) c3(2391) c4(28505, 41562, 54619, 15448, 67676) c5(Td, aRq, SY); #c1(COIL) c2(NP_004636) c3(2392) c4(28506, 41563, 54620, 15449, 67677) c5(fr, jT, an, J, ft, X, kz, od, as, XR, av, aRr); #c1(COL10A1) c2(XP_011533735) c3(2393) c4(28507, 41564, 54621, 15450, 67678) c5(rM, aRs, ID, aRt, rU, dU, It, adp, aRv, aRu, u, aW, rC); #c1(COL11A1) c2(XP_011539021) c3(2394) c4(28508, 41565, 54622, 15451, 67679) c5(mI, aw, b, X, F, aiu, aRA, U, rF, e, d, BO, aRB, aRw, md, EA, ar, av, fy, V, W, aRx, Cf, ct, AP, aRy, rM, sr, ID, aRz, er, Nq, ag, Ns, rC); #c1(COL11A2) c2(NP_001157243) c3(2395) c4(28509, 41566, 54623, 15452, 67680) c5(hV, iG, b, ag, X, dB, asZ, w, dV, kY, cO, bf, U, rF, A, y, m, aRF, atj, aRC, h, f, q, fr, dZ, B, afp, aRv, av, fy, u, fI, o, WZ, nV, V, Ea, aC, nI, cs, Ns, fO, ad, P, co, T, agm, cV, pt, Cf, ft, AP, aRH, aM, rM, jT, aRE, aRD, ID, bm, kJ, Nq, vT, aE, na, cT, Oi, Bx, oM, aRG, rC); #c1(COL12A1) c2(NP_004361) c3(2396) c4(28510, 41567, 54624, 15453, 67681) c5(aw, rE, b, u, nI, Ex, aRJ, fI, oD, U, aRI, y, V); #c1(COL13A1) c2(NP_001123575) c3(2397) c4(28511, 41568, 54625, 15454, 67682) c5(fN, BU, bb); #c1(COL14A1) c2(XP_005251116) c3(2398) c4(28512, 41569, 54626, 15455, 67683) c5(Ew, cu, rE, dB, ar, at); #c1(COL15A1) c2(XP_011516516) c3(2399) c4(28513, 41570, 54627, 15456, 67684) c5(dx, dv, ez, du, dB, j, dZ, dV, fH, fJ, aRK, cp); #c1(COL16A1) c2(XP_011539026) c3(2400) c4(28514, 41571, 54628, 15457, 67685) c5(w); #c1(COL17A1) c2(NP_000485) c3(2401) c4(28515, 41572, 54629, 15458, 67686) c5(Ir, aRM, b, oH, mk, aRP, vI, adr, e, d, bs, XZ, aRL, arW, JI, aRO, aRR, ar, OA, QJ, Yb, arR, aRT, J, aRS, aRN, st, aHc, aum, kM, Ya, tI, aCI, aRQ); #c1(COL18A1) c2(NP_085059) c3(2402) c4(28516, 41573, 54630, 15459, 67687) c5(B, aw, dB, eW, w, e, O, t, DB, arS, oP, g, aC, bK, bp, ft, x, fx, jT, mm, Iq, jE, BX, ag, cT, i, aA, wa, X, EB, hS, yD, GV, bw, U, y, co, pp, DH, bu, k, cs, av, fy, bm, is, V, Xr, ny, Fr, JY, jR, qO, zS, b, d, Er, eA, nU, q, ra, ar, RF, hb, xd, u, aRU, ff, Id, VM, I, Dg, LR, ad, G, ct, jH, nV, Eu, B, u, o, fI, I, wR, A, vd, fr, BY, aW, h, F, gT, aq, ez, cV, J, W, dU, jo, T, fO, by, ip, vt, Af, bh, at, eG); #c1(COL1A1) c2(NP_000079) c3(2403) c4(28517, 41574, 54631, 15460, 67688) c5(gK, aw, aav, sJ, Jb, rF, aSf, cp, cy, b, FP, gB, aRX, Yj, sH, wo, fO, ft, vc, mm, rE, pP, Rw, aRW, tO, aSe, bq, aA, bT, mk, aRZ, vI, y, aSi, aSg, sT, gg, bm, rN, aSc, bd, Ih, Jc, jC, xe, aSb, aDX, am, aGv, aSa, yU, ic, tG, Iy, q, ff, aRY, u, o, fs, ob, LR, gL, IG, aSd, azr, Bu, Ck, cC, aRV, I, rC, iL, vd, fr, zF, Jn, rU, di, vg, sx, aSh, aso, rG, Ex, oJ, Jk, jZ, J, jo, T, j, tT, asX, pK, arq, Jh, zM, fo, pZ, bh, at); #c1(COL1A2) c2(NP_000080) c3(2404) c4(28518, 41575, 54632, 15461, 67689) c5(gK, vg, b, vd, zF, En, mk, vY, yU, sF, tG, Jb, aSf, cp, d, bb, FP, q, e, bh, Ex, fx, Jk, gg, awi, u, cc, aki, i, sH, wo, aSI, j, aSj, dt, vc, cd, Jh, amR, FW, ary, sK, arD, aSd, fD, azr, Rw, aRW, pC, jR, tO, aSm, aSk, bk, tI, I, hM, ap, aAr, aPO, rC); #c1(COL20A1) c2(NP_065933) c3(2405) c4(28519, 41576, 54633, 15462, 67690) c5(u, y); #c1(COL21A1) c2(NP_110447) c3(2406) c4(28520, 41577, 54634, 15463, 67691) c5(bb, ak, dd, fI, A); #c1(COL22A1) c2(NP_690848) c3(2407) c4(28521, 41578, 54635, 15464, 67692) c5(o, fU, bb, aSn, Eo, Fg, bj, xI, ap); #c1(COL23A1) c2(NP_775736) c3(2408) c4(28522, 41579, 54636, 15465, 67693) c5(bb, et); #c1(COL24A1) c2(XP_011539493) c3(2409) c4(28523, 41580, 54637, 15466, 67694) c5(cp); #c1(COL25A1) c2(NP_001243003) c3(2410) c4(28524, 41581, 54638, 15467, 67695) c5(bm, vv, aq, q, aN, ih, Gj, aK, o); #c1(COL26A1) c2(NP_001265492) c3(2411) c4(28525, 41582, 54639, 15468, 67696) c5(bq, cy); #c1(COL27A1) c2(NP_116277) c3(2412) c4(28526, 41583, 54640, 15469, 67697) c5(rF, rL); #c1(COL28A1) c2(XP_011513662) c3(2413) c4(28527, 41584, 54641, 15470, 67698) c5(xq, ak); #c1(COL2A1) c2(NP_001835) c3(2414) c4(28528, 41585, 54642, 15471, 67699) c5(aw, aSG, II, x, hM, aSf, aSD, aSy, aFP, wo, aSt, aRx, Cf, Dz, rJ, ry, wz, aSF, fI, TH, sm, aSB, kB, adp, rH, V, cs, WF, fY, fi, aSA, rN, aSz, aIU, aSE, Ix, aSs, Cy, Im, aSq, apH, aDX, b, zH, aSx, aSr, aGX, aRF, Im, ajY, aRv, aSG, aSw, gL, ad, vS, wq, rB, jU, rU, Bu, na, Ns, rC, aSo, aSv, gw, EE, aRA, aDc, IQ, aSu, bj, U, aX, aC, Ex, bc, aSp, be, Dw, gV, aDY, Is, AP, rM, ID, Nq, gI); #c1(COL3A1) c2(NP_000081) c3(2415) c4(28529, 41586, 54643, 15472, 67700) c5(gK, eX, aw, vg, aSK, bL, zF, dD, aSI, mk, sJ, di, Iu, tG, z, Jb, bW, ey, Ct, bb, Iz, FP, cK, f, aSJ, AK, sM, Ex, oJ, Jf, aSO, jZ, o, sF, Ke, LR, aSL, fD, FR, sH, wo, gL, dt, Ih, vc, My, cd, aSN, bq, rO, gF, uf, AL, aSH, fN, sW, bV, tO, sT, aSM, IP, fz, dn, bh, at, rC); #c1(COL4A1) c2(NP_001290039) c3(2416) c4(28530, 41587, 54644, 15473, 67701) c5(EO, bL, A, aST, dD, Iv, w, di, sY, dx, O, vI, bj, y, aSR, aX, b, aSQ, wd, f, It, Ii, B, aLV, mg, u, sF, du, hW, sH, IF, acv, bd, EQ, aSP, oD, aSS, bb, et, rQ, ail, aJy, vT, tO, bq, aU, at, aG); #c1(COL4A2) c2(NP_001837) c3(2417) c4(28531, 41588, 54645, 15474, 67702) c5(A, aw, b, fI, sY, vp, y, aSR, co, aX, f, It, aLV, oD, u, fU, hW, dA, sH, IF, bd, T, bb, et, tO, ag, aSU, vx, at, ap); #c1(COL4A3BP) c2(NP_001123577) c3(2418) c4(28532, 41589, 54646, 15475, 67703) c5(m, hU, b, X, aK, MU, mW, aN, o, aX, av, fy, u, gI, y); #c1(COL4A3) c2(NP_000082) c3(2419) c4(28533, 41590, 54647, 15476, 67704) c5(bP, aSV, A, gw, dB, aSX, vp, acQ, e, O, gO, d, tp, ha, aX, aSW, aTa, wd, f, q, cy, Ii, B, aLV, Hs, anZ, aSY, te, aIP, sH, cs, gJ, bd, jo, vx, hU, et, fy, Eu, Qk, tO, aSZ, aTb, fD, I, MU); #c1(COL4A4) c2(XP_005246338) c3(2420) c4(28534, 41591, 54648, 15477, 67705) c5(bP, gw, eC, aSX, ha, gO, aTa, et, acQ, Ii, aLV, aSY, te, aTc, sH, gJ, aSZ, vx, wd, tO, na, aTb, fD); #c1(COL4A5) c2(NP_000486) c3(2421) c4(28535, 41592, 54649, 15478, 67706) c5(bP, fI, vp, b, gw, hS, aRJ, aSX, aTd, acQ, eD, aTh, y, aTf, BL, mI, nU, oJ, cy, aTg, ZB, Ii, aTe, aLV, ar, u, sH, aSY, te, aeX, Ji, fD, nx, nz, LR, bd, dt, co, vx, cI, et, wh, hU, kB, tO, na, agw, rv, aTi, ji, wI); #c1(COL4A6) c2(NP_001274688) c3(2422) c4(28536, 41593, 54650, 15479, 67707) c5(bP, aTj, wh, d, b, sH, cs, aTi, tO, dt, ZB, Ii, oJ, W, Bx, Ji, ar, ad, et, e, aTk); #c1(COL5A1) c2(NP_000084) c3(2423) c4(28537, 41594, 54651, 15480, 67708) c5(tG, II, mk, vg, Jb, ba, aTI, Ag, aTm, jd, anC, Cz, Ex, aTo, pZ, aTn, sH, Ij, gL, dt, vc, T, aDA, pG, tO, rF, Af, rC); #c1(COL5A2) c2(NP_000384) c3(2424) c4(28538, 41595, 54652, 15481, 67709) c5(vg, aaW, mI, V, b, at, aTn, II, sH, eX, gL, tO, mk, vc, Ex, tG, Jb, U, aKv, ap, rC); #c1(COL5A3) c2(NP_056534) c3(2425) c4(28539, 41596, 54653, 15482, 67710) c5(Ex); #c1(COL6A1) c2(NP_001839) c3(2426) c4(28540, 41597, 54654, 15483, 67711) c5(aTp, aBx, cr, k, aq, nI, bp, rn, akI, asZ, o, oD, aA, at, WB, arE, xI); #c1(COL6A2) c2(NP_478054) c3(2427) c4(28541, 41598, 54655, 15484, 67712) c5(gK, o, IO, cr, aq, mA, aTp, aTr, zk, aTg, fq, oD, WB, arE, xI, zp); #c1(COL6A3) c2(NP_004360) c3(2428) c4(28542, 41599, 54656, 15485, 67713) c5(b, IO, aX, VQ, aTt, kJ, aq, aTs, ag, aTp, fg, A, bb, zK, oD, aA, WB, arE, xI); #c1(COL6A5) c2(NP_001265227) c3(2429) c4(28543, 41600, 54657, 15486, 67714) c5(aTp, cy, WB, arE, fq); #c1(COL7A1) c2(NP_000085) c3(2430) c4(28544, 41601, 54658, 15487, 67715) c5(aw, b, aTy, mk, aTF, adr, e, d, jh, aTE, aTx, XZ, aTD, aBd, u, arS, aTB, aTz, aTu, dt, sf, T, jr, asX, aTw, aeq, aTC, Ya, aTv, yA, aTA); #c1(COL8A1) c2(NP_065084) c3(2431) c4(28545, 41602, 54659, 15488, 67716) c5(LK, I, qr, mI, Bu, nv, Fg, aOB, aW, zb); #c1(COL8A2) c2(NP_001281276) c3(2432) c4(28546, 41603, 54660, 15489, 67717) c5(aOB, aSW, aTG, mI, f, q, qr, aoE, LK, ba); #c1(COL9A1) c2(NP_001842) c3(2433) c4(28547, 41604, 54661, 15490, 67718) c5(aDX, eR, IL, jR, Fh, O, aTI, BO, mI, zR, Yj, em, qw, rP, aTH, bK, aDY, P, wq, rM, ID, Bu, Ck, iV, na, aT, rC); #c1(COL9A2) c2(XP_011539020) c3(2434) c4(28548, 41605, 54662, 15491, 67719) c5(P, aiu, eR, qw, IL, jR, Fh, If, O, rG, dI, aTM, afp, aTK, zR, em, aTJ, rP, bK, vc, wq, rM, ID, Ck, iV, cC, aTL, aT, rC); #c1(COL9A3) c2(NP_001844) c3(2435) c4(28549, 41606, 54663, 15492, 67720) c5(aiu, eR, IL, jR, Fh, bf, O, aX, rG, aTM, afp, zR, aE, em, aTN, qw, rP, bK, P, wq, ac, aM, ID, Ck, iV, aTL, aT, bT, rC); #c1(COLCA1) c2(NP_001289574) c3(2436) c4(28550, 41607, 54664, 15493, 67721) c5(U, cs, V, ad); #c1(COLCA2) c2(NP_001258386) c3(2437) c4(28551, 41608, 54665, 15494, 67722) c5(U, cs, V, ad); #c1(COLEC10) c2(NP_006429) c3(2438) c4(28552, 41609, 54666, 15495, 67723) c5(bf, jT, Ov, b, Ou); #c1(COLEC11) c2(NP_001242912) c3(2439) c4(28553, 41610, 54667, 15496, 67724) c5(P, bb, asx, et, aTQ, v, aTO, aTP, AP); #c1(COLEC12) c2(NP_569057) c3(2440) c4(28554, 41611, 54668, 15497, 67725) c5(AA, Au, QZ, oD, IV, kq); #c1(COLGALT2) c2(NP_001290349) c3(2441) c4(28555, 41612, 54669, 15498, 67726) c5(bj); #c1(COLQ) c2(NP_005668) c3(2442) c4(28556, 41613, 54670, 15499, 67727) c5(xQ, xB, xn); #c1(COMMD10) c2(NP_057228) c3(2443) c4(28557, 41614, 54671, 15500, 67728) c5(ao); #c1(COMMD1) c2(NP_689729) c3(2444) c4(28558, 41615, 54672, 15501, 67729) c5(em, b, fd, P, vQ, abb, fP, bk, aTR, fK, bh, aTS, aIC, jU, jH); #c1(COMMD3-BMI1) c2(NP_001190991) c3(2445) c4(28559, 41616, 54673, 15502, 67730) c5(pm, B, aw, gG, w, aoK, e, O, kJ, t, fH, jM, arS, R, g, asQ, cs, gm, fO, ft, fx, jT, cq, jE, Iu, ie, yE, i, GD, X, eu, U, y, co, pp, ag, f, bu, Em, iv, Tk, av, fy, bm, iT, iF, V, fJ, jR, asP, ji, ci, b, asO, ic, Mr, d, jh, re, q, es, n, jG, u, dh, da, iI, qL, ad, G, Nh, Ut, aE, yA, A, k, fr, pD, BY, nT, hP, QV, aX, I, h, F, cU, ik, rR, cB, QJ, fU, cV, J, po, T, by, QN, Ez, vt); #c1(COMMD5) c2(NP_054785) c3(2446) c4(28560, 41617, 54674, 15503, 67731) c5(di, et, dh, I, bu); #c1(COMMD7) c2(NP_001092809) c3(2447) c4(28561, 41618, 54675, 15504, 67732) c5(bq, g); #c1(COMP) c2(NP_000086) c3(2448) c4(28562, 41619, 54676, 15505, 67733) c5(dx, qd, eR, PB, qw, IL, adp, aOt, Fh, jR, O, rP, aHA, dv, DB, pC, cs, Jk, aRv, zR, o, aTT, em, LR, rN, aC, bK, du, j, ad, P, wq, aoT, be, rM, ID, aTU, Jh, Ck, iV, xU, tI, aT, at); #c1(COMT) c2(NP_001128634) c3(2449) c4(28563, 41620, 54677, 15506, 67734) c5(dx, IJ, ak, pV, Gm, Hv, dB, abd, ns, dv, nm, dd, nq, nr, nn, aw, no, np, fx, cp, fI, bQ, hF, zo, qc, rW, aUI, bx, e, dI, do, EA, zb, IV, Wj, oN, oJ, aUk, aUc, aqQ, aOb, HX, bK, sH, du, jE, GK, Ce, aTY, aqt, x, aUo, jv, xx, jO, aOO, Ew, aUf, wh, ro, akn, aqw, aTZ, hn, K, i, dc, nt, aUn, eQ, aUr, azR, aEX, Jy, X, fE, aUe, iP, aQM, hS, GM, bf, cA, If, U, xw, cM, TC, nS, ip, aUg, rr, f, aG, aUi, B, cs, agT, av, fy, bm, tQ, aUh, xM, V, jh, yY, aUj, aUt, nu, v, xF, gv, aTX, aUq, afb, bq, rV, iA, bu, Ib, yQ, aY, nc, HZ, ahj, Ai, qO, iN, aUp, qh, Gn, wX, RB, vf, aUs, tr, b, nX, ami, jN, jJ, Ey, aUm, qa, aA, z, aoi, gZ, abq, zf, aO, d, Ag, wZ, ahi, acn, Qi, nU, PA, q, ap, vu, ar, ff, aUb, Wf, qu, aTW, u, ov, o, aUu, FD, kF, I, qA, Jt, hv, ad, nd, xq, tR, rB, JJ, Lt, aUd, nV, hy, fD, ch, tW, he, ih, aaf, HV, I, xf, rQ, Xm, y, FY, aUa, de, oC, A, tZ, mz, gN, aqV, di, in, vg, gE, Ji, aI, bj, by, ho, jI, hk, jP, sG, aqs, gA, GF, oE, cU, tF, ik, co, qB, PT, aV, aTV, eX, dj, hW, sC, acu, dT, GB, jo, ti, hE, GL, cz, axk, abw, Sp, to, jT, abt, eG, aDd, abX, acg, vW, QI, aop, Oi, at, T, GI); #c1(COPA) c2(NP_001091868) c3(2450) c4(28564, 41621, 54678, 15507, 67735) c5(A, iP, b, I, B, q, kz, ey); #c1(COPB1) c2(NP_057535) c3(2451) c4(28565, 41622, 54679, 15508, 67736) c5(aC); #c1(COPB2) c2(NP_004757) c3(2452) c4(28566, 41623, 54680, 15509, 67737) c5(NZ, aC, f, P, w, Io); #c1(COPE) c2(NP_009194) c3(2453) c4(28567, 41624, 54681, 15510, 67738) c5(A); #c1(COPG2) c2(NP_001276962) c3(2454) c4(28568, 41625, 54682, 15511, 67739) c5(Me); #c1(COPRS) c2(NP_060875) c3(2455) c4(28569, 41626, 54683, 15512, 67740) c5(sp, iD); #c1(COPS2) c2(NP_001137359) c3(2456) c4(28570, 41627, 54684, 15513, 67741) c5(aIX, eG); #c1(COPS3) c2(NP_001186054) c3(2457) c4(28571, 41628, 54685, 15514, 67742) c5(fr, q, ft, bh, aV, gv); #c1(COPS4) c2(NP_001244935) c3(2458) c4(28572, 41629, 54686, 15515, 67743) c5(aq, cV); #c1(COPS5) c2(NP_006828) c3(2459) c4(28573, 41630, 54687, 15516, 67744) c5(Dr, aw, b, X, oH, iL, bw, U, e, y, d, aX, q, vQ, ff, cB, av, u, R, V, nW, gv, jo, T, jT, jG, ag, bh); #c1(COPS6) c2(NP_006824) c3(2460) c4(28574, 41631, 54688, 15517, 67745) c5(P, nV, u, y); #c1(COPS7A) c2(XP_005253752) c3(2461) c4(28575, 41632, 54689, 15518, 67746) c5(bu); #c1(COPS8) c2(NP_006701) c3(2462) c4(28576, 41633, 54690, 15519, 67747) c5(nV, u, y, b); #c1(COPZ2) c2(NP_057513) c3(2463) c4(28577, 41634, 54691, 15520, 67748) c5(cU, iA); #c1(COQ2) c2(NP_056512) c3(2464) c4(28578, 41635, 54692, 15521, 67749) c5(ake, et, ae, eW, kV, el, GS, bd, na, aUv, fD, kS, oD, EW, JK, EV); #c1(COQ3) c2(NP_059117) c3(2465) c4(28579, 41636, 54693, 15522, 67750) c5(IJ); #c1(COQ4) c2(NP_057119) c3(2466) c4(28580, 41637, 54694, 15523, 67751) c5(EW); #c1(COQ5) c2(NP_115690) c3(2467) c4(28581, 41638, 54695, 15524, 67752) c5(nU); #c1(COQ6) c2(NP_872282) c3(2468) c4(28582, 41639, 54696, 15525, 67753) c5(aUw, na, hc, bd); #c1(COQ7) c2(NP_001177912) c3(2469) c4(28583, 41640, 54697, 15526, 67754) c5(v, hc, asx); #c1(COQ9) c2(NP_064708) c3(2470) c4(28584, 41641, 54698, 15527, 67755) c5(aUy, aUx, EW, kW, EV); #c1(CORIN) c2(NP_006578) c3(2471) c4(28585, 41642, 54699, 15528, 67756) c5(xQ, di, cO, cp, oy, xz, aEa, gA, fU, aUB, P, aUC, jH, eQ, hq, zM, cT, Ak, iB, aUz, at, aUA); #c1(CORO1A) c2(XP_011544016) c3(2472) c4(28586, 41643, 54700, 15529, 67757) c5(b, LX, X, eu, mW, jy, e, y, d, Ag, aGE, t, h, q, bu, Dd, av, ZU, u, gI, c, J, by, G, T, jT, aUD, m, vt); #c1(CORO1B) c2(NP_001018080) c3(2473) c4(28587, 41644, 54701, 15530, 67758) c5(80); #c1(CORO1C) c2(NP_001098707) c3(2474) c4(28588, 41645, 54702, 15531, 67759) c5(g, fI, b, I, q, bu, w, fy, by, O); #c1(CORO2A) c2(XP_011517288) c3(2475) c4(28589, 41646, 54703, 15532, 67760) c5(U, V, qB); #c1(CORO2B) c2(NP_001177385) c3(2476) c4(28590, 41647, 54704, 15533, 67761) c5(ik, Fg); #c1(CORO6) c2(NP_116243) c3(2477) c4(28591, 41648, 54705, 15534, 67762) c5(dB); #c1(CORO7) c2(NP_001188402) c3(2478) c4(28592, 41649, 54706, 15535, 67763) c5(jk, jj); #c1(CORO7-PAM16) c2(NP_001188408) c3(2479) c4(28593, 41650, 54707, 15536, 67764) c5(jk, jj); #c1(COTL1) c2(NP_066972) c3(2480) c4(28594, 41651, 54708, 15537, 67765) c5(azz, fU, m, fr, Nq, ft, aC, Ns, amS, amR, fy, u); #c1(COX10) c2(XP_005256515) c3(2481) c4(28595, 41652, 54709, 15538, 67766) c5(aNN, ake, aeK, I, cJ, acU, sK, aUE, o, pq); #c1(COX11) c2(NP_001156333) c3(2482) c4(28596, 41653, 54710, 15539, 67767) c5(u); #c1(COX14) c2(NP_001244062) c3(2483) c4(28597, 41654, 54711, 15540, 67768) c5(acU); #c1(COX15) c2(NP_004367) c3(2484) c4(28598, 41655, 54712, 15541, 67769) c5(ake, acU, aUF, cK, aUE, o, sK); #c1(COX16) c2(NP_057552) c3(2485) c4(28599, 41656, 54713, 15542, 67770) c5(acU); #c1(COX17) c2(NP_005685) c3(2486) c4(28600, 41657, 54714, 15543, 67771) c5(fy, b); #c1(COX18) c2(NP_001284661) c3(2487) c4(28601, 41658, 54715, 15544, 67772) c5(BX, ny, ip); #c1(COX19) c2(NP_001026788) c3(2488) c4(28602, 41659, 54716, 15545, 67773) c5(acU); #c1(COX4I1) c2(NP_001852) c3(2489) c4(28603, 41660, 54717, 15546, 67774) c5(acU, oD, aA, awy, P); #c1(COX4I2) c2(NP_115998) c3(2490) c4(28604, 41661, 54718, 15547, 67775) c5(A, aKy, acU, P, oD, aUG, aA, pq); #c1(COX5A) c2(NP_004246) c3(2491) c4(28605, 41662, 54719, 15548, 67776) c5(ake, aw, b, X, aUH, NH, bw, U, e, y, d, tp, co, cy, SS, kW, aCU, f, q, yp, fr, O, cs, bv, av, fy, u, dh, o, cc, aNN, sB, V, jh, aC, BT, ad, W, aNx, ji, ft, acU, NG, kJ, ag, pH, tI, I, Ez, df, at); #c1(COX5B) c2(NP_001853) c3(2492) c4(28606, 41663, 54720, 15549, 67777) c5(bb, I, aof, di, T, at); #c1(COX6A1) c2(NP_004364) c3(2493) c4(28607, 41664, 54721, 15550, 67778) c5(acU, cG); #c1(COX6A2) c2(NP_005196) c3(2494) c4(28608, 41665, 54722, 15551, 67779) c5(acU); #c1(COX6B1) c2(NP_001854) c3(2495) c4(28609, 41666, 54723, 15552, 67780) c5(acU); #c1(COX6C) c2(NP_004365) c3(2496) c4(28610, 41667, 54724, 15553, 67781) c5(wh, A); #c1(COX7A1) c2(NP_001855) c3(2497) c4(28611, 41668, 54725, 15554, 67782) c5(acU, wP, wV, F, I); #c1(COX7A2) c2(XP_011533748) c3(2498) c4(28612, 41669, 54726, 15555, 67783) c5(A); #c1(COX7A2L) c2(NP_001305965) c3(2499) c4(28613, 41670, 54727, 15556, 67784) c5(oO, ct, A, V); #c1(COX7B2) c2(XP_005248113) c3(2500) c4(28614, 41671, 54728, 15557, 67785) c5(A, T); #c1(COX7B) c2(NP_001857) c3(2501) c4(28615, 41672, 54729, 15558, 67786) c5(kD, kW, aUI); #c1(COX7C) c2(NP_001858) c3(2502) c4(28616, 41673, 54730, 15559, 67787) c5(bq, aA, cO); #c1(COX8A) c2(NP_004065) c3(2503) c4(28617, 41674, 54731, 15560, 67788) c5(f, aw, aSG, MW, yz, aUO, ps, e, O, aSD, cy, b, kJ, t, sZ, tE, kX, aUS, n, aUM, cs, yO, fO, ft, vc, BW, YT, OA, aOo, qt, ag, pH, i, aA, X, aiM, LK, NH, IW, bw, U, cM, V, tp, co, aUL, RD, pp, aUK, amo, DW, Be, cc, iv, bv, av, cj, rN, ae, qC, NZ, Oj, Qz, gv, acU, adM, aR, alM, tj, iA, W, bR, aMQ, aUW, JO, tl, ji, ci, ake, vq, nU, pT, aF, qz, aUH, aUQ, z, fD, aO, d, jh, bb, kW, jd, oB, axR, q, yp, fr, kr, DZ, VM, ar, u, dh, o, wY, aNN, aUT, ZA, wp, BT, ad, aUP, G, aUJ, et, ao, KK, rm, aUN, bX, Ck, ex, fI, I, agJ, df, da, aiF, SS, k, agH, EM, xf, C, gE, vl, AO, Ez, aX, aCU, cU, aC, Ex, y, Ps, be, lx, aUV, sB, J, dt, aNx, P, bh, eN, NG, AR, Vp, aUR, aUU, at); #c1(CPA1) c2(NP_001859) c3(2504) c4(28618, 41675, 54732, 15561, 67789) c5(bn, vO, vN, Fw, f, W, tU, u, aeC, y); #c1(CPA2) c2(NP_001860) c3(2505) c4(28619, 41676, 54733, 15562, 67790) c5(cz); #c1(CPA3) c2(NP_001861) c3(2506) c4(28620, 41677, 54734, 15563, 67791) c5(A, cy, B, b); #c1(CPA4) c2(NP_001156918) c3(2507) c4(28621, 41678, 54735, 15564, 67792) c5(A, cy, V, b, Qf, B, Me, U); #c1(CPA6) c2(NP_065094) c3(2508) c4(28622, 41679, 54736, 15565, 67793) c5(aUY, aNF, arP, aUX, hS, iZ, IL, Fg); #c1(CPAMD8) c2(NP_056507) c3(2509) c4(28623, 41680, 54737, 15566, 67794) c5(A, ig, wf, Co, y, qs, co, B, hb, cs, fy, u, cV, aC, ad, IX, Fo, Qt, jU, ao, aV, hg); #c1(CPB1) c2(NP_001862) c3(2510) c4(28624, 41681, 54738, 15567, 67795) c5(aC, wG, be); #c1(CPB2) c2(NP_001265470) c3(2511) c4(28625, 41682, 54739, 15568, 67796) c5(dx, bL, d, b, X, dD, ql, w, di, Bg, bf, be, fD, aO, oy, ed, co, bb, fm, adl, eX, q, e, dl, ar, tE, tg, kX, av, bm, wY, pW, amU, azZ, fU, kF, aog, I, sj, sH, du, Ej, fh, xf, aR, bp, tj, Pk, be, eN, at, Eh, ii, eQ, fw, aUZ, gA, ix, Vp, age, bq, aA, Vs, ql, Yx, ap); #c1(CPD) c2(NP_001186704) c3(2512) c4(28626, 41683, 54740, 15569, 67797) c5(Yk, co, b, cV, pi, B, afn, A, T, Dj, iL, iJ, yA, u, gl, y); #c1(CPEB1) c2(NP_001073001) c3(2513) c4(28627, 41684, 54741, 15570, 67798) c5(KK, am, b, J, cT, w, ar, fy, O); #c1(CPEB3) c2(NP_001171608) c3(2514) c4(28628, 41685, 54742, 15571, 67799) c5(dA); #c1(CPEB4) c2(NP_085130) c3(2515) c4(28629, 41686, 54743, 15572, 67800) c5(jE, bm, q, eo); #c1(CPED1) c2(NP_001099003) c3(2516) c4(28630, 41687, 54744, 15573, 67801) c5(aA, agv); #c1(CPE) c2(NP_001864) c3(2517) c4(28631, 41688, 54745, 15574, 67802) c5(aVa, dx, b, X, vB, eH, w, bf, U, O, f, q, amU, av, qT, aE, o, fU, fs, V, I, du, II, mD, aM, rd, qp, dS, nc, bh, aA, at); #c1(CP) c2(NP_000087) c3(2518) c4(28632, 41689, 54746, 15575, 67803) c5(dx, eX, alB, cO, bf, e, O, dv, kS, alx, nv, om, alA, aC, bK, sH, du, yO, x, aVd, hR, aVc, av, pq, sg, mE, ag, bq, fl, td, X, aVj, hS, Ei, f, hj, d, aVi, v, aVe, bt, aY, er, yM, aVk, ap, b, aVf, aVb, z, yK, q, mL, ff, aLV, as, sh, dh, o, fh, da, im, cz, axi, et, ao, nV, ch, hT, aVg, aE, El, aU, aVh, eZ, fd, pR, HS, bj, aW, ayi, aq, nW, si, nQ, afx, an, sj, fK, aM, ii, xM, bM, at, gl); #c1(CPLX1) c2(NP_006642) c3(2519) c4(28633, 41690, 54747, 15576, 67804) c5(ak, ix); #c1(CPLX2) c2(XP_011532721) c3(2520) c4(28634, 41691, 54748, 15577, 67805) c5(bb, aY, bK, ak, dc, bq, cM); #c1(CPLX3) c2(NP_001025176) c3(2521) c4(28635, 41692, 54749, 15578, 67806) c5(oy, GN); #c1(CPLX4) c2(NP_857637) c3(2522) c4(28636, 41693, 54750, 15579, 67807) c5(GN); #c1(CPM) c2(NP_001005502) c3(2523) c4(28637, 41694, 54751, 15580, 67808) c5(oy, aHE, b, bo, jA, QR, kz, cO, ji, eG, ib); #c1(CPN1) c2(XP_011537601) c3(2524) c4(28638, 41695, 54752, 15581, 67809) c5(be, f, fN, eX, v, Fr, aVI, o); #c1(CPN2) c2(NP_001278917) c3(2525) c4(28639, 41696, 54753, 15582, 67810) c5(Fr, vl); #c1(CPNE1) c2(NP_001185792) c3(2526) c4(28640, 41697, 54754, 15583, 67811) c5(qr); #c1(CPNE2) c2(NP_689940) c3(2527) c4(28641, 41698, 54755, 15584, 67812) c5(vl); #c1(CPNE3) c2(NP_003900) c3(2528) c4(28642, 41699, 54756, 15585, 67813) c5(X, co, A, fy, b); #c1(CPNE4) c2(NP_001276041) c3(2529) c4(28643, 41700, 54757, 15586, 67814) c5(bq, cy, Fg, dA); #c1(CPNE7) c2(NP_055242) c3(2530) c4(28644, 41701, 54758, 15587, 67815) c5(bw, u, y, cO); #c1(CPNE8) c2(NP_705898) c3(2531) c4(28645, 41702, 54759, 15588, 67816) c5(oy, eo); #c1(CPO) c2(XP_011508929) c3(2532) c4(28646, 41703, 54760, 15589, 67817) c5(A, cy, b, B, fO, aUH, aVm); #c1(CPOX) c2(NP_000088) c3(2533) c4(28647, 41704, 54761, 15590, 67818) c5(ake, fr, A, aw, b, X, Rl, aUH, NH, aVe, O, bw, O, acU, e, y, d, tp, co, cy, SS, kW, aCU, f, q, Rk, yp, aHH, aVm, aVn, B, cs, bv, av, I, u, dh, o, cc, aNN, sB, V, jh, aC, BT, fO, ad, dt, aNx, P, ji, ft, oh, W, at, NG, kJ, aBy, ag, pH, bk, tl, OL, Ez, df, gl, aVp); #c1(CPPED1) c2(NP_001092925) c3(2534) c4(28648, 41705, 54762, 15591, 67819) c5(ND, aX, fx, aw, i); #c1 (CPQ) c2(NP_057218) c3(2535) c4(28649, 41706, 54763, 15592, 67820) c5(asL, nl, adK, b, sG, cs, dB, q, ad, aC, P, oR, zO, z, aVq, di, bm, WN, Fg); #c1(CPS1) c2(NP_001116105) c3(2536) c4(28650, 41707, 54764, 15593, 67821) c5(gK, bL, fN, hS, di, xa, IW, ajf, aiz, q, gh, bm, xX, aVd, jE, gs, gt, ch, aq, mx, acF, fD, aeA, aA); #c1(CPSF1) c2(NP_037423) c3(2537) c4(28651, 41708, 54765, 15594, 67822) c5(bu); #c1(CPSF2) c2(NP_059133) c3(2538) c4(28652, 41709, 54766, 15595, 67823) c5(og, hV, nV, I, b); #c1(CPSF3) c2(NP_057291) c3(2539) c4(28653, 41710, 54767, 15596, 67824) c5(aVr); #c1(CPSF3L) c2(XP_011539949) c3(2540) c4(28654, 41711, 54768, 15597, 67825) c5(tF, aVr); #c1(CPSF4) c2(NP_001075028) c3(2541) c4(28655, 41712, 54769, 15598, 67826) c5(ji, Co, ar); #c1(CPSF6) c2(NP_001287876) c3(2542) c4(28656, 41713, 54770, 15599, 67827) c5(P, fl); #c1(CPSF7) c2(NP_001129512) c3(2543) c4(28657, 41714, 54771, 15600, 67828) c5(u, aw, y, b); #c1(CPT1A) c2(XP_005273819) c3(2544) c4(28658, 41715, 54772, 15601, 67829) c5(dx, w, dV, bf, al, jh, Fp, dZ, mR, n, u, o, em, I, du, T, gF, aM, oo, ch, cf, XH, fD, fN, bh, aA); #c1(CPT1B) c2(NP_001138606) c3(2545) c4(28659, 41716, 54773, 15602, 67830) c5(l, ami, ch, eX, do, cT, aaY, aA, at, bm, o); #c1(CPT1C) c2(NP_001129524) c3(2546) c4(28660, 41717, 54774, 15603, 67831) c5(aX, f, fO, bp, w, dZ, ac, dV); #c1(CPVL) c2(XP_011513739) c3(2547) c4(28661, 41718, 54775, 15604, 67832) c5(oy, en, ER, I, b, dA, re, aiW, aMr, J, ag, BY, ix, dQ, II, wf, aVs, Rd, P, iT, RQ); #c1(CPXCR1) c2(NP_001171700) c3(2548) c4(28662, 41719, 54776, 15605, 67833) c5(bu); #c1(CPZ) c2(NP_001014447) c3(2549) c4(28663, 41720, 54777, 15606, 67834) c5(cV); #c1(CR1) c2(NP_000564) c3(2550) c4(28664, 41721, 54778, 15607, 67835) c5(dx, iU, eW, sJ, di, C, z, al, aHp, eV, y, m, dv, aX, ae, aVu, h, vQ, aW, gg, aVt, u, gl, o, qw, sQ, fD, I, aC, du, J, aLy, asM, dt, P, T, bh, cy, et, add, hU, LR, aE, fR, i, bq, atR, Im, jl, ap); #c1(CR2) c2(NP_001006659) c3(2551) c4(28665, 41722, 54779, 15608, 67836) c5(WH, Zq, mW, di, bf, bj, jD, aW, d, m, jl, b, aoR, cT, e, oJ, fH, aV, bm, gl, I, aC, be, gm, fO, J, aoN, T, II, BW, jT, f, J, aM, wh, jM, aVv, iK, fc, P, aVw, aVx, zO, iB, mD); #c1(CRABP1) c2(NP_004369) c3(2552) c4(28666, 41723, 54780, 15609, 67837) c5(b, dB, U, e, d, jh, Be, h, F, jV, oJ, bm, nj, bU, og, V, cV, aC, W, T, wh, nV, tl); #c1(CRABP2) c2(NP_001186652) c3(2553) c4(28667, 41724, 54781, 15610, 67838) c5(A, b, k, dD, eR, e, O, d, co, pp, kJ, B, F, dl, ar, oJ, u, fe, I, cV, Fy, T, Hh, wh, jR, aRK, ji, y, Mb); #c1(CRACR2A) c2(NP_001138430) c3(2554) c4(28668, 41725, 54782, 15611, 67839) c5(bq, bj, am, fN); #c1(CRADD) c2(NP_003796) c3(2555) c4(28669, 41726, 54783, 15612, 67840) c5(dA, fr, dB, ft, do, bq, aVy); #c1(CRAMP1L) c2(NP_065876) c3(2556) c4(28670, 41727, 54784, 15613, 67841) c5(bb); #c1(CRAT) c2(NP_000746) c3(2557) c4(28671, 41728, 54785, 15614, 67842) c5(en, pV, iU, bV, cO, e, cy, do, mz, fe, ft, nV, od, jT, fp, f, ag, mD, X, jz, oH, U, kV, y, co, px, ak, B, cs, av, fy, bm, iT, if, jB, V, Jc, eX, qK, P, nU, b, eY, Lq, d, re, hV, q, ra, dQ, pB, HE, u, aE, Kx, I, qL, ad, rw, ao, KK, Dj, fl, I, bL, A, fr, Jn, og, iL, bj, iM, jQ, m, qs, aX, F, aBd, cU, Vr, n, Jf, QB, fU, cV, Be, W, aoN, T, nP); #c1(CRB1)

c2(NP_001180569) c3(2558) c4(28672, 41729, 54786, 15615, 67843) c5(lr, ea, aVD, ha, aVC, aW, cy, nQ, mL, aVz, nR, iF, fC, nW, ajG, vS, Nx, aVA, pk, aVB, nE, aA); #c1(CRB2) c2(NP_775960) c3(2559) c4(28673, 41730, 54787, 15616, 67844) c5(nW, nR, Nx, Nq, Ns); #c1(CRB3) c2(NP_777377) c3(2560) c4(28674, 41731, 54788, 15617, 67845) c5(b, Nk); #c1(CRBN) c2(NP_001166953) c3(2561) c4(28675, 41732, 54789, 15618, 67846) c5(oy, A, aVE, nU, fU, B, ak, bw); #c1(CRCP) c2(NP_001035737) c3(2562) c4(28676, 41733, 54790, 15619, 67847) c5(P, u, y, MO); #c1(CRCT1) c2(NP_061933) c3(2563) c4(28677, 41734, 54791, 15620, 67848) c5(cy); #c1(CREB1) c2(XP_011508947) c3(2564) c4(28678, 41735, 54792, 15621, 67849) c5(dx, jp, en, EM, w, dd, bf, O, dv, cy, kz, aVF, Qx, n, aGW, aC, bK, iv, fO, bp, ee, jT, gg, jE, f, fc, fN, DO, dc, bq, aA, Dr, cY, aGu, jz, hS, aCB, iG, cA, U, cM, V, alS, co, rY, ak, N, bu, B, cs, av, bm, iF, rN, pJ, JY, YM, du, aY, fw, b, bg, ey, abq, q, jV, X, Gj, u, dh, o, fh, I, by, ih, fl, adq, A, Iv, iL, hP, jQ, m, xT, aX, LI, h, oE, M, y, aV, aq, dj, fU, cV, adh, J, W, P, T, II, jl, ast, adu, eB); #c1(CREB3) c2(NP_006359) c3(2565) c4(28679, 41736, 54793, 15622, 67850) c5(dx, xT, aC, u, zl, du, MW, ag, dv, y, gE, kD, o); #c1(CREB3L1) c2(NP_443086) c3(2566) c4(28680, 41737, 54794, 15623, 67851) c5(fs, zF, f, aVG, bg, O); #c1 (CREB3L2) c2(NP_001240704) c3(2567) c4(28681, 41738, 54795, 15624, 67852) c5(QV, nV, bb, b, hV, T, QP, fs, O); #c1(CREB3L3) c2(NP_001258924) c3(2568) c4(28682, 41739, 54796, 15625, 67853) c5(W, f, bm, g); #c1 (CREB3L4) c2(NP_001242908) c3(2569) c4(28683, 41740, 54797, 15626, 67854) c5(A, qv, f, ar, B, u, y, JY); #c1 (CREB5) c2(NP_001011666) c3(2570) c4(28684, 41741, 54798, 15627, 67855) c5(oy, cy, A, di); #c1(CREBBP) c2(NP_001073315) c3(2571) c4(28685, 41742, 54799, 15628, 67856) c5(IJ, B, aw, aN, ps, e, O, cy, ia, gl, og, lb, bK, iv, bp, jT, bk, i, avX, X, jz, cA, U, xw, kV, y, alS, co, ak, cs, av, fy, V, ae, Dp, v, afz, iA, PY, jR, b, aF, jL, KN, aVH, aVJ, d, jh, aVK, nU, Kz, pB, jG, u, o, Kx, kt, ad, G, Nh, aVL, ao, aVI, iR, Qx, I, A, mW, iL, jQ, m, cr, h, oE, cU, aC, n, aCr, fU, hW, apx, cV, Be, J, gV, dt, P, T, fO, ast, aTs, adu, rb); #c1(CREBRF) c2(NP_001161865) c3(2572) c4(28686, 41743, 54800, 15629, 67857) c5(A, pw, b, aC, t, B, PB, ID, aVM, J, kB, cT, T, G); #c1(CREBZF) c2(NP_001034707) c3(2573) c4(28687, 41744, 54801, 15630, 67858) c5(iw, jT, xT, hN, jR); #c1(CREG1) c2(NP_003842) c3(2574) c4(28688, 41745, 54802, 15631, 67859) c5(dx, A, fs, ajF, aC, du, dv, di, nl, HE, T, at, iE, cp); #c1(CRELD1) c2(NP_001026887) c3(2575) c4(28689, 41746, 54803, 15632, 67860) c5(cr, hQ, tq, aVP, aVQ, aVO, aVN, at, ag); #c1(CRELD2) c2(NP_001128573) c3(2576) c4(28690, 41747, 54804, 15633, 67861) c5(jN, f, rP, ID); #c1(CREM) c2(NP_001254491) c3(2577) c4(28691, 41748, 54805, 15634, 67862) c5(en, am, tR, wn, A, vZ, cA, wX, ey, bj, jh, aX, ak, ar, B, hV, NB, gl, o, NT, hW, I, m, fO, mW, Bd, nV, f, aVR, aE, ih, yE, og, gj, bq, aA); #c1(CRHBP) c2(NP_001873) c3(2578) c4(28692, 41749, 54806, 15635, 67863) c5(tG, f, Gt, aFy, mk, dd, vg, cA, gZ, bj, cM, bb, wr, ak, iZ, ky, ff, aVS, dj, hW, sH, gL, vc, aY, jo, ih, gA, dc, di, aA); #c1(CRH) c2(NP_000747) c3(2579) c4(28693, 41750, 54807, 15636, 67864) c5(amcC, abu, aw, Gt, dN, bx, IM, ns, nm, dd, nq, nr, Dy, bf, no, np, e, gO, cU, aVT, hF, qc, ago, aVV, aVF, fH, iz, agQ, vN, sH, afh, MO, vc, od, akK, xx, dH, jE, f, dk, bm, yE, apy, fD, dc, nt, aA, bP, aqi, X, nn, aFy, mk, afo, wX, cA, si, cM, TC, dg, rr, ak, uB, ky, B, av, Ey, iT, iF, rN, Hq, bt, cy, f, J, wu, aVW, aY, Fu, cf, xe, gA, aOe, b, GL, aF, aVU, atU, at, j, J, tG, gZ, d, ND, bb, re, q, yp, NJ, vu, sR, u, aVS, fh, da, PJ, afW, gL, iN, afj, jH, ch, eQ, ih, o, nc, A, aVX, vg, dl, aX, fq, wr, oE, aOd, aC, iZ, y, cB, akn, dj, fU, hW, cV, aMK, be, W, P, T, aM, qp, xM, hq, bM, gl, eG, oT); #c1(CRHR1) c2(NP_001138618) c3(2580) c4(28694, 41751, 54808, 15637, 67865) c5(f, aw, Gt, dd, wX, cp, cy, qc, t, aqQ, aC, sH, vc, aqx, GL, tO, yE, Fq, fD, dc, mD, aA, X, aFy, mk, cA, cM, TC, rr, ak, uB, B, av, JB, Gr, v, zf, amH, OW, aY, gA, b, jq, Ey, qa, tG, gZ, abq, wZ, jd, AK, dQ, ar, Gj, u, aVS, aAf, I, aVY, gL, G, jU, jH, KK, hT, he, ih, I, acE, A, tR, di, vg, oy, m, wr, oE, y, cB, aV, dj, hW, wE, W, ti, qe, nk, eG, gu, LQ, aVZ, gl); #c1(CRHR2) c2(NP_001189404) c3(2581) c4(28695, 41752, 54809, 15638, 67866) c5(da, ak, aw, vg, b, pR, aFy, tR, mk, A, dd, tG, gE, cA, wX, U, oE, abq, cM, TC, wZ, sH, uj, rr, f, q, bu, cc, dQ, amU, cB, u, dh, aqQ, ff, aAf, dj, V, aC, ui, dB, jU, gL, by, W, vc, aZ, cy, qe, Ey, aY, bm, tO, ih, aVZ, dc, di, aA, eG, y); #c1(CRIM1) c2(NP_057525) c3(2582) c4(28696, 41753, 54810, 15639, 67867) c5(ak, fl); #c1(CRIP2) c2(NP_001257766) c3(2583) c4(28697, 41754, 54811, 15640, 67868) c5(jh, u, aeq, y); #c1(CRIP3) c2(NP_996805) c3(2584) c4(28698, 41755, 54812, 15641, 67869) c5(cK, bb); #c1(CRIPAK) c2(NP_787114) c3(2585) c4(28699, 41756, 54813, 15642, 67870) c5(u, y); #c1(CRIPT) c2(NP_054890) c3(2586) c4(28700, 41757, 54814, 15643, 67871) c5(avF, ayZ); #c1(CRISP1) c2(NP_001122) c3(2587) c4(28701, 41758, 54815, 15644, 67872) c5(f, cy); #c1(CRISP2) c2(NP_001135879) c3(2588) c4(28702, 41759, 54816, 15645, 67873) c5(A, b, asx, cY, dB, oi, DX, cO, Eh, e, y, d, co, aX, am, pp, Tq, re, B, bu, cU, aaZ, O, cs, av, fy, u, dh, iT, mz, cV, aC, be, j, ad, W, jo, bQ, T, fO, iA, by, DG, DR, er, jR, ji, aA, Jh, afd, ap); #c1(CRISP3) c2(NP_001177915) c3(2589) c4(28703, 41760, 54817, 15646, 67874) c5(A, aw, b, VG, hq, gn, bu, T, B, ar, Fr, by); #c1(CRISPLD1) c2(NP_001273707) c3(2590) c4(28704, 41761, 54818, 15647, 67875) c5(aal, dA); #c1(CRISPLD2) c2(NP_113664) c3(2591) c4(28705, 41762, 54819, 15648, 67876) c5(aF, je, Nq, Ns, aZ, z, apU); #c1(CRK) c2(NP_005197) c3(2592) c4(28706, 41763, 54820, 15649, 67877) c5(dx, by, en, Ob, gG, dB, Od, w, cO, bf, e, O, dv, dN, kz, cl, Hs, Oe, aC, du, aB, gm, bp, ft, jT, ag, cT, FT, bk, dc, aA, fO, X, LM, mk, bw, U, y, V, co, DM, f, bu, B, cs, av, fy, bm, iT, iF, rN, ae, NZ, BV, Oa, yM, zS, b, aF, Of, NY, ey, gZ, d, fv, re, q, dQ, as, ar, jG, u, dh, o, da, I, j, ad, CZ, jU, kB, HN, xU, yA, Jh, A, k, fr, di, gE, al, jx, aX, h, F, n, aV, cV, an, be, J, Oc, P, II, ji, cz, wU, mb, fP, iB, at, eG, ja); #c1(CRKL) c2(NP_005198) c3(2593) c4(28707, 41764, 54821, 15650, 67878) c5(A, b, y, co, cr, t, B, bu, cl, jG, fy, u, fU, aC, J, by, G, T, afb, pw, cz, K); #c1(CRLF1) c2(NP_004741) c3(2594) c4(28708, 41765, 54822, 15651, 67879) c5(aQO, S, LR, aPo, aWa, Ns, C, gg); #c1(CRLF2) c2(NP_071431) c3(2595) c4(28709, 41766, 54823, 15652, 67880) c5(G, AL, cy, t, ajy, UG, J, jy, cT, oR, aWb, gR, fq, oO, Jc, ag); #c1(CRLF3) c2(NP_057070) c3(2596) c4(28710, 41767, 54824, 15653, 67881) c5(bm, en, or, b, lb, iR, xJ, q, Dj, aWc, X, xr, w, fl, zO, jV, AP, O); #c1(CRLS1) c2(NP_001120930) c3(2597) c4(28711, 41768, 54825, 15654, 67882) c5(aIU, aWd, f, gd, bk, aA, fR); #c1(CRMP1) c2(NP_001014809) c3(2598) c4(28712, 41769, 54826, 15655, 67883) c5(b, ey, bj, co, pw, f, ar, aNK, fy, dh, wK, cV, v, J, IR, IX, ao, aOO, Nq, Ns, IS, Au, ji); #c1(CRNKL1) c2(NP_001265554) c3(2599) c4(28713, 41770, 54827, 15656, 67884) c5(jH, Ns, P, C, cO, gg); #c1(CRNN) c2(NP_057274) c3(2600) c4(28714, 41771, 54828, 15657, 67885) c5(d, jh, qf, il, f, MW, ik, dn, Xx, e); #c1(CROCC) c2(XP_011540774) c3(2601) c4(28715, 41772, 54829, 15658, 67886) c5(g); #c1(CROT) c2(NP_001137407) c3(2602) c4(28716, 41773, 54830, 15659, 67887) c5(aX); #c1(CRP) c2(XP_011507509) c3(2603) c4(28717, 41774, 54831, 15660, 67888) c5(dx, gK, en, a, xx, aAB, dN, vq, F, dD, aWf, ud, ql, iC, aN, eH, dv, aWm, xb, aEO, ak, vl, cO, aw, eP, OH, e, iF, gO, wY, bQ, cy, Jo, fP, nv, dl, om, do, mR, tE, xf, kX, Uy, gl, mz, sE, gG, aC, sH, du, gJ, bp, ft, vc, fl, eR, x, rm, hR, Yp, pq, sS, fN, wK, mE, rJ, m, pv, i, dc, aCQ, bq, aA, eQ, Mb, aWj, nX, tG, id, td, Kt, aWI, u, He, Zl, jz, ZG, py, rd, mk, eV, Ku, av, GV, rH, xw, vV, cM, rN, tp, co, hi, fm, f, N, cs, fb, aWk, Em, B, aDM, vo, hj, fy, bm, azi, em, vR, V, ae, Bs, Dr, nl, nu, v, cd, aVe, pr, vm, aR, eX, bt, rT, By, iA, pi, akG, PJ, xd, W, aH, tm, wp, uJ, aY, fL, iV, xe, uK, gA, yM, fK, zS, Xt, aAp, fD, fW, ap, fn, bP, bn, bW, b, aF, vh, anb, atU, aw, dk, vY, Og, z, aMI, ey, gZ, IS, LP, aO, d, jh, fO, bb, aAG, vj, j, q, f, J, Cu, mL, dQ, Km, bf, pY, dh, o, fh, gl, RG, adK, kF, Zz, I, im, adJ, sX, be, hv, gL, aWh, RY, I, J, Ql, aZ, fH, qV, et, iw, hU, Ka, ch, aFa, bX, aJy, ub, mA, aE, aGQ, gd, Bm, rv, VT, I, di, Vs, fw, QU, bL, A, MZ, iL, qd, fr, UA, sv, mW, cA, Xh, vZ, C, vg, eO, wf, sx, U, aW, pF, ih, qs, Oh, aej, IO, ox, aWi, cU, tF, hN, ik, y, ev, agN, Io, jQ, jH, si, ed, sj, aWg, be, dB, vF, aWe, P, ti, axN, II, Oi, gF, ad, fz, aM, da, atJ, Ic, il, aas, atR, bh, X, at, vT, oT); #c1(CRTAC1) c2(NP_001193457) c3(2604) c4(28718, 41775, 54832, 15661, 67889) c5(tY, cy, I, ale); #c1(CRTAM) c2(NP_001291711) c3(2605) c4(28719, 41776, 54833, 15662, 67890) c5(iG); #c1(CRTAP) c2(NP_006362) c3(2606) c4(28720, 41777, 54834, 15663, 67891) c5(co, b, zF, aWo, F, fM, zM, vc, T, adp, fy, aV, Qk, aWn, cp); #c1(CRTC1) c2(NP_001091952) c3(2607) c4(28721, 41778, 54835, 15664, 67892) c5(jp, A, b, Ip, Ty, aWp, y, co, aX, sR, aO, u, dh, ff, FR, agh, fO, ee, jo, iy, aeC, py, aWq, eB, aA, ahQ); #c1(CRTC2) c2(NP_859066) c3(2608) c4(28722, 41779, 54836, 15665, 67893) c5(d, mz, co, I, b, ch, f, fO, e, w, ar, A, bf, ey, u, aA, y, aM); #c1(CRTC3) c2(NP_001036039) c3(2609) c4(28723, 41780, 54837, 15666, 67894) c5(jp, aA, aal); #c1(CRX) c2(NP_000545) c3(2610) c4(28724, 41781, 54838, 15667, 67895) c5(b, aWs, ea, sI, aW, fC, aNT, mL, nU, cB, Nk, nR, nQ, nW, SF, Or, Pa, ayr, aih, fP, aWr, Nx); #c1(CRY1) c2(NP_004066) c3(2611) c4(28725, 41782, 54839, 15668, 67896) c5(A, td, b, aQf, di, aWt, cA, bf, U, y, aX, ak, cU, B, jG, u, V, cM, iN, ke, aM, aY, ih, cT, dc); #c1(CRY2) c2(NP_001120929) c3(2612) c4(28726, 41783, 54840, 15669, 67897) c5(amC, A, tr, b, aQf, di, gE, cM, jl, ak, ra, ar, B, jG, u, tQ, dj, og, I, aMR, T, eX, jT, aY, ih, dc, aA, y); #c1(CRYAB) c2(NP_001276737) c3(2613) c4(28727, 41784, 54841, 15670, 67898) c5(mZ, A, aw, b, X, dB, w, kY, O, aWu, aWx, e, aW, mR, d, tp, f, F, q, Kk, ik, y, cB, kD, oD, av, aWv, u, o, rR, WG, GS, nQ, asN, an, LR, v, kp, as, akT, T, x, cK, gg, art, aV, aWy, aWw, sK, fc, aWA, PY, aWz, eo, qP, dX, Ez, at); #c1(CRYBA1) c2(NP_005199) c3(2614) c4(28728, 41785, 54842, 15671, 67899) c5(EM, aWB, jV, xg); #c1(CRYBA2) c2(NP_476434) c3(2615) c4(28729, 41786, 54843, 15672, 67900) c5(KC); #c1(CRYBA4) c2(NP_001877) c3(2616) c4(28730, 41787, 54844, 15673, 67901) c5(aru, aWD, kD, aWC); #c1(CRYBB1) c2(NP_001878) c3(2617) c4(28731, 41788, 54845, 15674, 67902) c5(aru, aWF, aWE); #c1(CRYBB2) c2(NP_000487) c3(2618) c4(28732, 41789, 54846, 15675, 67903) c5(aWH, aWG, aru, OG, Zt, kD, rn); #c1(CRYBB3) c2(NP_004067) c3(2619) c4(28733, 41790, 54847, 15676, 67904) c5(aWI); #c1(CRYGB) c2(NP_005201) c3(2620) c4(28734, 41791, 54848, 15677, 67905) c5(aWJ); #c1(CRYGC) c2(NP_066269) c3(2621) c4(28735, 41792, 54849, 15678, 67906) c5(m, cy, nQ, apx, cV, P, ar, aWG, Aj, aV); #c1(CRYGD) c2(NP_008822) c3(2622) c4(28736, 41793, 54850, 15679, 67907) c5(dx, QU, A, b, qd, vp, U, xe, vl, rN, yK, co, aWM, aoR, zc, bX, B, aWL, UM, cq, aE, zH, ax, aWG, V, aC, du, bR, dv, VP, bb, be, dH, XY, aWN, anG, aWK, Le, ji, apD, ap); #c1(CRYGS) c2(NP_060011)

c3(2623) c4(28737, 41794, 54851, 15680, 67908) c5(aWP, aru, f, Zt, aWO); #c1(CRYL1) c2(NP_057058) c3(2624) c4(28738, 41795, 54852, 15681, 67909) c5(A, cf, q, dY, aWQ, xa, gF, pP); #c1(CRYM) c2(NP_001879) c3(2625) c4(28739, 41796, 54853, 15682, 67910) c5(rO, b); #c1 (CRYZL1) c2(NP_665857) c3(2626) c4(28740, 41797, 54854, 15683, 67911) c5(cM); #c1(CSAD) c2(NP_001231634) c3(2627) c4(28741, 41798, 54855, 15684, 67912) c5(gK, A, aX, sG, Jh, vf, Iq, j, B, gg); #c1(CSAG3) c2(NP_001123300) c3(2628) c4(28742, 41799, 54856, 15685, 67913) c5(ck, b, fr, u, ft, av, iR); #c1(CSE1L) c2(NP_001243064) c3(2629) c4(28743, 41800, 54857, 15686, 67914) c5(b, X, dB, HC, w, U, e, y, d, q, es, jF, O, cB, cs, av, u, aoh, fi, vR, V, aC, Fs, J, ad, W, P, aiL, jE, gm, bm, kM, nJ, aof, aod, T); #c1(CSF1R) c2(NP_005202) c3(2630) c4(28744, 41801, 54858, 15687, 67915) c5(dx, jK, aw, dB, aWS, w, oU, O, cp, BO, dv, cy, kT, t, GG, JI, og, aC, du, ft, od, jT, ahX, M, Ey, fc, hx, TJ, bk, i, ael, fl, X, Em, JE, bw, y, eK, B, cs, Em, iv, aPM, av, cj, em, cJ, aWT, iA, ci, b, zH, aWR, z, ey, bb, Be, hV, q, jV, es, ar, ff, u, aWU, aWV, ad, G, iD, agi, jU, nV, hX, I, A, fr, Sc, pR, gw, fs, bj, cr, h, cU, n, aV, fU, J, T, eG, MU); #c1(CSF2) c2(NP_000749) c3(2631) c4(28745, 41802, 54859, 15688, 67916) c5(aXk, ix, dB, ER, Vn, ajf, pz, e, aWX, cp, dl, gP, IU, aC, ft, ME, IH, aXf, pq, pb, aL, jE, aXp, DO, tO, ag, pH, fD, pt, Dr, GD, X, eu, iG, cM, eK, hg, agU, av, fy, V, aXd, kp, jC, aNO, Cs, aY, oM, ck, aKO, Hr, aGX, yN, Be, fv, aE, da, fs, aXv, j, ad, agi, iw, ao, mA, CL, aED, eZ, fr, aXs, asm, iL, jQ, m, RQ, bK, wF, oS, be, J, jo, Jh, fP, E, dx, jK, iU, bf, aK, O, aXe, aXh, AX, amW, Kd, rR, XY, nl, du, gm, bp, asz, x, wh, aoC, fc, sN, la, aEN, bS, U, co, BL, f, ky, SV, aWY, akT, wt, bq, PJ, eF, aXh, rn, pv, mZ, Pv, oR, d, ec, bb, IY, jd, q, QE, zm, ff, ar, iR, o, fh, kt, pB, sf, aZ, et, jU, rQ, Eu, NG, gd, fl, k, Ik, EE, abr, al, dl, oJ, hN, cB, cZ, T, II, UE, eB, sp, DL, gj, bM, DM, aXA, aw, Zq, N, Ka, eW, fR, ps, iy, tX, asy, Rh, aD, aoc, g, aXy, aBs, ahM, agQ, p, ss, fO, BW, fx, OA, rS, YA, aXz, cT, xb, aXx, tW, aXw, EO, aKe, zu, cG, cY, rq, jz, NH, JE, ai, bF, Ei, pp, na, mL, B, JX, iv, gg, QD, cJ, qq, v, Qz, dv, Fr, akG, cf, fw, ach, b, zH, ami, jq, jL, bg, aiE, aiT, TQ, N, J, Pc, ajJ, ri, Zz, wp, ir, Dg, aXm, cz, et, hT, HN, ub, Xf, sc, acE, adK, eM, db, eh, aXc, cU, tF, aoQ, sb, a, XL, aEN, sH, yd, W, ti, jl, aM, e, J, aXj, Y, xM, at, eG, pV, aXo, hx, aiW, aN, sJ, w, cO, aWW, cy, t, do, aE, Qx, Jl, lb, aHS, aXr, jT, QJ, ro, aWZ, Qk, Nv, aXa, i, dc, ael, axq, TJ, Kc, IW, aXg, y, aCy, aXq, cs, kN, bm, cj, em, CZ, aXi, pr, afa, auw, dP, jR, oj, gA, ci, Dm, ey, jV, dQ, qu, jG, u, aaQ, I, G, aFj, aXn, pe, RU, Du, pa, xX, I, aff, A, H, J, aXt, di, Oy, Bz, bj, aX, kn, fq, h, F, M, n, Mi, aV, jZ, fU, qB, apx, cV, hZ, wE, aXu, P, aj, HK, pw, fT, pF, vv, ac, zl, cb, al, vt, iE); #c1(CSF2RA) c2(NP_001155002) c3(2632) c4(28746, 41803, 54860, 15689, 67917) c5(eK, aXa, a, kD, wp, asm); #c1(CSF2RB) c2(NP_000386) c3(2633) c4(28747, 41804, 54861, 15690, 67918) c5(hW, aWZ, h, nl, aXB, J, azc, cA, eK, fh, cy); #c1(CSF3) c2(NP_000750) c3(2634) c4(28748, 41805, 54862, 15691, 67919) c5(dx, gK, f, aw, Io, IY, ip, aXJ, w, cO, yi, ps, fx, O, cp, aXC, jT, cy, kT, t, e, eE, pC, mR, gP, fH, n, fe, lb, bK, sH, du, fO, gm, bp, ft, Q, x, DM, hR, gg, pq, qt, BX, ie, fn, tO, ag, cT, pH, i, dc, pt, ael, aEN, QD, Kt, X, eu, aGq, NH, iG, y, co, pp, ss, mL, hg, N, cs, bu, ky, B, iv, oD, av, fy, bm, cj, wK, le, aXd, it, Dp, pr, bq, cK, pi, anf, be, dt, uJ, in, ej, ci, aXG, b, aE, od, aoP, ic, z, jD, d, bb, jd, aXF, g, jV, es, VM, jG, u, dh, aXE, da, PJ, qy, ir, aXm, UG, gL, ad, Fo, aZ, XR, et, jU, iw, ao, pe, iR, aXK, Ck, fg, ah, I, aXD, zD, bL, A, pF, k, fr, gE, pz, aA, aFe, ds, C, iL, eM, eh, QV, aX, Ec, h, F, M, hN, ik, sb, cg, aXH, fk, fU, cV, me, J, uR, P, Ei, T, aXI, oF, oM, jl, by, azK, ac, fJ, aeq, iK, NG, Ic, G, DI, fP, atR, bh, at, aoM, oT); #c1(CSGALNACT1) c2(NP_001123990) c3(2635) c4(28749, 41806, 54863, 15692, 67920) c5(oy, t, qZ, Pn, Y); #c1(CSGALNACT2) c2(NP_061060) c3(2636) c4(28750, 41807, 54864, 15693, 67921) c5(ahS); #c1 (CSH1) c2(NP_001308) c3(2637) c4(28751, 41808, 54865, 15694, 67922) c5(eX, b, nF, F, wy, Dj, Lq, y, co, f, N, oc, Me, Lf, bK, nB, av, u, iF, ae, kt, v, J, dt, T, Nh, aAE, aXM, wV, aXL, mA, wP, JO, fl, nd, yA); #c1(CSH2) c2(NP_066271) c3(2638) c4(28752, 41809, 54866, 15695, 67923) c5(eX, b, nF, F, wy, Dj, Lq, y, co, f, N, oc, Me, Lf, bK, nB, av, u, iF, ae, kt, v, J, dt, T, Nh, aAE, aXM, wV, aXL, mA, wP, JO, fl, od, yA); #c1(CSHL1) c2(NP_001309) c3(2639) c4(28753, 41810, 54867, 15696, 67924) c5(mz, A, I, b, ch, yL, B, J, aXN, w, Af, ca, u, aE, y); #c1(CS) c2(NP_004068) c3(2640) c4(28754, 41811, 54868, 15697, 67925) c5(aXO, aNN, ao, LU, ae, b, k, cO, aMI, aXQ, aXP, aoJ, mR, cV, Us, bw, bb, aA, cz, cK); #c1(CSK) c2(XP_005254222) c3(2641) c4(28755, 41812, 54869, 15698, 67926) c5(A, b, X, di, gE, U, yw, y, jx, oy, m, aX, f, aXR, q, bu, B, cs, av, fy, u, o, n, PJ, V, aC, j, ad, P, x, by, mb, bk, gl); #c1(CSMD1) c2(NP_150094) c3(2642) c4(28756, 41813, 54870, 15699, 67927) c5(KS, A, b, X, ix, di, bf, U, bj, e, aW, oy, yg, qf, aX, F, cy, dl, ar, IV, aV, u, Fg, da, d, V, dA, xg, Io, bb, Eo, i, aXS, yA, at); #c1(CSMD2) c2(XP_011538874) c3(2643) c4(28757, 41814, 54871, 15700, 67928) c5(aX, hT, Fs, fP, aw, hR); #c1(CSMD3) c2(NP_443132) c3(2644) c4(28758, 41815, 54872, 15701, 67929) c5(co, V, nU, dB, cz, bf, U, IV); #c1(CSNIS1) c2(NP_001020275) c3(2645) c4(28759, 41816, 54873, 15702, 67930) c5(u, y); #c1(CSN2) c2(XP_011529920) c3(2646) c4(28760, 41817, 54874, 15703, 67931) c5(Ag, at, t, h, G, T, Af, iv, bf, yo, u, aE, y, aM); #c1(CSN3) c2(NP_005203) c3(2647) c4(28761, 41818, 54875, 15704, 67932) c5(Ag, KU, hT, ahk, aAl, il, aAk, fr, ft, nz, nU, q, gv, T, Af, bq, QZ, bh, aV, Vf, FR); #c1(CSNK1A1) c2(NP_001020276) c3(2648) c4(28762, 41819, 54876, 15705, 67933) c5(aX, V, cY, AP, vQ, ad, cs, x, U, u); #c1(CSNK1D) c2(NP_001884) c3(2649) c4(28763, 41820, 54877, 15706, 67934) c5(aXT, da, ak, aXV, sG, f, aXU, bu, W, yU, o, bf, ayx, vf, od, azo, u, y, at); #c1(CSNK1G3) c2(NP_001026982) c3(2650) c4(28764, 41821, 54878, 15707, 67935) c5(ao); #c1(CSNK2A1) c2(XP_011527477) c3(2651) c4(28765, 41822, 54879, 15708, 67936) c5(A, b, w, ic, U, e, y, d, h, f, B, cs, aXW, QJ, u, fe, V, lb, fO, ad, zU, Dj, ag, Xt); #c1(CSNK2A2) c2(NP_001887) c3(2652) c4(28766, 41823, 54880, 15709, 67937) c5(d, V, w, ic, ct, aXW, U, QJ, e); #c1(CSNK2B) c2(NP_001311) c3(2653) c4(28767, 41824, 54881, 15710, 67938) c5(d, m, aC, q, ic, ct, iA, e); #c1(CSPG4) c2(NP_001888) c3(2654) c4(28768, 41825, 54882, 15711, 67939) c5(aCw, ma, aX, b, t, DO, w, o, bb, u, arE, y, fh); #c1(CSPG5) c2(NP_001193871) c3(2655) c4(28769, 41826, 54883, 15712, 67940) c5(Ew, AX); #c1(CSPP1) c2(NP_001278268) c3(2656) c4(28770, 41827, 54884, 15713, 67941) c5(Nw, aXX); #c1(CSRNP1) c2(NP_149016) c3(2657) c4(28771, 41828, 54885, 15714, 67942) c5(bf, mR, T, ad); #c1(CSRNP3) c2(NP_079245) c3(2658) c4(28772, 41829, 54886, 15715, 67943) c5(IV, cz); #c1(CSRP1) c2(NP_001180500) c3(2659) c4(28773, 41830, 54887, 15716, 67944) c5(dx, fn, en, aw, b, fr, aF, aWf, ZG, jH, aN, dv, m, id, aEO, nl, z, MZ, U, gZ, OH, LP, aO, gO, d, ed, qs, xw, bb, aej, aW, aMI, f, e, q, ap, hN, mR, cM, A, cs, bf, gg, fy, u, dh, aWI, wY, aE, du, V, I, jh, aC, gG, LR, ft, fK, P, co, aR, eX, Cy, di, Ka, be, aM, iw, py, aY, bm, atJ, vT, B, uK, gd, fP, dc, I, vZ, aA, at, y, oT); #c1 (CSRP2BP) c2(NP_065397) c3(2660) c4(28774, 41831, 54888, 15717, 67945) c5(aSW); #c1(CSRP2) c2(NP_001287894) c3(2661) c4(28775, 41832, 54889, 15718, 67946) c5(u, y); #c1(CSRP3) c2(NP_003467) c3(2662) c4(28776, 41833, 54890, 15719, 67947) c5(azz, mL, b, X, Pv, iP, Ty, A, BJ, cO, e, y, d, bb, f, aXY, fr, mR, B, IV, fy, u, jZ, cl, sz, me, nQ, cV, aXZ, ft, T, amR, cK, pF, sK, Nq, ag, Ns, amS, aA); #c1(CST1) c2(NP_001889) c3(2663) c4(28777, 41834, 54891, 15720, 67948) c5(by, A, V, I, ahB, bu, cs, x, U, ad); #c1(CST2) c2(NP_001313) c3(2664) c4(28778, 41835, 54892, 15721, 67949) c5(nP, bb, X, F, aC, Wv, aYa, av, aK, al, o); #c1(CST3) c2(NP_001275543) c3(2665) c4(28779, 41836, 54893, 15722, 67950) c5(dx, dM, w, cO, bW, aK, gO, dv, b, dl, g, azZ, aC, bK, du, aax, aL, dS, xb, fD, bq, aA, aaA, EO, gk, td, sF, bf, ai, aYc, ed, co, DG, B, aaZ, ky, cp, Gl, v, cd, aYb, tX, aH, PY, aYe, ap, tr, am, bg, id, z, bb, jd, aYd, zm, jG, u, o, aDu, fs, I, G, zk, et, ao, HN, I, kK, bL, A, k, UA, BY, aBV, di, qX, aYa, bj, aW, adb, h, F, tF, y, Jk, aV, sj, GS, dt, II, aj, aM, eB, zp, aT, at); #c1(CST4) c2(NP_001890) c3(2666) c4(28780, 41837, 54894, 15723, 67951) c5(aBc); #c1(CST5) c2(NP_001891) c3(2667) c4(28781, 41838, 54895, 15724, 67952) c5(nP, A, X, F, Wv, aYa, av, aK, al, o); #c1(CST6) c2(NP_001314) c3(2668) c4(28782, 41839, 54896, 15725, 67953) c5(da, mL, b, X, mk, A, aYa, bw, O, aK, y, MT, aX, fq, re, B, F, ar, DP, av, fy, u, o, g, qL, dt, T, dq, nP, nV, iT, Wv, aT); #c1(CST7) c2(NP_003641) c3(2669) c4(28783, 41840, 54897, 15726, 67954) c5(b, xB, bu, bf, aMf, aOI); #c1(CST8) c2(NP_005483) c3(2670) c4(28784, 41841, 54898, 15727, 67955) c5(aYf, aX, o, am); #c1(CST9) c2(NP_001008693) c3(2671) c4(28785, 41842, 54899, 15728, 67956) c5(td, u, pi, T, et, y, ap); #c1(CST9L) c2(NP_542177) c3(2672) c4(28786, 41843, 54900, 15729, 67957) c5(ap, td, UO); #c1(CSTA) c2(NP_005204) c3(2673) c4(28787, 41844, 54901, 15730, 67958) c5(da, B, b, w, bf, A, e, y, d, jh, co, aX, ail, fq, f, F, ar, fy, u, g, qL, aYg, cy, aM, er, I); #c1(CSTB) c2(NP_000091) c3(2674) c4(28788, 41845, 54902, 15731, 67959) c5(A, b, k, ahd, hS, w, KQ, y, jh, co, aX, aPZ, jd, zn, B, q, vQ, dl, ar, bK, u, yJ, aYh, il, aYi, zj, v, SE, yH, ME, zk, XV, jr, kS, akA, aq, P, zp, Bx, afw, T); #c1(CSTF1) c2(NP_001315) c3(2675) c4(28789, 41846, 54903, 15732, 67960) c5(l, i); #c1(CSTF2) c2(NP_001316) c3(2676) c4(28790, 41847, 54904, 15733, 67961) c5(co, fy); #c1(CSTF2T) c2(NP_056050) c3(2677) c4(28791, 41848, 54905, 15734, 67962) c5(am); #c1(CSTL1) c2(NP_612140) c3(2678) c4(28792, 41849, 54906, 15735, 67963) c5(bj); #c1(CT45A1) c2(NP_001017417) c3(2679) c4(28793, 41850, 54907, 15736, 67964) c5(wV, qp, b, X, nl, wP, ck, ar, av, u, y); #c1(CT55) c2(NP_001026875) c3(2680) c4(28794, 41851, 54908, 15737, 67965) c5(X, Up, pt, oM, av, u, y); #c1(CT83) c2(NP_001017978) c3(2681) c4(28795, 41852, 54909, 15738, 67966) c5(d, ck, rr, co, ar, fy, A, e); #c1(CTAG1A) c2(NP_640343) c3(2682) c4(28796, 41853, 54910, 15739, 67967) c5(A, aw, b, X, Lv, iP, jz, BY, ck, bo, U, re, e, y, jx, d, jh, co, aX, zu, Qu, B, q, vQ, M, ik, O, ar, av, fy, u, iT, jQ, jg, V, il, cV, Be, Mi, J, aHK, P, fO, ji, nP, jT, jG, fM, wV, aeq, iR, Bg, wP, oi, bh, h, WP); #c1(CTAG2) c2(NP_066274) c3(2683) c4(28797, 41854, 54911, 15740, 67968) c5(d, jh, A, aX, V, b, aHK, X, bo, B, e, fO, bu, ck, ik, il, ar, U, iR, av); #c1(CTAGE1) c2(NP_758441) c3(2684) c4(28798, 41855, 54912, 15741, 67969) c5(hT, b); #c1(CTAGE5) c2(NP_001234918) c3(2685) c4(28799, 41856, 54913, 15742, 67970) c5(jd, aYj, aX, b, cs); #c1(CTBP1) c2(NP_001012632) c3(2686) c4(28800, 41857, 54914, 15743, 67971) c5(pt, iF, A, aX, V, b, B, gL, bu, W, ct, T, n, bb, oM, U, by, u, aA, y); #c1(CTBP2) c2(NP_001277143) c3(2687) c4(28801, 41858, 54915, 15744, 67972) c5(jh, A, b, X, J, cU, av, u, iA, y); #c1(CTC1) c2(NP_079375) c3(2688) c4(28802, 41859, 54916, 15745, 67973) c5(ajG, aYk, hi, ss, mm, aYl); #c1(CTCF) c2(NP_001177951) c3(2689) c4(28803, 41860, 54917, 15746, 67974) c5(aMC, fr, A, b, X, jz, wy, aYn, ck, dV, U, fx, y, V, d, cU, fe, co, mF, t, h, nU, e, Me, qL, sL, dZ, cB, av, jQ, u, NT, hW, aYo, Be, el, J, gL, ft, dt, qO, G, T, eX, bt, rO, iA, aNS, KK, aYm, i, fl, Ez, at, bp); #c1(CTCFL) c2(NP_001255970) c3(2690) c4(28804, 41861, 54918, 15747, 67975) c5(ck, aw, b, X, QB, wy, in, fx, y, d, cU, co, aX, t, F, e, Me, sL, ik, cs, av, u, il, bp, G, T, iA, TY, aYp, nJ); #c1(CTDP1) c2(NP_004706) c3(2691) c4(28805, 41862, 54919, 15748, 67976) c5(ao, aYq, A, ak, ahe); #c1(CTDSP1) c2(NP_001193807) c3(2692) c4(28806, 41863, 54920, 15749, 67977) c5(ck, b, fO, M, WP, jG, u, y); #c1(CTDSP2) c2(NP_005721) c3(2693) c4(28807, 41864, 54921, 15750, 67978) c5(o); #c1(CTDSPL) c2(NP_001008393) c3(2694) c4(28808, 41865, 54922, 15751, 67979) c5(d, A, b, F, h, ie, dB, bp, e, M, T, ff, ar, fy, u, re, y); #c1(CTF1) c2(NP_001136016) c3(2695) c4(28809, 41866, 54923, 15752, 67980) c5(dx, Kl, eX, kE, dD, aN, di, cO, qs, dv, f, q, mR, cc, vE, OA, bm, I, du, v, Jj, hR, et, ao, yE, Au, aA, ap); #c1(CTGF) c2(NP_001892) c3(2696) c4(28810, 41867, 54924, 15753, 67981) c5(dx, gK, dM, aw, Fk, Gm, EM, dB, w, cO, vp, e, xl, gO, vr, dv, cy, kJ, t, anh, sM, wY, fH, Hs, oJ, aNq, fe, aC, du, fO, gm, bp, ft, aiL, x, hR, gg, wh, Dz, sN, ag, iT, fD, bq, aA, bT, bP, fl, anY, cY, aYv, LM, kB, iG, bf, bw, U, y, ed, co, sT, mL, f, bu, aLT, O, av, fy, bm, fY, is, V, gv, Jc, cl, pi, f, J, er, jd, tl, ji, EG, aGP, wj, bW, b, Hr, z, jy, ey, d, jh, xi, MX, re, hV, q, Cu, vu, ar, oO, u, dh, o, iP, fs, I, LR, j, by, G, aZ, aYw, et, jU, jH, nV, ig, ch, DR, jc, aE, I, fr, sO, aYu, IW, HJ, qi, di, iL, gE, wf, al, sx, wd, oy, QV, aX, bj, F, aYr, pC, Gw, Ek, jZ, aYt, ez, aNr, be, Dw, J, T, II, aM, jT, atL, Jh, Ir, zM, fP, pZ, aYs, iB, bh, X, at, eG, gf); #c1(CTHRC1) c2(NP_001243028) c3(2697) c4(28811, 41868, 54925, 15754, 67982) c5(aw, b, cY, U, e, y, d, aX, q, bu, xl, cs, u, V, aC, be, by, T, ad, Rz, VQ, py, ag, Mp); #c1(CTIF) c2(NP_001135869) c3(2698) c4(28812, 41869, 54926, 15755, 67983) c5(bw, bj); #c1(CTLA4) c2(NP_001032720) c3(2699) c4(28813, 41870, 54927, 15756, 67984) c5(dx, mL, pV, Io, sE, iU, aPi, Ka, eC, jT, sJ, en, hM, ak, vl, aw, eD, e, M, hR, cy, aYl, kJ, t, AX, DB, yh, dl, aGe, mR, jU, aMq, Dc, aD, pq, gl, TP, ha, Ex, aeM, mm, aC, el, sH, du, fO, gm, bp, gY, Jk, vc, xO, ed, BW, vM, x, JN, gg, dH, pb, Ip, aoC, Lz, gC, OR, fc, fN, sS, ie, aV, axA, ag, cT, axC, pH, iT, i, bq, jl, bT, aEN, bP, rN, id, anY, Kt, cY, dE, eu, aIV, Kc, mk, fU, Ku, vp, U, Jo, V, y, gB, j, co, BL, pp, ps, DM, f, aDD, XP, vQ, bu, Em, aFL, B, zQ, fy, bm, aFZ, QD, d, be, yV, Ag, yY, nl, n, cd, dv, Jc, eX, bb, pi, sU, pk, aYH, dP, aMQ, nc, P, a, YE, iu, tl, abs, Im, qB, re, WH, aDx, kE, b, Pv, qz, aE, m, A, ic, tG, z, ey, IS, aYA, HQ, yK, aGd, aYB, lz, bX, vf, q, QE, zm, ar, ac, bf, yW, u, nj, ri, ff, da, pS, a, YD, I, im, gL, xe, qO, G, aYz, vw, et, JH, cW, jH, hU, ig, fD, DR, rq, Ck, iq, xU, EL, ix, CL, Bm, gl, I, yA, fh, cK, C, aYy, aFY, Pb, iL, TQ, fr, HD, gE, gn, mW, IE, aYx, vg, Oy, PL, al, ft, yw, aW, vW, aX, aGp, cb, kn, fq, h, bY, aHp, bn, Dd, Pm, nl, aYC, fP, alb, jZ, Ac, aFM, ax, hW, gR, Ea, sj, Oq, aYF, dB, J, bR, axl, ti, T, II, aDA, pw, Pk, asn, qe, aM, iz, aGc, ii, Y, eG, Jh, hq, MP, abN, sG, DI, auy, iB, bh, at, Nu, aYG); #c1(CTNNA1) c2(NP_001277236) c3(2700) c4(28814, 41871, 54928, 15757, 67985) c5(A, aw, b, k, X, w, bw, U, e, y, d, jh, cy, h, B, bu, cU, ik, O, cs, av, u, n, cj, em, fe, V, J, gL, ad, W, Fo, T, bp, et, fx, by, VF, qp, hD, alB, i, ci); #c1(CTNNA2) c2(NP_001158355) c3(2701) c4(28815, 41872, 54929, 15758, 67986) c5(oy, dA, ak, F, bu, T, bw, at); #c1(CTNNA3) c2(NP_001278062) c3(2702) c4(28816, 41873, 54930, 15759, 67987) c5(aw, b, Yk, xj, U, bj, aoa, m, cy, mR, IV, aV, iR, o, em, fe, V, T, rB, aYJ, Fg, i, bq); #c1(CTNNAL1) c2(NP_001273903) c3(2703)

c4(28817, 41874, 54931, 15760, 67988) c5(d, jp, aX, b, cy, do, aqR, e); #c1(CTNNB1) c2(NP_001091679) c3(2704) c4(28818, 41875, 54932, 15761, 67989) c5(fA, jp, by, B, aw, dB, Zf, HC, w, ps, aeC, O, Hq, gB, e, dl, alK, aX, yG, apz, g, fe, ft, pF, fO, jE, bp, gY, Ge, vM, x, fx, Yp, aEv, wh, BX, QD, K, aEo, yE, cT, aen, i, mD, aEm, aEl, is, X, DO, iP, iG, bw, U, y, co, ip, f, bu, cc, cs, aYP, av, bm, iT, yJ, em, jB, YV, V, v, gv, aEt, Qt, iA, W, aYM, auK, P, jR, og, tl, ji, pv, hV, b, ia, MS, ic, z, d, jd, re, aua, q, jF, ar, ff, VM, Yr, aYK, jG, u, o, jj, aYN, Tx, gL, ZS, aYL, G, Ca, et, auL, gt, jH, nV, aYO, GM, I, GK, A, k, fr, xj, jc, agj, HS, iL, hP, aX, jk, h, F, cU, apP, ik, oJ, aJZ, IP, YR, J, GB, jo, T, II, bh, ad, AP, Oi, eG, rb); #c1(CTNNBL1) c2(NP_001268424) c3(2705) c4(28819, 41876, 54933, 15762, 67990) c5(A, b, X, dB, wn, NH, U, y, aX, f, q, ar, aD, u, aEg, fU, V, wp, by, Fo, T, cy, jT, st, NG, UR, HN, jR, cT, pH, i, aA); #c1(CTNND1) c2(NP_001078927) c3(2706) c4(28820, 41877, 54934, 15763, 67991) c5(f, b, gG, dB, HC, A, et, bw, U, BQ, y, jh, d, BO, MT, co, aX, ag, B, e, q, es, eE, qL, ar, O, cs, av, fy, u, jF, aoh, fi, vR, V, Be, J, bp, ad, W, P, cU, aiL, ji, jl, iA, aod, kM, nJ, aof, alB, zO, T); #c1(CTNND2) c2(NP_001275644) c3(2707) c4(28821, 41878, 54935, 15764, 67992) c5(B, b, X, w, ak, cA, U, A, O, jh, qf, co, cy, nU, ar, aYQ, av, fy, o, hW, V, dA, aso, aZ, bq, Fr, Zt, Bu, ih, ji); #c1(CTNS) c2(NP_001026851) c3(2708) c4(28822, 41879, 54936, 15765, 67993) c5(em, US, awl, aYR, aAr, mL, LG, aYT, cc, aYS, bf, aYU, et); #c1(CTPS1) c2(NP_001288166) c3(2709) c4(28823, 41880, 54937, 15766, 67994) c5(os, iv); #c1(CTR9) c2(NP_055448) c3(2710) c4(28824, 41881, 54938, 15767, 67995) c5(pL, av, at, pE, cp); #c1(CTRB1) c2(NP_001897) c3(2711) c4(28825, 41882, 54939, 15768, 67996) c5(bf, aW, aM); #c1(CTRB2) c2(NP_001020371) c3(2712) c4(28826, 41883, 54940, 15769, 67997) c5(bw, bn, aE, aW); #c1(CTRC) c2(XP_011538852) c3(2713) c4(28827, 41884, 54941, 15770, 67998) c5(bn, alH, GL, ju, azh, aE, aYV); #c1(CTRL) c2(NP_001898) c3(2714) c4(28828, 41885, 54942, 15771, 67999) c5(da, Ov, aFd, cO, Ou, u, y); #c1(CTSA) c2(NP_000299) c3(2715) c4(28829, 41886, 54943, 15772, 68000) c5(aYh, b, zJ, LF, aYW, LG, dt, P, aYX, di, aDu, aYY, h); #c1(CTSB) c2(NP_680093) c3(2716) c4(28830, 41887, 54944, 15773, 68001) c5(dx, B, iq, dB, aN, w, cO, Eh, bf, aK, e, O, bQ, mR, g, mz, xc, atW, aC, bK, du, bp, ft, aye, cv, mm, fN, Dz, bk, i, pt, aYb, wz, Dr, QD, td, wK, cY, ig, sF, bW, bw, U, y, co, pp, uj, f, cs, bu, aZc, aZd, aZb, cc, aaF, oD, av, fy, bm, akd, yJ, iF, V, ae, v, dv, mD, iA, pi, JY, py, aZa, jR, oM, ap, bn, kE, b, aF, ahd, sU, ha, d, aem, yN, jd, bX, hV, q, X, ajJ, as, ar, jG, u, dh, o, fh, aDu, I, adJ, ad, zk, Fk, azh, nV, aYZ, ch, bg, A, eZ, qd, fr, adK, og, HS, aYa, aks, yw, c, MT, aX, wG, cU, tF, ma, cV, an, hZ, ui, be, Dw, LG, bR, P, T, II, by, aM, aZe, zE, HM, sp, zp, asx, fq, Ez, gl); #c1(CTSC) c2(NP_001107645) c3(2717) c4(28831, 41888, 54945, 15774, 68002) c5(dx, fh, mk, di, qX, z, vl, MT, aZh, yN, aZf, cn, bu, ik, aye, TP, ajs, du, bR, dv, fx, aZg, ch, ajv, i, gj, aA, at, bX, ap); #c1(CTSD) c2(NP_001900) c3(2718) c4(28832, 41889, 54946, 15775, 68003) c5(A, aw, b, k, X, aZk, dB, bg, hS, w, O, bw, U, bj, vl, y, d, ag, co, aX, tX, Ec, aPT, bX, f, q, e, cU, an, iZ, ar, B, cs, av, u, o, Bc, yJ, aaQ, sE, V, cV, aZi, Dc, v, kp, cz, bR, awl, T, aZ, ji, QZ, cy, iA, et, fx, eJ, ata, py, bm, PY, cK, eo, aC, adb, sp, qP, i, bq, aZj, Lm, Mp, at, aAr, aaA, rb); #c1(CTSE) c2(NP_001901) c3(2719) c4(28833, 41890, 54947, 15776, 68004) c5(by, ML, b, kJ, fq, hq, bu, W, ag, T, i, fx, YY, bm); #c1(CTSF) c2(NP_003784) c3(2720) c4(28834, 41891, 54948, 15777, 68005) c5(aQa, wf, sp, aZI, ak); #c1(CTSG) c2(NP_001902) c3(2721) c4(28835, 41892, 54949, 15778, 68006) c5(Tp, b, aF, sE, aZm, vl, ha, oU, bb, h, f, jV, iv, wK, lb, gJ, J, j, P, eX, aZ, cy, ie, fw, gd, cT, fD, bq, eN, ap); #c1(CTSH) c2(NP_004381) c3(2722) c4(28836, 41893, 54950, 15779, 68007) c5(xc, Bu, tr, b, i, bm, h, ak, q, bp, ig, I, cd, aZ, I, u, aE, dH); #c1(CTSL) c2(XP_005251773) c3(2723) c4(28837, 41894, 54951, 15780, 68008) c5(dx, Dr, hV, td, b, mz, X, eu, O, cc, w, Bg, kY, bf, aw, U, iw, pi, y, d, Db, Fp, dv, aX, xu, bn, fq, re, f, e, q, bu, dl, fr, ik, ff, il, mR, av, fy, u, aE, o, fh, g, em, og, V, I, cV, aC, du, J, bp, bd, da, P, jG, T, II, BL, ft, et, yW, fM, aM, ata, aZn, ii, zE, ck, ch, aZe, in, jd, iF, sU, iT, Nj, aA, rC); #c1(CTSO) c2(NP_001325) c3(2724) c4(28838, 41895, 54952, 15781, 68009) c5(u, y); #c1(CTSV) c2(NP_001188504) c3(2725) c4(28839, 41896, 54953, 15782, 68010) c5(da, fq, j, iB, ha, aE); #c1(CTSW) c2(NP_001326) c3(2726) c4(28840, 41897, 54954, 15783, 68011) c5(dn, aoh); #c1(CTSZ) c2(NP_001327) c3(2727) c4(28841, 41898, 54955, 15784, 68012) c5(uD, ag, A, dn, b, zJ, h, B, iU, aN, by, kJ, T, aox, bt, ar, aV, aK, bu, aCV); #c1(CTTNBP2) c2(NP_219499) c3(2728) c4(28842, 41899, 54956, 15785, 68013) c5(p, fl, at, xX, bw); #c1 (CTTN) c2(NP_001171669) c3(2729) c4(28843, 41900, 54957, 15786, 68014) c5(by, aw, BW, b, X, cO, U, e, y, cy, d, BO, bb, LI, f, F, q, bu, ik, rR, cs, ar, av, u, fi, V, il, jh, gL, ad, T, II, bt, aX, fx, BV, jE, bm, ag, i); #c1(CTU1) c2(NP_660275) c3(2730) c4(28844, 41901, 54958, 15787, 68015) c5(Ne, ck, y, avx); #c1(CTXN3) c2(NP_001041717) c3(2731) c4(28845, 41902, 54959, 15788, 68016) c5(Fg); #c1(CUBN) c2(NP_001072) c3(2732) c4(28846, 41903, 54960, 15789, 68017) c5(bP, IJ, dM, td, A, di, bf, at, oy, co, aX, mT, aE, o, V, aZp, xq, Vd, aM, ao, nh, acN, mS, fD, apU, ap, aZn); #c1(CUEDC1) c2(NP_001278954) c3(2733) c4(28847, 41904, 54961, 15790, 68018) c5(aV); #c1 (CUEDC2) c2(NP_076945) c3(2734) c4(28848, 41905, 54962, 15791, 68019) c5(jG, u, y); #c1(CULI) c2(XP_011514934) c3(2735) c4(28849, 41906, 54963, 15792, 68020) c5(aX, b, cV, X, q, KL, aC, P, iD, u, y); #c1(CUL2) c2(NP_001185707) c3(2736) c4(28850, 41907, 54964, 15793, 68021) c5(hh, d, il, b, pR, dB, fP, jo, ik, cB, VP, ar, bj, e, y); #c1(CUL3) c2(NP_001244126) c3(2737) c4(28851, 41908, 54965, 15794, 68022) c5(co, aX, aZq, b, i, sg, bm, f, q, ad, w, di, yn, cs, I, LK, fx, u, y); #c1(CUL4A) c2(NP_001008895) c3(2738) c4(28852, 41909, 54966, 15795, 68023) c5(iF, co, iP, b, X, bm, f, q, bp, W, yE, P, A, B, oi, av, u, y); #c1(CUL4B) c2(NP_001073341) c3(2739) c4(28853, 41910, 54967, 15796, 68024) c5(amd, fl, b, nz, nU, hS, aZs, aZr, ac); #c1(CUL5) c2(NP_003469) c3(2740) c4(28854, 41911, 54968, 15797, 68025) c5(P, aCO, cT, b, re, q, Wh, hG, iT, u, y); #c1(CUL7) c2(NP_001161842) c3(2741) c4(28855, 41912, 54969, 15798, 68026) c5(rM, cV, eX, dB, q, aCt, od, aCv, fy, bm); #c1(CUL9) c2(NP_055904) c3(2742) c4(28856, 41913, 54970, 15799, 68027) c5(bb, cV, iL, aCP, bj, cp); #c1(CUTA) c2(NP_001014433) c3(2743) c4(28857, 41914, 54971, 15800, 68028) c5(m); #c1(CUX1) c2(NP_001189472) c3(2744) c4(28858, 41915, 54972, 15801, 68029) c5(B, Yq, ahM, dB, aN, xb, bf, aK, O, cy, Hs, oJ, xc, aqQ, bK, ao, bp, jT, wh, Qk, ag, aCQ, bq, X, jz, aer, dV, iG, cA, ai, y, co, pp, f, N, bu, dZ, iv, av, fy, V, v, Fy, anf, jR, cz, b, eR, jh, bb, re, jV, Tv, u, o, fs, LR, by, jU, wV, rQ, wP, zO, Xm, A, Iv, U, Ld, jQ, awa, adx, LS, LI, fq, h, F, M, rR, aV, cV, J, T, fO, aX, ad, fM, xM, fP); #c1(CUX2) c2(NP_056082) c3(2745) c4(28859, 41916, 54973, 15802, 68030) c5(ak, cz, ns, nm, nt, nq, nr, nn, no, np, aE); #c1(CUZD1) c2(NP_071317) c3(2746) c4(28860, 41917, 54974, 15803, 68031) c5(X, ag, av, fP, b); #c1(CWC22) c2(NP_065994) c3(2747) c4(28861, 41918, 54975, 15804, 68032) c5(m, qf, A, cy, ad, cs, bb, aA, bg); #c1(CWC27) c2(NP_001284573) c3(2748) c4(28862, 41919, 54976, 15805, 68033) c5(at); #c1(CWF19L1)

c2(NP_001290333) c3(2749) c4(28863, 41920, 54977, 15806, 68034) c5(fN, dL); #c1(CWF19L2) c2(NP_689647) c3(2750) c4(28864, 41921, 54978, 15807, 68035) c5(di, do, u); #c1(CWH43) c2(NP_079363) c3(2751) c4(28865, 41922, 54979, 15808, 68036) c5(al); #c1(CX3CL1) c2(NP_002987) c3(2752) c4(28866, 41923, 54980, 15809, 68037) c5(dx, cO, aZu, O, vr, dv, cy, kJ, aZv, wY, bl, UQ, aC, du, vc, ahO, jT, av, gs, sS, fc, Ox, Di, vJ, bq, qD, rn, He, ahS, Kc, IW, eo, y, V, MI, B, sj, FG, SV, v, cd, aA, xd, dO, fw, aG, b, dk, aZw, z, eV, fv, u, dh, o, da, I, im, j, Fo, aZ, jH, nV, hU, aZt, ch, uH, gd, di, rC, bL, A, gn, vZ, bj, aW, wG, aV, ma, nQ, cV, hZ, P, II, aDA, aGc, nk, MU, Ic, fP, fq, at, eG, iE, gl); #c1(CX3CR1) c2(NP_001164645) c3(2753) c4(28867, 41924, 54981, 15810, 68038) c5(dx, B, Ir, dN, tC, sJ, w, cO, bf, O, vr, dv, cy, kJ, DB, nv, eE, wY, bl, oN, UQ, aC, sH, du, MO, ee, ME, jT, av, Vb, wi, Ox, ag, agS, vJ, bq, aA, bT, rn, bP, id, He, jz, Kc, IW, xw, aZx, y, SV, co, MI, DM, f, sj, NB, fy, wK, uH, i, aZz, cd, IR, eX, aZy, xd, dO, fD, ij, ap, b, dk, vY, fl, aZw, FG, jD, bb, fv, dQ, ar, u, dh, o, da, I, im, gL, IX, Fo, Io, et, hU, aZt, ch, HN, eo, IS, fl, I, di, rC, bL, A, DB, k, ZP, UA, ea, vZ, al, aW, jQ, jI, sG, fq, aV, nQ, cV, hZ, P, j, aDA, aM, at, Ic, eB, agN, bh, gl, MU, oT); #c1(CXADR) c2(NP_001193993) c3(2754) c4(28868, 41925, 54982, 15811, 68039) c5(A, MZ, b, X, eu, w, hM, aHt, O, e, U, aEe, fx, v, d, co, aX, pp, jF, jd, Qe, h, B, F, q, bu, fr, hN, mR, Pm, cB, cs, ar, av, fy, u, o, g, V, cV, ft, fO, J, gL, ad, W, T, II, x, iA, hR, iw, jT, qt, sS, YA, Ic, cT, i, fl, rw, bq, aA, bp); #c1(CXCL10) c2(NP_001556) c3(2755) c4(28869, 41926, 54983, 15812, 68040) c5(dx, hg, aw, Ob, bx, sE, iU, eC, eW, sJ, w, ku, vp, e, O, cy, kJ, AX, aZB, amW, fH, aBs, og, Ib, bK, sH, du, fO, Yl, x, fx, jT, FG, dH, xO, Lz, sS, fN, bY, sN, cT, pH, aex, i, aZA, aA, bT, rn, aEN, Zm, Kt, X, aDE, mk, ma, NH, bf, cA, y, yV, ae, aoR, f, aDD, vQ, bu, aaZ, aLT, av, fy, bm, iT, V, aZC, gv, iA, aZD, en, eF, bR, dY, FG, gj, apD, iu, re, aG, adJ, anh, b, wv, z, ey, jD, d, bb, bX, j, g, fJ, IY, dQ, pB, u, dh, fh, aAf, sQ, il, im, kt, LR, gL, by, aFj, aZ, aCT, et, jU, jH, KK, hU, pS, iq, aE, kC, sU, fl, I, yA, da, A, iL, xu, qd, gE, gn, C, rj, nT, PI, al, aDt, eb, m, aX, fq, h, avu, aC, ik, Dg, aV, jZ, wF, ax, hZ, be, dB, J, W, dU, P, T, II, HK, aM, NG, mb, yf, aWm, DI, auy, iB, bh, at, eG, gf); #c1(CXCL11) c2(NP_005400) c3(2756) c4(28870, 41927, 54984, 15813, 68041) c5(bm, b, k, X, Pv, dB, D, mk, w, gE, al, jD, y, d, yh, q, e, eE, IY, aaZ, aW, av, fy, u, ye, ax, fs, ae, vb, P, T, II, aZE, jT, yj, dH, jE, iR, dY, fP, dX, I, at); #c1(CXCL12) c2(NP_000600) c3(2757) c4(28871, 41928, 54985, 15814, 68042) c5(dx, jp, by, mI, aw, BW, Zq, EM, gG, iX, dB, Ka, sJ, w, aEK, cO, bf, bu, ps, e, O, gO, M, dv, cy, Vx, iR, t, dl, hG, cl, kX, Hs, gl, n, g, eg, aeM, jH, aC, du, fO, bp, ft, m, Bd, aZH, x, fx, hR, vG, gg, ie, vY, we, ag, cT, pv, i, mD, qD, yC, rn, mZ, sa, id, axq, X, eu, bY, kB, fU, iG, Ou, bw, U, Oh, y, yV, tp, co, BL, pp, yE, pz, mI, f, IN, aG, ky, B, cs, fg, av, fy, bm, iT, yJ, if, aZG, V, Ov, qb, aCG, IR, cd, bq, VP, jC, iA, fJ, be, dO, P, fw, aDL, jd, apy, qO, Im, iu, re, ap, uy, b, GD, aF, dk, aoP, oi, z, aiR, ey, jD, jw, d, jh, bb, zJ, Be, bX, q, mL, ar, ff, oO, u, dh, o, fh, sz, aDu, I, qL, LR, aZI, gL, ad, IX, vS, fH, jf, Ut, iw, ch, eQ, hT, iq, adv, agf, IS, asg, aEJ, bL, A, apN, k, fr, pR, mW, aZE, jc, iL, gE, zK, aI, hP, yw, Sj, RX, aX, h, F, cU, aE, aV, wF, ma, cV, me, J, W, bR, jo, ti, T, j, bh, aFt, Ap, aM, jT, MU, G, zM, Di, fP, Kn, at, eG, rr); #c1(CXCL13) c2(NP_006410) c3(2758) c4(28872, 41929, 54986, 15815, 68043) c5(dx, b, qd, Pv, iX, gn, mW, aOQ, di, G, e, y, aFR, m, dv, cy, auW, aoR, yX, t, DM, cV, IN, aC, cB, aV, u, gl, d, du, aZJ, im, Be, aHS, LR, gm, gL, v, I, ME, bt, pw, fx, jT, P, jH, aJi, fc, PB, fG, gd, cT, DI, aAy, iB, aA, apD); #c1(CXCL14) c2(NP_004878) c3(2759) c4(28873, 41930, 54987, 15816, 68044) c5(B, aw, b, X, eu, A, gE, bw, U, e, y, d, co, cy, apG, DM, f, F, bu, ar, IV, u, vR, V, bp, by, P, T, aX, JY, cW, wh, nV, bm, ag, og, DI, I, ji, eG); #c1(CXCL16) c2(NP_001094282) c3(2760) c4(28874, 41931, 54988, 15817, 68045) c5(dx, bL, A, b, vd, Dr, cO, aZK, ki, z, bw, U, fD, O, ed, dv, bb, LI, DM, f, q, cl, B, dh, ff, ax, V, aC, du, dB, eO, by, bR, jo, T, eX, iD, cy, pi, dH, dO, ag, DI, fP, fz, at, bX, ap); #c1(CXCL17) c2(NP_940879) c3(2761) c4(28875, 41932, 54989, 15818, 68046) c5(co, Qm, re, eu, q, U, aZL, iT); #c1(CXCL1) c2(NP_001502) c3(2762) c4(28876, 41933, 54990, 15819, 68047) c5(dx, by, A, gE, Ob, bx, X, sE, eu, aZN, pv, mk, cs, z, U, re, e, y, rN, d, qH, aX, b, pp, aZM, fq, h, hV, q, bu, DI, dQ, B, JF, kX, av, aV, u, Bc, ma, V, dA, aC, hZ, du, J, aLy, gv, W, IJ, Ce, T, II, bt, cy, ad, In, Iz, jH, yG, nk, qt, PB, ti, xe, gd, k, KI, bY, i, akT, bh, at, eG, DM, aG); #c1(CXCL2) c2(NP_002080) c3(2763) c4(28877, 41934, 54991, 15820, 68048) c5(ik, Fk, aF, sE, vB, NF, mk, aZO, di, C, cO, sQ, O, cp, gB, BM, aX, fq, DM, f, mR, cy, ajJ, wT, sR, dQ, gg, u, dh, ma, Pz, aC, Bs, BV, gj, P, vm, II, aZ, bb, aVd, jU, at, dk, iR, aZP, zX, gd, DI, atR, aA, aG, gl); #c1(CXCL3) c2(NP_002081) c3(2764) c4(28878, 41935, 54992, 15821, 68049) c5(Fk, b, X, mk, vY, aZO, vl, y, cy, DM, f, aDD, iZ, O, u, gD, ma, Pz, Bs, sy, BZ, P, vm, aZ, aVd, qW, aZP, mE, gd, DI, atR); #c1(CXCL5) c2(NP_002985) c3(2765) c4(28879, 41936, 54993, 15822, 68050) c5(A, aw, b, aDD, gG, sJ, add, eM, aZR, bf, U, sN, OH, e, eb, d, co, aX, ag, eD, h, B, F, g, bu, Mr, ar, y, hb, fy, u, ri, sQ, V, I, aC, LR, bp, gL, gv, W, T, II, aZ, cy, by, aM, jH, AI, nk, aZQ, yr, gd, kC, DI, fP, bh, aA, at, eG, DM, JX); #c1(CXCL6) c2(NP_002984) c3(2766) c4(28880, 41937, 54994, 15823, 68051) c5(AI, ma, aX, ft, fy, X, Bs, DM, B, aZQ, BZ, fr, DI, bk, aC, bq, sQ, cy, zX, A, gl); #c1(CXCL8) c2(NP_000575) c3(2767) c4(28881, 41938, 54995, 15824, 68052) c5(en, dD, bao, Vz, vB, SB, JH, DH, ra, kJ, ban, dl, nL, mR, cl, TP, JP, vN, aMr, baq, pq, jE, hx, pS, DO, tO, ag, axC, pH, bk, fD, aCQ, bq, aA, GD, X, eu, ig, II, GV, bw, vl, Oh, cM, aZX, pz, rr, N, e, CL, av, fy, fY, zO, aBv, V, ae, cd, jC, J, fJ, pk, aY, dY, ji, ij, aG, Hr, vY, pi, jh, fv, amU, dh, da, fs, Mi, aHm, ad, Yi, fH, ajU, JI, aUd, nV, mA, zX, yr, aDa, VT, Mp, zD, fr, pR, In, gN, iH, bar, C, iL, gE, jQ, m, BM, ajn, Ir, aC, oJ, qB, wF, bau, an, ui, be, dB, bd, bR, xT, ft, fP, wT, Qp, hz, dx, sd, iU, hC, vp, O, cU, AX, gB, Cp, aTe, og, aeM, du, gm, bp, auf, GI, x, wh, qt, sS, Ya, iV, bT, aEX, fl, ie, aSB, mk, ash, Ku, kY, U, arW, amx, co, bah, f, aDD, bu, aee, aNY, gv, ny, Qt, Hh, qH, yf, aqf, nb, eF, fg, Oa, tl, pv, vq, Pv, oi, z, aZW, vn, d, bb, eA, q, zx, IY, hb, ar, aM, iR, o, fh, LR, rw, aZ, et, jU, jH, baa, aAs, BU, gd, aaM, aEV, aZU, Xm, bf, aDj, qd, Ik, tA, rp, al, aW, avV, aq, BT, bam, sj, T, II, at, uj, DI, j, mI, akQ, aw, dN, rR, sE, DT, Ka, axx, eD, bx, eE, aD, kX, yG, g, p, Xc, fO, vc, aZY, fx, gg, cT, RU, bae, EO, nX, AI, cY, jz, kB, has, NH, bW, bab, tp, hm, DM, B, Db, gX, k, bv, hj, iT, yJ, SA, le, rN, BV, bav, bap, bt, By, bat, iA, JY, fw, zS, iu, fn, b, zH, aF, jL, tG, re, hV, aZV, Cu, aNu, Zz, Dg, atr, SG, et, hU, aJA, DR, hT, ub, kC, Bm, adK, mW, Iv, vg, eM, eb, bj, HY, tF, pC, ik, iK, sV, aFN, aTV, Yb, Be, GS, W, aoN, ti, aDA, jI, qT, NG, bal, ajv, aZQ, zM, bac, ap, eG, h, haw, pV, Ym, Ob, Gm, bad, bai, Zs, sJ, w, Gk, Mn, gO, dv, cy, t, Bk, Mu, jq, gl, R, Uv, lb, ol, sH, od, aZS, jT, dL, dH, re, fN, os, yE, i, dc, azR, id, Kt, Zx, aFy, ma, IW, y, aDr, UV, cs, aDp, kN, bm, iF, ali, qb, bag, afB, Xr, pi, aZT, dP, py, aNp, fG, TQ, aox, baj, An, aOR, eR, DJ, ic, Og, atD, ey, aD, baf, Iz, zJ, bX, jV, dQ, jG, u, nj, ax, bak, sQ, I, aPR, by, G, aFj, Io, vw, GW, Jd, eQ, aE, ix, dn, I, bL, A, xa, Mj, HJ, aZZ, aZR, hP, MT, FG, aX, fq, adl, F, n, aXv, aV, jZ, aSL, fU, aBz, cV, hZ, wE, GB, P, gL, Oi, gE, pF, sX, zE, cv, gf, aEA, bh, oT, rZ); #c1(CXCL9) c2(NP_002407) c3(2768) c4(28882, 41939, 54996, 15825, 68053) c5(dx, jK, en, anh, b, X, jz, eu, mk, z, Pl, al, e, y, jQ, d, IC, aX, xu, fq, h, q, M, IY, aaZ, O, Jk, fy, u, jZ, da, wF, bm, sQ, ae, jH, aC, du, dB, gm, gL, gY, P, II, gn, cy, pS, jT, iU, DM, nk, hU, gt, sS, pY, aq, dY, aE, gd, DL, fP, tl, fl, iu, bT); #c1(CXCR1) c2(NP_000625) c3(2769) c4(28883, 41940, 54997, 15826, 68054) c5(aZ, eG, ku, bf, pz, cy, kX, oJ, Uv, aC, Xc, ft, vc, wh, LR, os, tO, ag, bk, i, rn, mk, bax, II, IW, bw, y, co, B, aDD, bu, cs, fg, fy, Ov, bt, JY, wT, vq, b, tG, jh, aem, q, u, aEV, da, Dg, atr, gL, by, Io, jH, yr, kC, Ou, I, A, iL, fr, pR, vg, rp, eb, aX, ajn, cU, aTe, sV, Ek, sH, fU, be, J, dU, P, T, j, bh, ad, aM, bay, ajv, fP, aEA, Oi, pv, eG); #c1(CXCR2) c2(NP_001161770) c3(2770) c4(28884, 41941, 54998, 15827, 68055) c5(dx, B, aw, Io, Yq, DT, w, rp, ku, vp, pz, dv, cy, LN, kJ, aDw, gB, eE, kX, JP, Uv, aC, sH, du, bp, dB, FG, qt, q, os, tO, ag, bk, aA, mZ, X, ix, Xc, IW, et, bw, U, y, co, DM, f, aDD, bu, cs, av, fy, aFi, V, vb, bt, Qt, ael, aqf, JY, ji, pv, bW, b, aF, Hr, vY, jh, Be, bX, aZN, baz, dQ, ar, atr, u, dh, o, da, il, Dg, LR, j, ad, IJ, aZ, jU, aUd, jH, Eu, yr, gd, kC, fg, Bm, I, A, k, In, HJ, gE, vl, eb, aHA, aX, ajn, fq, cU, ik, aTe, aV, jZ, fU, m, be, dU, P, T, fO, aDA, by, DI, fP, Oi, eG, oT); #c1(CXCR3) c2(NP_001136269) c3(2771) c4(28885, 41942, 54999, 15828, 68056) c5(dx, JH, Ob, dB, sJ, ku, vp, e, O, bQ, cy, Os, t, vw, dl, mR, bl, aC, du, gm, fO, ft, jT, dH, sS, sN, cT, aA, bT, cY, jz, ig, ma, iG, U, y, IC, aoR, DM, B, IN, aaZ, ky, cs, av, fy, V, baA, bt, yf, dP, P, iu, b, ic, d, eE, bb, IY, ar, ff, u, dh, PJ, im, ER, kt, gL, ad, aZ, et, Jd, jH, hU, mk, aE, gd, kC, ix, I, zD, A, xu, fr, iL, gE, aEE, PI, al, jQ, m, aX, fq, gT, avu, aV, wF, ax, J, gj, jo, II, jl, ac, HL, nk, Y, DI, fP, iB, X, at, eG, Dg); #c1(CXCR4) c2(NP_001008540) c3(2772) c4(28886, 41943, 55000, 15829, 68057) c5(dx, jp, by, mI, aw, Zq, cs, DT, gi, sJ, w, baB, fw, ps, e, O, M, dv, cy, Vx, t, dl, cl, baD, kX, Fg, g, CS, og, jH, aC, bK, ft, Dt, fO, gm, bp, iU, m, zU, od, Jj, fx, jT, zQ, xO, Dc, DO, bY, baC, ag, cT, oi, iT, i, pt, ael, yC, rn, id, il, if, X, ie, jz, eu, jf, kB, apN, dV, kY, OV, bw, U, y, yt, tp, co, MI, pp, yE, pz, f, LI, IN, bu, dZ, B, iv, fg, av, fy, bm, fY, d, Bd, baE, V, Ov, hf, cd, IR, bt, VP, jC, pi, aA, aec, dt, du, eF, aum, QG, Oa, jo, nJ, jd, tl, oM, iu, re, pv, gG, An, b, aF, aoP, A, qD, z, baE, jD, hh, jh, bb, Dx, Be, bX, hV, PA, q, es, ar, ff, fE, oO, fv, jG, u, dh, o, sz, I, qL, Ou, LR, dT, gL, ad, CM, G, agl, aZ, baG, P, iw, nV, DR, hT, jc, agf, IS, fl, aEJ, Iv, bL, Qv, iG, k, fr, pR, Ik, BY, dY, jR, hP, yw, Sj, RX, MT, aX, ajn, h, F, jQ, oE, cU, hN, ik, n, gg, fP, aV, aFc, wF, fU, qO, cV, Be, sj, be, dB, J, W, bR, aoN, QI, T, II, Oi, jl, nP, Pk, azK, st, IX, zM, j, Kn, at, eG, rb); #c1(CXCR5) c2(NP_001707) c3(2773) c4(28887, 41944, 55001, 15830, 68058) c5(A, b, bx, eu, eG, iL, U, al, y, aFR, m, pw, px, BI, t, B, IN, aC, cs, kX, aV, u, jZ, apN, V, cV, Be, fO, gm, gL, P, T, bp, bt, jl, jT, gT, fc, G, ag, cT, aAy, iB, bg, bT); #c1(CXCR6) c2(NP_006555) c3(2774) c4(28888, 41945, 55002, 15831, 68059) c5(dx, Dr, ak, aw, b, fO, yu, afY, z, yz, hS, yD, w, di, yx, yn, cO, O, A, yv, y, yy, co, aX, LI, yl, f, F, q, ys, oE, yp, X, yF, B, cB, jD, av, yB, u, el, ax, I, aC, nW, du, dB, bp, by, P, dv, yk, eX, iD, uw, cy, jv, dL, yA, be, dH, yG, dO, eF, ym, bm, jC, yr, ag, cT, gu, il, I, T, aA, at, iu, yn); #c1(CXorf36) c2(NP_078965) c3(2775) c4(28889, 41946, 55003, 15832, 68060) c5(Wk, nz, nU); #c1(CXorf66) c2(NP_001013421) c3(2776) c4(28890, 41947, 55004, 15833, 68061) c5(ak, hW); #c1 (CXorf67) c2(NP_981952) c3(2777) c4(28891, 41948, 55005, 15834, 68062) c5(g, A, Tw); #c1(CXXC1) c2(NP_001095124) c3(2778) c4(28892, 41949, 55006, 15835, 68063) c5(by, b, fr, aE, oi, jy, U, ft, e, xl, cp, d, c, aX, re, q, bu, QE, O, aV, Qx, iT, cl, baH, og, V, m, bK, nz, Qz, Xr, P, T, fy, cz, fM, dy, hT, TJ, dr, cT, agw, fP, ji); #c1(CXXC4) c2(NP_079488) c3(2779) c4(28893, 41950, 55007, 15836, 68064) c5(by, A, q, dB, J, bu, n, jB, at, ci); #c1(CYB561D2) c2(NP_001278213) c3(2780) c4(28894, 41951, 55008, 15837, 68065) c5(co, fy, b); #c1(CYB561) c2(XP_005257148) c3(2781) c4(28895, 41952, 55009, 15838, 68066) c5(jw, di); #c1(CYB5A) c2(NP_001177736) c3(2782) c4(28896, 41953, 55010, 15839, 68067) c5(vq, ag, baK, baJ, afg, tW, f, W, axD, bal, kJ, aA, eG, jw); #c1 (CYB58) c2(NP_085056) c3(2783) c4(28897, 41954, 55011, 15840, 68068) c5(fH, fJ); #c1(CYB5R3) c2(NP_000389) c3(2784) c4(28898, 41955, 55012, 15841, 68069) c5(aX, baK, b, fD, E, nU, J, baM, II, KF, axD, Bn, baL, sb, adn); #c1(CYB5R4) c2(NP_057314) c3(2785) c4(28899, 41956, 55013, 15842, 68070) c5(mz, fl, I, f, mA, bf, aM); #c1(CYBA) c2(NP_000092) c3(2786) c4(28900, 41957, 55014, 15843, 68071) c5(bP, dx, asK, uk, td, dD, eO, gN, fw, pX, di, sF, bf, wf, aw, vl, jl, eP, aO, fh, qs, dv, bb, ob, Mw, fn, h, f, IW, bu, dl, y, bv, n, zQ, u, aE, TP, wK, ma, tP, I, m, ir, du, J, j, Dp, eX, baN, bq, cy, mQ, hR, et, aXf, aM, dO, Y, fD, ch, eQ, Ic, SJ, Rd, vT, by, DI, i, I, vZ, aA, at, fz, DM, ap); #c1(CYBB) c2(NP_000388) c3(2787) c4(28901, 41958, 55015, 15844, 68072) c5(dx, g, aFH, zr, dN, ag, gw, baO, fw, sJ, fl, di, Fz, cO, bf, baQ, sx, eV, y, baR, dv, aX, b, pp, iR, t, f, fP, ps, M, CK, tE, kX, zQ, Hs, u, dh, o, aAf, wK, ma, Zz, ae, baP, Bs, xf, du, eu, P, xd, baS, bb, et, bq, be, aM, ir, G, ao, qt, dS, fD, ch, PY, fn, aE, sE, gd, sU, i, VT, I, bh, aA, at, fj, gl); #c1(CYBRD1) c2(NP_001120855) c3(2788) c4(28902, 41959, 55016, 15845, 68073) c5(yK, fh, bb, V, yO, T, yM, bq, U, at, ap); #c1(CYC1) c2(NP_001907) c3(2789) c4(28903, 41960, 55017, 15846, 68074) c5(X, baT, fr, kF, ft); #c1(CYCS) c2(NP_061820) c3(2790) c4(28904, 41961, 55018, 15847, 68075) c5(Ad, Ei, aC, fN, baU, dh, od, kB, xK, vZ, aA, Ck, PZ, NB, fh, u, LP, y, pq); #c1(CYFIP1) c2(NP_001274739) c3(2791) c4(28905, 41962, 55019, 15848, 68076) c5(aNI, rQ, aNk, dA, lb, bK, hT, J, jV, cz, acO, axl, rv, pK); #c1(CYFIP2) c2(NP_001278650) c3(2792) c4(28906, 41963, 55020, 15849, 68077) c5(KK, cy, b, X, ad, cT, ti, cs, av, u, y); #c1(CYGB) c2(NP_599030) c3(2793) c4(28907, 41964, 55021, 15850, 68078) c5(gK, b, X, w, et, bf, baW, y, baV, co, f, F, qU, ar, afl, av, Hs, u, g, bp, T, Fr, et, aM, fy, yM, bh); #c1(CYLC1) c2(NP_066941) c3(2794) c4(28908, 41965, 55022, 15851, 68079) c5(P, jT, jD, b); #c1(CYLC2) c2(NP_001331) c3(2795) c4(28909, 41966, 55023, 15852, 68080) c5(bq, do, at, auz, o); #c1(CYLD) c2(NP_001035877) c3(2796) c4(28910, 41967, 55024, 15853, 68081) c5(dx, da, A, b, atr, bbb, aFm, Iv, aAb, et, O, e, y, d, dv, aX, bba, q, aJS, bu, ik, kk, ar, gg, fy, u, QD, pw, be, dn, il, aC, YR, du, fO, gm, gL, by, dt, P, T, baX, baZ, fH, LS, pi, fJ, aJA, Tu, py, aJt, baY, gd, fP, Bm, tl, yA, at, rb, ic); #c1(CYP11A1) c2(NP_000772) c3(2797) c4(28911, 41968, 55025, 15854, 68082) c5(A, afg, jj, dk, di, bbd, kF, ey, y, bbc, bQ, B, PA, cU, O, hb, PH, u, avP, Gl, I, jh, p, MO, W, zU, iA, vF, qT, US, ch, nc, bbe, UW, yy, cz, bO, acF, UJ, vJ, eG, Hg); #c1(CYP11B1) c2(NP_000488) c3(2798) c4(28912, 41969, 55026, 15855, 68083) c5(bbj, bbf, bbh, gw, di, cO, bbg, qs, Hq, jl, bbm, afj, XQ, ff, u, avP, GI, Fw, afh, cz, dt, aPG, bbl, bbi, qT, W, Fz, bbk, jo, bO, jk, at, MQ, ap); #c1(CYP11B2) c2(NP_000489) c3(2799) c4(28913, 41970, 55027, 15856, 68084) c5(bP, bbj, bbf, td, sO, bbh, vh, IW, vB, Km, mI, tH, dx, cO, vD, vI, jI, sx, aO, MH, oy, ed, qs, Hq, bb, sS, vC, bbn, mI, eX MV, mL, bbp, ff, sX, et, mR, u, Fw, avP, sz, jj, kF, tP, I, er, aC, bbq, sH, du, gJ, bd, xh, uR, vE, vc, eR, bq, cr, di, hR, bbl, bbi, sK, akd, W, Fz, bbk, ch, nc, Ic, bbo, jo, uX, fl, o, fD, jk, tT, at, cK, eQ, MQ, ap); #c1(CYP17A1) c2(NP_000093) c3(2800) c4(28914, 41971, 55028, 15857, 68085) c5(gK, B, Gm, jE, bV, e, Up, cp, cU, bQ, b, Si, do, PH, UP, aC, Qf, afh, gm, MO, Ce, bbr, x, jT, wh, bbk, os, ag, Wp, i, aUt, bq, LD, fE, afo, bw, U, ho, y, gB, co, bbs, hg, bu, DP, av, fy, bm, is, V, aub, Et, HV, nu, afn, gv, Hg, iA, W, Fz, nc, in, RP, Im, fD, ap, ck, am, au, yU, z, aoi, BQ, d, bb, q, X, ar, ff, aJ, u, o, fh, kF, tg, I, Fw, dT, cz, afj, aUd, US, vs, bO, acF, afg, I, Xm, lb, A, jc, di, gE, bbt, al, bj, jw, oy, m, aX, wp, baJ, az, oJ, pN, PT, aq, sH, bbu, vF, dt, jo, T, jl, gF, by, gT, agI, acK, zU, Lr, agc, Oi, at, eG, Gl); #c1(CYP19A1) c2(NP_112503) c3(2801) c4(28915, 41972, 55029, 15858, 68086) c5(pM, dx, by, aw, Tw, w, hM, bW, O, cp, bQ, b, Kg, dl, FN, aC, zv, du, bp, vc, od, dH, wh, fN, qN, i, aUt, aA, Dr, X, fE, jj, NF, mk, afD, iG, U, ho, y, NW, co, js, B, UV, bu, avh, av, fy, bm, iT, Ke, V, afn, Ih, bbw, iA, xd, py, nc, in, iu, ap, am, bbA, yU, tG, aoi, gZ, yQ, aga, re, hV, PA, q, bby, ar, aJ, qu, Nf, u, o, kF, tg, I, afW, be, dT, gL, cz, Lt, aUd, rd, US, nV, kB, ch, mA, yy, afq, I, awy, Gn, A, di, C, vg, ako, bbv, bbz, bj, jw, bbx, m, jl, wp, ty, sG, jk, cU, ik, oJ, p, PT, aq, ma, vF, dt, T, Oi, Ap, ac, sK, arq, agl, acK, bbB, agc, bh, at, eG); #c1(CYP1A1) c2(NP_000490) c3(2802) c4(28916, 41973, 55030, 15859, 68087) c5(dx, by, B, aw, Gm, dD, iU, bn, PM, bf, O, e, Up, cp, cU, bQ, LL, b, LN, t, DM, Go, nZ, dl, Gp, jU, ju, acy, fH, PH, Zv, rR, g, aeM, jH, ajy, du, is, bp, dB, GK, vc, Ce, x, fx, hR, av, aOo, wh, M, vz, dS, bbH, QD, jh, aeR, ag, cT, oi, bbD, i, bq, aA, Dr, aEX, GM, fO, X, fE, iP, mk, fU, bbC, iG, et, bw, U, ho, y, nS, ip, cX, f, cs, bbG, bu, tv, aDg, DP, iv, bv, NB, fy, bm, iT, yJ, V, aub, nl, n, dv, cy, iA, fJ, YU, Vx, GB, pk, gt, P, in, xe, gA, yg, tl, ji, qh, iu, ci, ap, ck, am, GD, sH, aF, au, yU, ic, tG, z, pF, gZ, fD, d, Ag, Fp, bb, Iz, re, hV, PA, q, vu, ar, ff, tg, fv, jG, u, nj, o, da, kF, I, dT, gL, ad, BZ, G, rB, Lt, iw, an, nV, hS, ch, Bg, gd, Ns, ix, I, Mp, af, Xm, azt, bL, A, IO, iL, TQ, Lv, gE, jc, di, fw, vg, eM, zY, Bz, bj, vl, aW, oy, m, bbE, Ez, aX, il, gD, fq, h, F, az, eN, ik, oJ, Jk, PT, QJ, jZ, ma, IP, be, J, W, jo, co, T, II, Oi, jl, cz, ac, aM, jT, nk, bbF, Nq, fW, Lr, E, gj, bh, at, eG, ja); #c1(CYP1A2) c2(NP_000752) c3(2803) c4(28917, 41974, 55031, 15860, 68088) c5(dx, gK, B, aw, adn, aHH, gG, e, dv, cy, bbl, t, aID, gP, Gs, IV, HX, aC, du, bp, fx, FG, bY, ag, cT, i, dc, bq, X, iP, hS, bw, U, y, co, ip, f, xr, bu, NK, cs, av, bm, V, gv, iA, hs, GB, gt, aY, ji, ap, ck, b, GK, aF, z, nS, BQ, d, bbJ, bb, q, fv, ar, u, I, qA, ad, Rk, Lt, ao, hy, GM, HV, I, de, lb, A, Pb, di, bj, aW, jl, sG, h, F, cU, ik, PT, QJ, W, NQ, T, bh, nP, by, ac, bbK, Nq, E, Oi, at, eG); #c1(CYP1B1) c2(NP_000095) c3(2804) c4(28918, 41975, 55032, 15861, 68089) c5(B, dB, Ig, O, e, Up, cp, cy, kJ, t, JZ, n, gD, gm, bp, od, Gl, x, fx, jT, kl, wh, ag, cT, i, aUt, aA, GD, X, fE, iP, ate, bw, U, ho, y, nS, ip, ml, f, md, bu, awd, av, bm, iT, is, V, jh, IR, aSS, sIA, W, nc, er, in, gA, ji, qh, kD, ci, ap, ck, b, vJ, xg, aoi, gZ, d, Ag, bbO, jd, re, PA, q, ar, ff, bbL, u, il, qL, dT, cz, IX, G, aZ, Lt, add, rQ, g, DR, IS, I, bbN, bL, A, jc, di, bj, kH, m, aX, F, qr, cU, ik, oJ, PT, ez, GB, jo, co, T, fO, jl, by, bbM, fM, bbK, sr, eG); #c1(CYP21A2) c2(NP_000491) c3(2805) c4(28919, 41976, 55033, 15862, 68090) c5(bbj, WH, Jo, Kg, di, afo, ajf, IS, bbQ, m, bQ, jl, ni, afj, bbR, bbP, q, dl, aC, Pj, Ex, as, iz, bm, avP, em, kF, an, Fw, afh, vF, dt, aeA, Hq, Lb, cz, amT, qT, W, jE, mP, bbS, nc, ex, axF, cT, bO, bk, jk, I, aA, xa); #c1(CYP24A1) c2(NP_000773) c3(2806) c4(28920, 41977, 55034, 15863, 68091) c5(jl, A, aw, b, X, bbU, gG, dB, ix, bbV, cO, bf, U, pi, AO, gO, co, aX, bbW, fy, bbT, amK, hV, q, ra, ik, y, cs, ar, TW, aV, u, aE, og, V, il, mm, qL, nl, gJ, bp, arx, dt, T, ji, x, cy, D, ad, et, aA, ac, aM, nV, bbk, bm, B, zM, ag, i, I, di, arz, at, rn); #c1(CYP26A1) c2(NP_000774) c3(2807) c4(28921, 41978, 55035, 15864, 68092) c5(dx, IJ, AI, b, Pv, jV, y, co, avN, F, qr, ik, ar, u, o, nl, cV, lb, du, J, W, dv, T, x, ct, et, Mp, eG); #c1(CYP26B1) c2(NP_001264671) c3(2808) c4(28922, 41979, 55036, 15865, 68093) c5(d, dx, bbX, dv, AI, cV, AP, du, aw, aA, et, e, ej); #c1(CYP26C1) c2(NP_899230) c3(2809) c4(28923, 41980, 55037, 15866, 68094) c5(nl, bbY); #c1(CYP27A1) c2(NP_000775) c3(2810) c4(28924, 41981, 55038, 15867, 68095) c5(dx, A, LF, aN, eH, gB, C, rj, eO, aK, aW, ec, dv, aX, bbZ, B, q, Vr, bm, is, ez, bK, bj, du, v, cy, aFq, ao, ep, fq, bh, at, bca); #c1(CYP27B1) c2(NP_000776) c3(2811) c4(28925, 41982, 55039, 15868, 68096) c5(B, pV, Zy, sE, iU, HC, sJ, w, bcf, vl, cO, JH, e, Up, cp, bQ, cy, aDx, iz, TP, og, aC, Ls, bp, azo, od, x, mm, dH, wh, xO, Lz, abv, aZg, Qk, DO, rJ, pH, i, ch, vJ, arz, bT, rn, dB, bP, aAY, X, Dz, ig, ix, NH, mA, xZ, bf, rH, y, bee, co, f, bch, O, Mp, cs, av, fy, bm, iT, vR, V, ae, nl, v, aCO, eX, bch, aA, dt, aH, P, aAW, fK, ji, iu, re, gG, b, bcc, aF, yU, z, gZ, jD, d, jh, jF, bX, HV, q, jV, ra, dQ, ff, ar, u, rX, wR, da, I, beg, Dg, ad, qO, aZ, Lu, jU, jH, nV, fD, bcd, kM, Ck, he, aE, yV, arA, I, D, yA, KG, A, aoG, bci, IE, di, iL, wf, al, U, AO, Ic, m, aX, wp, fq, amK, Pm, qB, PT, aV, ax, tl, YR, Dw, J, arx, W, bR, jo, T, jl, ya, aM, ii, NG, hq, ajv, zM, fP, Oi, at); #c1(CYP27C1) c2(NP_001001665) c3(2812) c4(28926, 41983, 55040, 15869, 68097) c5(111); #c1(CYP2A13) c2(NP_000757) c3(2813) c4(28927, 41984, 55041, 15870, 68098) c5(GK, b, GL, e, cM, d, co, ip, tv, ar, jM, iR, el, W, fx, GB, wh, fy, GM, ag, i, ji); #c1(CYP2A6) c2(NP_000753) c3(2814) c4(28928, 41985, 55042, 15871, 68099) c5(bck, bm, A, gE, b, GK, X, F, bco, bcm, hS, aqp, di, GM, iL, z, e, VJ, nS, U, cM, bcl, d, jh, co, il, ip, re, f, hB, q, bu, tv, gA, ik, y, cs, ar, fy, u, iP, V, aOb, el, nu, bp, gv, W, P, T, x, bcn, fx, ad, et, JY, GL, GB, jM, QN, aY, bcj, hT, Bg, ag, xr, i, dc, I, bh, aA); #c1(CYP2A7) c2(NP_000755) c3(2815) c4(28929, 41986, 55043, 15872, 68100) c5(W, g, gt, b, aPt); #c1(CYP2B6) c2(NP_000758) c3(2816) c4(28930, 41987, 55044, 15873, 68101) c5(dx, by, B, dD, jw, w, cO, bf, bD, ajf, bcq, D, M, aDo, bQ, cy, b, bbl, kJ, t, gB, e, JZ, do, it, ky, oJ, g, HX, lb, bK, afh, fO, bp, ft, fl, od, bbr, fx, jT, mO, GL, wh, bbk, bm, bY, ag, cT, i, dc, pt, aA, bT, bP, aEX, id, AI, X, Rl, hS, UW, bw, U, cM, co, pp, her, f, md, bu, NK, iv, oD, FG, fy, aqp, em, jB, auU, GI, V, ae, nl, v, gv, dv, bt, bch, cl, YU, bct, aY, nc, er, xe, tl, oM, fD, ap, am, fN, Dm, MS, jj, ic, z, MZ, jD, aO, d, Fp, bh, avN, g, jV, DC, aDP, Lv, bcs, n, jG, qT, u, dh, qy, kF, I, qA, el, ht, j, bcp, G, bcu, afj, bq, yi, iw, nV, hU, UJ, tW, he, ih, bO, arA, HV, Lr, Xm, lb, A, Pb, pF, TQ, fr, aaP, gE, di, C, eM, fs, al, Bz, hP, bbz, m, aX, h, oE, cU, aC, y, p, aq, Fw, aXH, du, hW, ez, sB, J, vF, W, P, T, II, Ze, ji, Ap, aM, bbK, Jh, Rd, bh, at, eG); #c1(CYP2C18) c2(NP_000763) c3(2817) c4(28931, 41988, 55045, 15874, 68102) c5(A, b, aaP, iP, hS, di, nS, y, oy, Fp, co, mI, g, AK, DC, bv, u, o, oE, GJ, cT, fD, dc, at); #c1(CYP2C19) c2(NP_000760) c3(2818) c4(28932, 41989, 55046, 15875, 68103) c5(dx, aw, bx, dD, iU, eH, baB, bf, ps, e, gM, aDo, cy, dl, jm, kX, n, azZ, aC, du, bp, IL, fx, akk, qt, akn, fN, os, cT, vK, bk, i, dc, bq, aA, GJ, bP, id, kN, bcv, aiV, iP, hS, ix, hew, cA, Lr, U, cM, yr, nS, mI, f, bu, vo, hj, fy, bm, SA, ali, V, gv, bt, rV, qH, aH, aY, xe, ci, ap, ny, b, z, gZ, fD, aO, d, Fp, bh, eA, je, q, AK, X, qu, u, da, tw, I, sX, atr, fz, j, by, afj, aJA, aFa, ih, dn, I, di, bv, cK, y, A, aaP, gN, hex, C, iL, Ei, wf, jw, hP, vl, oy, m, F, oE, M, hN, ik, ID, aSL, afh, hW, sj, be, J, P, co, fO, Ap, aCC, at, qJ, Ic, bh, eN, eG); #c1(CYP2C8) c2(NP_000761) c3(2819) c4(28933, 41990, 55047, 15876, 68104) c5(dx, GK, X, aaP, ia, eH, hS, ds, eV, aO, at, gM, qf, dv, bb, ae, ip, eA, t, AK, hN, ik, y, bcy, bv, oD, av, gO, u, dh, eN, fh, I, iw, bK, du, fO, W, T, bg, et, ac, pg, GB, bcz, gt, Y, cf, GM, cT, bcA, fD, di, GJ, ap); #c1(CYP2C9) c2(NP_000762) c3(2820) c4(28934, 41991, 55048, 15877, 68105) c5(dx, aw, dD, iU, jw, eH, cO, bf, ps, gM, bcC, dv, cy, dl, Gp, gP, fH, g, aC, bK, du, gJ, bp, bv, x, hR, bY, cT, i, dc, bq, aA, GJ, X, hS, cA, Lr, vl, cM, co, fm, ip, mI, akf, bu, cs, vo, oD, av, bm, SA, V, IL, IR, cK, fJ, W, aH, aY, cf, bcA, ap, b, GK, vh, sU, Z, fD, aO, jh, Fp, bb, eA, je, q, AK, mL, u, dh, wY, kF, il, sX, TK, bc, hv, j, ad, IX, aZ, et, bcB, GM, vP, IS, y, bL, aaP, gN, di, al, U, oy, tn, qs, jl, I, F, oE, hN, ik, ID, bcj, be, GB, P, Ei, fO, AP, aM, aCC, eN, at); #c1(CYP2D6) c2(NP_000097) c3(2821) c4(28935, 41992, 55049, 15878, 68106) c5(bcF, by, aw, aAB, Gm, dD, le, iU, eH, aaY, cO, bf, e, bcl, gM, M, jv, cy, t, SI, Go, Li, gP, IV, g, eg, aqQ, aeM, HX, aC, sH, cs, gJ, bp, dB, vc, Re, bcH, fx, hR, Ew, jE, gt, BX, Wi, aei, hn, fP, yE, cT, bk, i, dc, bq, bT, bP, GD, id, QF, fO, X, xg, bY, Kc, mk, pX, Bg, cA, io, cM, co, bed, ip, cK, B, vQ, bu, aMH, aOg, ky, awd, iv, vo, oD, av, fy, bm, iT, aEq, iF, JB, GS, Gl, V, Et, nl, nu, v, gv, bcL, Jc, ny, rV, YU, GB, aH, aY, er, bcK, gA, tl, azb, T, jP, fD, ap, b, bcE, bg, ic, tG, z, gZ, jD, d, Ag, eA, jd, re, k, q, AK, ar, Wf, gu, jG, aM, u, aE, aVS, sz, Jn, kF, I, ir, sX, gL, ad, Rk, G, xq, bcu, rB, iN, et, nV, hy, hS, tW, he, ih, cX, o, HV, I, de, lb, A, gU, gE, xh, aqV, di, vg, eM, bcD, al, Le, bj, aW, cf, oy, m, qs, aX, hk, bcG, ty, sG, h, F, qr, oE, aqA, y, PT, aV, jZ, dj, fU, hW, ez, an, be, J, W, P, hE, II, bh, cz, qT, aCC, eN, dl, xM, aDd, j, bM, at, zn, as); #c1(CYP2E1) c2(NP_000764) c3(2822) c4(28936, 41993, 55050, 15879, 68107) c5(dx, f, Gt, Gm, iU, aE, cO, bf, e, O, dv, cy, NR, iR, t, bx, nZ, mR, gP, ia, fH, IV, n, g, aOb, sH, du, bp, GI, fx, hR, dL, OA, GL, jE, LW, bm, YA, bY, cT, iT, i, dc, aA, kN, X, iP, ma, vl, Oh, cM, yt, co, ip, hg, akf, bu, tv, Go, awd, iv, bv, av, fy, pP, bcO, Zu, SA, V, aub, nu, Qz, gv, bt, cK, fJ, JY, GB, aaa, gt, aY, B, gA, abs, ji, fW, ap, aEg, bn, b, fN, aF, z, jy, nS, d, jh, Iz, re, q, ar, ff, bcs, u, dh, I, ju, j, by, as, G, rB, ch, Ck, Bg, ex, gd, Ns, Bm, I, di, y, A, TQ, Ow, gE, gN, bcN, C, eM, al, Bz, bj, U, aW, oy, m, aX, il, h, F, bcM, ik, ID, QJ, fU, be, J, W, P, uF, T, Oi, jl, vv, ac, aM, jT, Nq, bh, at, eG); #c1(CYP2F1) c2(NP_000765) c3(2823) c4(28937, 41994, 55051, 15880, 68108) c5(l, co, gt, bp); #c1(CYP2R1) c2(NP_078790) c3(2824) c4(28938, 41995, 55052, 15881, 68109) c5(A, iq, dB, og, UW, al, U, O, aX, B, q, ra, hG, cs, aV, aE, NT, V, aC, ad, dt, P, bcP, cy, mA, ag, arA, bh, iu, afm); #c1(CYP2S1) c2(NP_085125) c3(2825) c4(28939, 41996, 55053, 15882, 68110) c5(da, mk, di); #c1(CYP2U1) c2(NP_898898) c3(2826) c4(28940, 41997, 55054, 15883, 68111) c5(bcQ); #c1(CYP2W1) c2(NP_060251) c3(2827) c4(28941, 41998, 55055, 15884, 68112) c5(Hq, V, b, q, ad, cs, x, U, u, y); #c1(CYP39A1) c2(NP_057677) c3(2828) c4(28942, 41999, 55056, 15885, 68113) c5(aFq, iw, f, hN, bcR); #c1(CYP3A43) c2(NP_001265850) c3(2829) c4(28943, 42000, 55057, 15886, 68114) c5(A, u, B, y); #c1(CYP3A4) c2(NP_001189784) c3(2830) c4(28944, 42001, 55058, 15887, 68115) c5(dx, B, dD, le, dB, eH, bf, e, cp, gM, dv, cy, t, gB, nZ, dl, fH, ha, jH, afh, gJ, bp, GI, x, fx, jT, dL, aZS, bm, ie, hn, bk, i, fN, bq, aA, bT, X, iP, bY, hS, Lr, U, aaw, y, aiH, co, ip, f, jD, gX, cs, oD, av, fy, pP, fi, jB, GI, V, ae, gv, eX, bd, fJ, du, fw, jP, fD, ck, b, ia, wn, ic, z, gZ, iA, d, Ag, bb, re, hV, q, OC, ar, ff, aJ, as, jG, u, I, ad, G, et, iw, afj, Ck, GM, ih, ZL, dn, HV, GK, lb, A, kb, fr, bbU, gE, di, iL, eM, al, hP, jw, sG, h, cU, HN, ik, n, fM, IG, fU, J, gV, GB, P, T, ac, aM, aLj, bh, at, bca); #c1(CYP3A5) c2(NP_000768) c3(2831) c4(28945, 42002, 55059, 15888, 68116) c5(dx, aw, bcS, dD, dB, eH, ck, bf, e, gO, gM, hO, cy, t, Si, nZ, dl, ha, jH, du, gJ, bp, fM, hn, i, vJ, bq, X, hS, Lr, U, y, co, ip, B, oD, av, fy, bm, fY, V, ae, gt, ap, gB, b, ic, fD, d, jh, bb, re, hV, je, q, ff, aJ, oO, jG, u, I, as, G, et, iw, hy, I, hd, lb, A, gU, Lv, di, jw, hP, aW, oy, qs, h, M, hN, ID, Jk, jZ, fU, J, P, T, ac, aCC, Y, at, gf); #c1(CYP3A7-CYP3A5IP) c2(NP_001243426) c3(2832) c4(28946, 42003, 55060, 15889, 68117) c5(bQ, kF, ck, bm, q, gf, cU, co, Lv, cy, u, hd, y); #c1(CYP3A7) c2(NP_000756) c3(2833) c4(28947, 42004, 55061, 15890, 68118) c5(gK, co, kF, ck, bm, q, cU, bQ, A, i, Lv, I, cy, av, u, y); #c1(CYP46A1) c2(NP_006659) c3(2834) c4(28948, 42005, 55062, 15891, 68119) c5(o, ez, aN, tF, dZ, dV, aK, aW); #c1(CYP4A11) c2(XP_011539132) c3(2835) c4(28949, 42006, 55063, 15892, 68120) c5(qs, bm, bb, va, dN, yu, ch, q, fw, di, bq, at, vG, aO, fh); #c1(CYP4B1) c2(NP_001306090) c3(2836) c4(28950, 42007, 55064, 15893, 68121) c5(b, q, bp, cT, w, di, O, i, fl, fx, u, y); #c1(CYP4F11) c2(NP_067010) c3(2837) c4(28951, 42008, 55065, 15894, 68122) c5(u, y); #c1(CYP4F12) c2(NP_076433) c3(2838) c4(28952, 42009, 55066, 15895, 68123) c5(di, ac); #c1(CYP4F22) c2(NP_775754) c3(2839) c4(28953, 42010, 55067, 15896, 68124) c5(aC, bcT, bcq, dw); #c1(CYP4F2) c2(NP_001073) c3(2840) c4(28954, 42011, 55068, 15897, 68125) c5(bL, qs, bb, kJ, aaP, dD, eX, q, fw, ig, mL, di, aO, sX, bq, Fg, fh); #c1(CYP4F3) c2(NP_000887) c3(2841) c4(28955, 42012, 55069, 15898, 68126) c5(lb, B, b, k, fN, ig, A, di, jV, z, U, e, y, gM, qs, co, cy, pp, kJ, jd, f, q, bbG, bu, cU, oJ, aV, u, d, jB, V, bcU, HX, lb, Fw, bbE, by, T, II, bq, iA, dL, wh, bm, HV, od, aA, Fp); #c1(CYP4F8) c2(NP_009184) c3(2842) c4(28956, 42013, 55070, 15899, 68127) c5(A, B); #c1(CYP4V2) c2(NP_997235) c3(2843) c4(28957, 42014, 55071, 15900, 68128) c5(P, nG, bcp, cT, kz, aR, bcV); #c1(CYP51A1) c2(NP_000777) c3(2844) c4(28958, 42015, 55072, 15901, 68129) c5(ajf, qV, sE, b, avN); #c1(CYP7A1) c2(NP_000771) c3(2845) c4(28959, 42016, 55073, 15902, 68130) c5(dx, gB, ka, dD, eO, eR, eH, jc, au, di, z, bf, U, jw, oy, dv, f, q, az, cs, bm, bcW, is, em, V, du, cx, dK, ad, cz, aM, ii, dS, ZL, i, bq, aA, at, bT, ap); #c1(CYP7B1) c2(NP_004811) c3(2846) c4(28960, 42017, 55074, 15903, 68131) c5(gB, aC, A, IK, fN, oo, Nw, bcX, bcY, bcR, aFq, bcZ, ar, B, i, z, I, bda, Fr, bN, o); #c1(CYP8B1) c2(NP_004382) c3(2847) c4(28961, 42018, 55075, 15904, 68132) c5(ka, bf, gB, ac, aM); #c1(CYS1) c2(NP_001032237) c3(2848) c4(28962, 42019, 55076, 15905, 68133) c5(v0); #c1(CYSLTR1) c2(NP_001269117) c3(2849) c4(28963, 42020, 55077, 15906, 68134) c5(dx, A, b, IW, Kc, eO, U, gM, dv, cy, fq, DM, ar, cs, gg, u, ma, TK, du, ad, xk, ti, T, x, av, nk, gd, DI, TN, aZU, at); #c1(CYTH1) c2(NP_004753) c3(2850) c4(28964, 42021, 55078, 15907, 68135) c5(iv); #c1(CYTH3) c2(NP_004218) c3(2851) c4(28965, 42022, 55079, 15908, 68136) c5(gA, b); #c1(CYTIP) c2(NP_004279) c3(2852) c4(28966, 42023, 55080, 15909, 68137) c5(aV, b, Qk, F, co, T, KM, fy, fM); #c1(CYTL1) c2(NP_061129) c3(2853) c4(28967, 42024, 55081, 15910, 68138) c5(QJ, cV); #c1(CYYR1) c2(NP_443186) c3(2854) c4(28968, 42025, 55082, 15911, 68139) c5(oy, qp, cy, KM, cV); #c1(D2HGDH) c2(NP_001274178) c3(2855) c4(28969, 42026, 55083, 15912, 68140) c5(em, bdc, w, bdb, sc, bdd, ac); #c1(DAAM1) c2(NP_001257449) c3(2856) c4(28970, 42027, 55084, 15913, 68141) c5(bb, u, kX, y, pv); #c1(DAAM2) c2(NP_001188356) c3(2857) c4(28971, 42028, 55085, 15914, 68142) c5(DF, dB, ff, dA); #c1(DAB2) c2(NP_001231800) c3(2858) c4(28972, 42029, 55086, 15915, 68143) c5(A, aw, b, X, dD, BY, bw, fx, y, d, tp, co, iR, aol, B, e, cU, ik, Dd, av, aV, u, o, fD, dA, nl, bp, T, bq, et, iA, et, aec, jH, ZU, Ic, nJ, fP, yg, i, od); #c1(DAB2IP) c2(NP_115941) c3(2859) c4(28973, 42030, 55087, 15916, 68144) c5(A, aw, b, di, bW, co, aX, h, f, q, B, iR, wY, bp, P, dv, cd, fx, u, jR, i, bq, at, iu); #c1(DACH1) c2(NP_004383) c3(2860) c4(28974, 42031, 55088, 15917, 68145) c5(A, b, X, EM, dB, hl, Ni, bf, y, co, B, q, bu, av, fy, u, zW, bde, dt, T, iD, aM, MP, fD, ap); #c1(DACH2) c2(NP_001132986) c3(2861) c4(28975, 42032, 55089, 15918, 68146) c5(jw); #c1(DACT1) c2(NP_001072988) c3(2862) c4(28976, 42033, 55090, 15919, 68147) c5(I, V, b, t, q, bu, by, G, T, cs, U, ad, bm, aA, eF); #c1(DACT2) c2(NP_001273280) c3(2863) c4(28977, 42034, 55091, 15920, 68148) c5(bm, co, hM, b); #c1(DACT3) c2(NP_659493) c3(2864) c4(28978, 42035, 55092, 15921, 68149) c5(og, kF, V, cT, co, U); #c1(DAD1) c2(NP_001335)

c3(2865) c4(28979, 42036, 55093, 15922, 68150) c5(qp, py, aN, do, u, y); #c1(DAG1) c2(NP_001171113) c3(2866) c4(28980, 42037, 55094, 15923, 68151) c5(dx, gK, WE, nU, aw, b, bdh, bdg, dB, AA, A, di, ak, cO, ER, sx, e, xl, mR, h, c, dv, BL, DG, cK, f, vu, mg, y, cs, arh, oD, u, bdf, ff, g, d, kG, FR, cJ, nI, du, ad, jo, T, ar, x, cy, ac, Iv, VQ, alt, jR, B, FT, Au, aA, bT); #c1(DAND5) c2(NP_689867) c3(2867) c4(28981, 42038, 55095, 15924, 68152) c5(co, aX, V, b, J, we, ag, oi, cl, cy, U, fy, iu, vl); #c1(DA0A) c2(NP_001155284) c3(2868) c4(28982, 42039, 55096, 15925, 68153) c5(oC, eO, ns, nm, nt, nq, nr, nn, cA, wX, no, np, aW, bb, bdi, ak, aUi, o, Ew, dj, bdj, hW, cz, to, rQ, aY, he, jN, dc, aeZ); #c1(DA0) c2(XP_011536307) c3(2869) c4(28983, 42040, 55097, 15926, 68154) c5(ih, oC, ak, rQ, jv, f, he, EE, ns, cz, nm, nt, nq, nr, nn, O, no, np, aeZ); #c1(DAP3) c2(NP_001186778) c3(2870) c4(28984, 42041, 55098, 15927, 68155) c5(nV, cy, bu, w, A, pw, by, u, O); #c1(DAP) c2(NP_001278892) c3(2871) c4(28985, 42042, 55099, 15928, 68156) c5(dx, WH, kM, aw, jT, b, X, anb, jz, hS, O, bf, U, hP, e, y, jQ, d, E, co, Be, adr, h, px, F, apw, bu, ra, aIC, iZ, ik, iK, fB, ar, av, fy, u, iT, jH, iF, og, V, il, cV, du, BC, gm, bp, J, dv, T, fO, et, fx, by, VF, wh, py, eQ, vU, cT, i, re); #c1(DAPK1) c2(NP_004929) c3(2872) c4(28986, 42043, 55100, 15929, 68157) c5(aw, bS, b, fr, jq, pR, gG, dB, G, BY, w, iG, bdm, jy, Q, re, pz, e, y, d, co, aX, Be, h, f, F, bu, do, hN, ik, oJ, n, ar, av, fy, u, o, ff, g, bdk, V, il, bdl, atr, J, bp, ft, wV, qO, jo, Q, fx, by, jG, ac, JY, iw, wh, BX, aJA, iR, DO, iZ, jR, wP, cT, iT, i, T, fW, rb); #c1(DAPK2) c2(NP_055141) c3(2873) c4(28987, 42044, 55101, 15930, 68158) c5(wK, ao, bj, h, f, v, fO, bu, IR, IX, IS, jV, i, Au, T, ey, u, dh, y); #c1(DAPK3) c2(XP_005259565) c3(2874) c4(28988, 42045, 55102, 15931, 68159) c5(A, b, di, bw, bf, y, ed, co, Tq, f, q, zN, B, jG, fy, u, n, jB, cV, gm, T, aM, pS, ag, yM, kD, ap); #c1(DARS2) c2(NP_060592) c3(2875) c4(28989, 42046, 55103, 15932, 68160) c5(bdo, I, akB, bdn, aV, aW); #c1(DARS) c2(NP_001280241) c3(2876) c4(28990, 42047, 55104, 15933, 68161) c5(bdo, bdp, cV); #c1(DAW1) c2(NP_849143) c3(2877) c4(28991, 42048, 55105, 15934, 68162) c5(oy, bj); #c1(DAXX) c2(NP_001135442) c3(2878) c4(28992, 42049, 55106, 15935, 68163) c5(b, X, jj, vZ, bw, m, bdr, t, AX, f, jV, aC, Dc, pB, av, aE, fi, lb, J, gL, qp, T, II, HL, tm, aaz, asT, bdq, h, Ca); #c1(DAZ1) c2(NP_004072) c3(2879) c4(28993, 42050, 55107, 15936, 68164) c5(yy, NT, wp, am, bds, oH, wn, UW, Lb, ac); #c1(DAZ2) c2(NP_001005785) c3(2880) c4(28994, 42051, 55108, 15937, 68165) c5(NT, UW, am); #c1(DAZ3) c2(NP_065097) c3(2881) c4(28995, 42052, 55109, 15938, 68166) c5(NT, ac); #c1(DAZ4) c2(NP_001005375) c3(2882) c4(28996, 42053, 55110, 15939, 68167) c5(NT, ac, am); #c1(DAZAP1) c2(NP_061832) c3(2883) c4(28997, 42054, 55111, 15940, 68168) c5(t, G, aW, b); #c1(DAZAP2) c2(NP_001129736) c3(2884) c4(28998, 42055, 55112, 15941, 68169) c5(f0); #c1(DAZL) c2(NP_001177740) c3(2885) c4(28999, 42056, 55113, 15942, 68170) c5(pM, NT, am, Lv, wn, ck, jw, Ap, Lt); #c1(DBF4) c2(NP_006707) c3(2886) c4(29000, 42057, 55114, 15943, 68171) c5(DO, f, aX); #c1(DBH) c2(NP_000778) c3(2887) c4(29001, 42058, 55115, 15944, 68172) c5(gK, lb, xJ, KG, bdy, aIV, ns, hS, qa, di, ak, cO, cA, xw, bj, GL, cM, iy, vr, qs, bdx, aX, bdv, sG, f, hB, sW, ap, tF, zb, aV, rX, o, fh, dj, GS, hW, fd, bg, cV, ac, bK, dc, nu, v, bdz, cz, bdt, Wj, Qv, GR, bdw, bb, EE, et, bdu, Sp, Ew, dt, WA, Ww, Ey, aY, ch, tW, hT, vf, ih, cT, amk, PU, HV, bM, aaX, Gn, nc, RB); #c1(DB1) c2(NP_001073331) c3(2888) c4(29002, 42059, 55116, 15945, 68173) c5(Ag, A, I, b, aPm, f, B, ih, T, Af, Fr, acb); #c1(DBN1) c2(NP_004386) c3(2889) c4(29003, 42060, 55117, 15946, 68174) c5(ak, nU, v, w, O, cO, fy, xw, o); #c1(DBNL) c2(NP_001014436) c3(2890) c4(29004, 42061, 55118, 15947, 68175) c5(cy, dP, NG, ak, xB, Kc, NH, Xz, bf, aMf, aOI); #c1(DBP) c2(NP_001343) c3(2891) c4(29005, 42062, 55119, 15948, 68176) c5(f, aeP, yU, bf, ey, O, cp, bi, qc, ak, iZ, aV, u, aE, Ps, nl, fD, I, be, fx, jT, aM, xO, aY, ih, i, fl, I, di, aA, iu, rn); #c1(DBR1) c2(NP_057300) c3(2892) c4(29006, 42063, 55120, 15949, 68177) c5(P, ao, qD, zD); #c1(DBX1) c2(NP_001025036) c3(2893) c4(29007, 42064, 55121, 15950, 68178) c5(PY); #c1(DCAF12) c2(NP_056212) c3(2894) c4(29008, 42065, 55122, 15951, 68179) c5(ck, co, A, B, b); #c1(DCAF13) c2(NP_056235) c3(2895) c4(29009, 42066, 55123, 15952, 68180) c5(cp); #c1(DCAF17) c2(NP_001158293) c3(2896) c4(29010, 42067, 55124, 15953, 68181) c5(US, afW, nU, bf, bM, bdA); #c1(DCAF4) c2(NP_001156980) c3(2897) c4(29011, 42068, 55125, 15954, 68182) c5(cy); #c1(DCAF5) c2(NP_001271136) c3(2898) c4(29012, 42069, 55126, 15955, 68183) c5(at); #c1(DCAF6) c2(NP_001017977) c3(2899) c4(29013, 42070, 55127, 15956, 68184) c5(cp, A, di, eu, B); #c1 (DCAF7) c2(NP_005819) c3(2900) c4(29014, 42071, 55128, 15957, 68185) c5(avO, B, aw, EM, dB, ns, Zs, nm, nt, nq, nr, nn, Eh, bf, no, np, xl, cp, acL, bdH, t, kz, cl, jq, zW, TP, bdD, mz, aC, yL, afh, gm, fD, ft, aye, QZ, Lw, fx, jT, uB, pq, aHi, aDI, fy, iL, sS, bdB, Ot, w, i, aA, pO, bP, agx, zr, X, agP, arQ, hS, fU, Bg, y, bC, bdC, ak, aDD, bu, aVm, ss, oD, av, RR, fD, ae, ge, dP, KW, QG, fw, aqn, Dr, b, aF, eY, Em, bdl, alg, Fp, aUO, bb, pL, nU, qF, q, es, WO, QE, ar, atT, jG, u, aE, BS, bU, wp, im, UG, KL, j, CM, G, afj, iw, aYZ, hT, mA, yy, fg, rv, D, bdF, kK, g, A, bdG, pu, fr, zF, Mj, di, bdE, sb, ih, aX, aej, h, F, nY, hN, awS, aYQ, ag, azT, aYo, nQ, aIS, acv, yH, P, Nx, cr, AP, fM, aM, apR, ayr, Jh, acp, apA, agV, bM); #c1(DCAF8) c2(NP_056541) c3(2901) c4(29015, 42072, 55129, 15958, 68186) c5(bdJ, cK, gZ); #c1(DCANP1) c2(NP_570900) c3(2902) c4(29016, 42073, 55130, 15959, 68187) c5(cy, aY, fq, f, dc, cA, cM); #c1(DCBLD1) c2(NP_775945) c3(2903) c4(29017, 42074, 55131, 15960, 68188) c5(eO, aX, cO); #c1(DCBLD2) c2(NP_563615) c3(2904) c4(29018, 42075, 55132, 15961, 68189) c5(co, kF, pp, b, aCU, anC, Ij, bu, dv, w, cy, by, Fg); #c1(DCC) c2(NP_005206) c3(2905) c4(29019, 42076, 55133, 15962, 68190) c5(aw, w, bf, rc, e, O, do, g, fe, aC, fO, ft, x, fx, jT, Ox, ie, os, ag, i, bq, X, wy, bw, U, cM, co, DG, B, bu, cs, av, fy, is, V, YS, bdK, iA, dY, iu, ap, b, Qy, d, jh, bb, jd, q, fy, qj, ar, jG, u, fh, by, G, ct, jf, jH, iR, af, y, A, fr, jc, hP, aW, aX, bj, h, F, cU, ik, n, ma, cV, J, W, P, T, ad, iK, YX, fP, Oi, at); #c1(DCDC2C) c2(NP_001274373) c3(2906) c4(29020, 42077, 55134, 15963, 68191) c5(oy, cy, I, dA, cO, bw, at, bj); #c1(DCDC2) c2(NP_057440) c3(2907) c4(29021, 42078, 55135, 15964, 68192) c5(A, bb, yQ, b, bdL, xJ, q, Wh, alW, aal, B, aeu); #c1(DCD) c2(NP_444513) c3(2908) c4(29022, 42079, 55136, 15965, 68193) c5(pb, sz, A, aX, I, b, ag, bm, f, q, qL, bdM, mk, IC, B, fq, u, y, cp); #c1(DCHS1) c2(NP_003728) c3(2909) c4(29023, 42080, 55137, 15966, 68194) c5(auz, bdN, at, aet); #c1(DCHS2) c2(NP_001136024) c3(2910) c4(29024, 42081, 55138, 15967, 68195) c5(oy, aV, o); #c1(DCK) c2(NP_000779) c3(2911) c4(29025, 42082, 55139, 15968, 68196) c5(b, X, jl, iG, bw, zL, O, Ei, jl, kJ, t, h, DC, ik, y, cs, av, fy, aq, n, og, cV, J, P, T, nP, jT, ac, hX, u, G, ag, ji); #c1(DCLK1) c2(NP_001182344) c3(2912) c4(29026, 42083, 55140, 15969, 68197) c5(lg, bb, V, b, kJ, cV, q, ez, W, ag, fl, U, bm, Yp, O, ap); #c1(DCLK2) c2(NP_001035350) c3(2913) c4(29027, 42084, 55141, 15970, 68198) c5(cO); #c1(DCLK3) c2(NP_208382) c3(2914) c4(29028, 42085, 55142, 15971, 68199) c5(HI, b, sr, sE, HG, azs, w, VJ); #c1(DCLRE1A) c2(NP_055696)

c3(2915) c4(29029, 42086, 55143, 15972, 68200) c5(oM, fU, pt, eu, pg); #c1(DCLRE1C) c2(NP_001029027) c3(2916) c4(29030, 42087, 55144, 15973, 68201) c5(pm, eu, pD, bdP, z, U, xw, e, O, d, jT, aX, pp, h, CR, bu, Dc, oO, bdQ, av, aV, u, g, RG, ax, V, gm, fO, J, P, QZ, by, aAs, cT, bdO, CV, eG); #c1(DCN) c2(NP_598010) c3(2917) c4(29031, 42088, 55145, 15974, 68202) c5(dx, B, Ip, w, lu, cO, bW, aK, e, xl, dv, cy, Hs, Sk, wo, fO, bdS, fx, vG, av, jE, ag, cT, fY, i, bg, aA, ib, fl, td, X, kB, bf, U, Co, y, aCy, f, vQ, O, cs, vo, gg, fy, bm, tQ, Bd, V, dA, Bs, cd, gv, eq, Qt, iA, rK, uJ, afd, Iz, aG, b, Pv, anY, d, zJ, q, u, aE, o, I, LR, j, ad, IX, Fo, rO, et, nV, hO, ch, mA, apt, bL, A, qd, fr, zF, di, sx, oy, asn, ajn, aBd, cU, pC, Ex, cB, aV, du, Dw, bdR, dt, T, aM, wU, aHE, amS, bh, aT, at, eG); #c1(DCP1A) c2(NP_001277136) c3(2918) c4(29032, 42089, 55146, 15975, 68203) c5(oy, ao, f, zj); #c1(DCP1B) c2(NP_689853) c3(2919) c4(29033, 42090, 55147, 15976, 68204) c5(bL, aY, cM, dc, bw, aW); #c1(DCPS) c2(NP_054745) c3(2920) c4(29034, 42091, 55148, 15977, 68205) c5(P, cy); #c1(DCST1) c2(NP_001137159) c3(2921) c4(29035, 42092, 55149, 15978, 68206) c5(bg); #c1(DCST2) c2(NP_653223) c3(2922) c4(29036, 42093, 55150, 15979, 68207) c5(bg); #c1(DCSTAMP) c2(XP_005251132) c3(2923) c4(29037, 42094, 55151, 15980, 68208) c5(z, bdT, xq, bZ, bq, eG); #c1(DCTD) c2(NP_001012750) c3(2924) c4(29038, 42095, 55152, 15981, 68209) c5(bw, bb); #c1(DCT) c2(NP_001123361) c3(2925) c4(29039, 42096, 55153, 15982, 68210) c5(pV, cB, rG, f, DO, asY, w, Cd, aYz, qB, If, aX, iu, O, rC); #c1(DCTN1) c2(NP_001128512) c3(2926) c4(29040, 42097, 55154, 15983, 68211) c5(bdU, ao, aV, amc, TE, cG, bK, bj, PY, v, dj, KN, Kz, HS, afw, avZ, ai, bdV, u, DA); #c1(DCTN2) c2(NP_001248341) c3(2927) c4(29041, 42098, 55155, 15984, 68212) c5(fr, b, ft); #c1(DCTN3) c2(NP_001268354) c3(2928) c4(29042, 42099, 55156, 15985, 68213) c5(bdW, b, Pv, q, aNI, bdX, nP, DY); #c1(DCTN4) c2(NP_001129115) c3(2929) c4(29043, 42100, 55157, 15986, 68214) c5(bm, A, Kt, b, gG, KN, w, kY, bZ, ai, xw, U, y, TC, d, cy, kJ, f, e, q, iT, bS, Kz, ar, B, WE, fy, u, o, le, V, GS, v, BV, P, T, bt, aj, ao, pY, zM, bdY, bk, amb, aA); #c1(DCTN5) c2(NP_001185940) c3(2930) c4(29044, 42101, 55158, 15987, 68215) c5(ao, bb, u, aC, bK, ak, HN, v, dB, P, di, bf, at, hw); #c1(DCTN6) c2(NP_006562) c3(2931) c4(29045, 42102, 55159, 15988, 68216) c5(dx, B, aw, gG, dB, w, aTh, O, yg, dv, iy, e, og, du, gm, fO, gY, fx, jT, wh, yE, cT, i, bT, X, iP, jz, Ku, iG, OO, U, y, co, ag, f, N, bu, cs, av, fy, bm, iT, iF, jB, V, qq, Qz, ad, aEw, Hh, d, dY, b, hh, jh, apI, re, hV, q, OC, jG, u, o, by, et, aoO, nV, fg, bL, A, k, EN, jR, iL, jw, jQ, aX, h, F, cU, n, cB, cV, J, W, P, T, Ap, fM, E, Oi); #c1(DCUNIDI) c2(NP_065691) c3(2932) c4(29046, 42103, 55160, 15989, 68217) c5(d, jh, js, b, jj, w, T, aj, ar, ai, fy, e, O); #c1(DCX) c2(NP_000546) c3(2933) c4(29047, 42104, 55161, 15990, 68218) c5(bec, nU, aw, b, Xd, jq, aeX, HG, hS, w, gE, bdZ, A, O, FT, aX, LI, bea, Tq, Lw, rc, f, beb, k, aew, g, FR, sB, Fs, Q, cV, bed, iy, Xw, hT, HN, jR, agb, qP); #c1(DCXR) c2(NP_057370) c3(2934) c4(29048, 42105, 55162, 15991, 68219) c5(A, bb, mb, nU, q, fw, xU, bee, B, Fr, aA, aq, be); #c1(DDAH1) c2(XP_011539460) c3(2935) c4(29049, 42106, 55163, 15992, 68220) c5(uk, bb, I, dN, cV, sH, lW, xf, di, tE, Ra, z, gO, bq, gg, at, et, eQ, ap); #c1(DDAH2) c2(NP_001289937) c3(2936) c4(29050, 42107, 55164, 15993, 68221) c5(bP, dx, dN, di, bf, ey, gO, m, dv, aX, f, tE, gg, aE, I, sH, du, gJ, bb, et, xf, bq, aA, at, ap); #c1(DDB1) c2(NP_001914) c3(2937) c4(29051, 42108, 55165, 15994, 68222) c5(X, f, q, Dj, bu, ad, iL, gE, av, aWc); #c1(DDB2) c2(NP_000098) c3(2938) c4(29052, 42109, 55166, 15995, 68223) c5(bef, co, aX, BX, b, X, ip, f, i, Dj, aWc, ad, w, iL, ny, cs, av, aV, u, yA, y); #c1(DDC) c2(NP_000781) c3(2939) c4(29053, 42110, 55167, 15996, 68224) c5(de, vf, aw, b, gK, X, Nr, beh, ns, nm, nt, nq, nr, nn, e, U, np, A, no, cM, d, vr, gC, sG, bj, ak, F, q, bu, Me, ar, beg, av, ajs, fU, hW, vW, ae, cV, qA, nu, bd, cz, by, GL, tW, hT, B, ih, fD, HS); #c1(DDHD1) c2(NP_001153619) c3(2940) c4(29054, 42111, 55168, 15997, 68225) c5(oy, yl, bcZ, bcY, bei); #c1(DDHD2) c2(NP_001157706) c3(2941) c4(29055, 42112, 55169, 15998, 68226) c5(bcZ, bej, bN); #c1(DDI1) c2(NP_001001711) c3(2942) c4(29056, 42113, 55170, 15999, 68227) c5(bq); #c1(DDIAS) c2(NP_659455) c3(2943) c4(29057, 42114, 55171, 16000, 68228) c5(u, y); #c1(DDIT3) c2(NP_001181983) c3(2944) c4(29058, 42115, 55172, 16001, 68229) c5(by, eX, aw, Ny, vB, w, bf, e, O, n, TV, aow, fO, rQ, x, jT, wh, cT, bk, vJ, aA, ib, X, xg, hS, yn, bo, cA, bw, U, y, co, ip, f, bu, B, cs, iJ, aye, av, fy, bm, iT, V, aHK, v, QP, aH, eF, re, hV, b, aOQ, dk, QR, z, d, Dx, PK, gz, q, es, vu, Zh, RF, jG, iR, dh, fh, fs, jE, I, LR, ad, aZ, aeC, iw, ao, nV, u, mA, aE, I, Vs, A, pD, iL, gE, aiP, aX, h, F, jA, M, hN, aHl, oJ, cB, aXm, nQ, cV, J, gm, bel, T, jl, gF, bek, ac, aM, pp, Xu, adu, at, gf); #c1(DDIT4) c2(NP_061931) c3(2945) c4(29059, 42116, 55173, 16002, 68230) c5(d, M, o, A, iy, b, fO, h, f, F, J, avv, B, ih, HS, cA, bj, e, aW); #c1(DDIT4L) c2(NP_660287) c3(2946) c4(29060, 42117, 55174, 16003, 68231) c5(aX, ac); #c1(DDN) c2(NP_055901) c3(2947) c4(29061, 42118, 55175, 16004, 68232) c5(et, bd); #c1(DDO) c2(NP_003640) c3(2948) c4(29062, 42119, 55176, 16005, 68233) c5(dA); #c1(DDR1) c2(NP_001189450) c3(2949) c4(29063, 42120, 55177, 16006, 68234) c5(pM, dx, A, pV, b, sO, X, gE, aN, O, ix, cO, U, aK, aSf, y, aek, m, co, aX, tX, t, h, f, q, fJ, mR, B, qB, ar, av, Hs, u, aE, o, ff, g, iF, ax, V, gG, NT, LR, J, bp, gv, da, jo, dv, T, II, aZ, fH, aos, iA, aA, su, dH, aL, du, fy, hU, bm, ie, UW, sN, yE, fl, Af, fI, bh, aT, bT); #c1(DDR2) c2(XP_011507889) c3(2950) c4(29064, 42121, 55178, 16007, 68235) c5(dx, b, X, ben, dv, QR, di, bo, e, y, aek, d, co, gC, bem, f, fy, u, aC, du, j, QI, T, QJ, Jh, bT); #c1(DDRGK1) c2(NP_076424) c3(2951) c4(29065, 42122, 55179, 16008, 68236) c5(al); #c1(DDT) c2(NP_001077861) c3(2952) c4(29066, 42123, 55180, 16009, 68237) c5(ae, bm, kE, b, ag, xM, q, avJ, bbJ, IB, jo, ar, ff, fy, ji, U, IV, u, y); #c1(DDTL) c2(NP_001077862) c3(2953) c4(29067, 42124, 55181, 16010, 68238) c5(ae, bm, kE, b, ag, xM, q, avJ, bbJ, IB, jo, ff, fy, ji, U, IV, u, y); #c1(DDX10) c2(NP_004389) c3(2954) c4(29068, 42125, 55182, 16011, 68239) c5(b, h, Fg, u, ci, y, n); #c1(DDX11) c2(NP_001244074) c3(2955) c4(29069, 42126, 55183, 16012, 68240) c5(f, b, cY, jC, aX, re, nU, WW, bep, ff, ar, QJ, iT, beo, cz, dt, jo, oM, QZ, FW, Dj, pt); #c1(DDX17) c2(NP_001091974) c3(2956) c4(29070, 42127, 55184, 16013, 68241) c5(b, ad, cs, x, u, y); #c1(DDX18) c2(NP_006764) c3(2957) c4(29071, 42128, 55185, 16014, 68242) c5(h); #c1(DDX19A) c2(NP_060802) c3(2958) c4(29072, 42129, 55186, 16015, 68243) c5(bes, JH, b, beq, mk, gE, U, y, ahN, aX, ml, f, O, aYI, u, ber, V, m, aC, v, j, vc, lI, Nh, cI, ao, jR, aE, cH); #c1(DDX1) c2(NP_004930) c3(2959) c4(29073, 42130, 55187, 16016, 68244) c5(aAF, wV, aw, fD, b, cV, oH, wP, hI, cB, sQ, IV, u, y); #c1(DDX21) c2(NP_004719) c3(2960) c4(29074, 42131, 55188, 16017, 68245) c5(bet, vc); #c1(DDX25) c2(NP_037396) c3(2961) c4(29075, 42132, 55189, 16018, 68246) c5(NT, am, agl, wn, beu, pO); #c1(DDX27) c2(NP_060365) c3(2962) c4(29076, 42133, 55190, 16019, 68247) c5(M); #c1(DDX28) c2(NP_060850) c3(2963) c4(29077, 42134, 55191, 16020, 68248) c5(U, V); #c1(DDX31) c2(NP_073616) c3(2964) c4(29078, 42135, 551920, 16021, 68249) c5(dB); #c1

(DDX39A) c2(NP_005795) c3(2965) c4(29079, 42136, 55193, 16022, 68250) c5(jH, aC, ht, aE, bev, Bm, i, bq, bf, vl, fx, o, aM); #c1(DDX39B) c2(NP_542165) c3(2966) c4(29080, 42137, 55194, 16023, 68251) c5(OB, ix, bf, vl, jD, m, aXC, cy, aiT, fq, aV, aE, o, ae, aC, ht, P, cK, aM, jH, bev, Bm, bq); #c1(DDX3X) c2(NP_001180345) c3(2967) c4(29081, 42138, 55195, 16024, 68252) c5(fI, b, aiW, z, C, iL, gE, jw, y, co, f, q, cU, cB, fy, bm, bew, bp, P, ll, iA, u, jR, UE, cT); #c1(DDX3Y) c2(NP_001289481) c3(2968) c4(29082, 42139, 55196, 16025, 68253) c5(wV, NT, am, UW, fp, wP, ck, bex); #c1(DDX41) c2(NP_057306) c3(2969) c4(29083, 42140, 55197, 16026, 68254) c5(aX, cV, t, G, fO, P, cB, vl); #c1(DDX42) c2(NP_987095) c3(2970) c4(29084, 42141, 55198, 16027, 68255) c5(jR, UE); #c1(DDX43) c2(NP_061135) c3(2971) c4(29085, 42142, 55199, 16028, 68256) c5(aAZ, co, aX, b, h, J, M, ck, T, aMh, jG); #c1(DDX46) c2(NP_001287789) c3(2972) c4(29086, 42143, 55200, 16029, 68257) c5(bes, JH, b, beq, mk, gE, U, y, ahN, aX, ml, f, O, aYI, u, ber, V, m, aC, v, j, vc, ll, Nh, cI, ao, jR, aE, cH); #c1(DDX4) c2(NP_001136021) c3(2973) c4(29087, 42144, 55201, 16030, 68258) c5(Lg, wV, NT, am, cV, X, jT, Lo, bey, wy, wn, Mu, Lu, av, PX, bbz, fp, wP); #c1(DDX50) c2(NP_076950) c3(2974) c4(29088, 42145, 55202, 16031, 68259) c5(aY); #c1(DDX51) c2(NP_778236) c3(2975) c4(29089, 42146, 55203, 16032, 68260) c5(t, G); #c1(DDX52) c2(NP_008941) c3(2976) c4(29090, 42147, 55204, 16033, 68261) c5(A, B, ac); #c1(DDX53) c2(NP_874358) c3(2977) c4(29091, 42148, 55205, 16034, 68262) c5(by, ml, Gt, b, aFy, A, z, al, U, y, d, qH, aX, re, B, e, q, bu, cU, bh, cB, pt, bv, u, iT, fi, V, cs, dB, bp, gv, jo, T, Gl, ht, oM, x, iA, ad, cW, ck, bm, DO, jR, cz, tl, fl, Sw); #c1(DDX54) c2(NP_001104792) c3(2978) c4(29092, 42149, 55206, 16035, 68263) c5(bm, kF); #c1(DDX56) c2(NP_001244118) c3(2979) c4(29093, 42150, 55207, 16036, 68264) c5(A, b, B, UE, ajf, P, w, C, gE, at); #c1(DDX58) c2(NP_055129) c3(2980) c4(29094, 42151, 55208, 16037, 68265) c5(en, JH, b, X, aiW, mk, w, iL, gE, ER, al, re, m, Ei, aX, DG, kJ, AX, F, hN, dQ, av, aV, aE, iT, awq, da, apx, aC, Dg, gL, P, ll, BL, ajd, jH, hU, aeq, aAu, bez, hT, Oa, UE, fl, fI, DM); #c1(DDX59) c2(NP_001026895) c3(2981) c4(29095, 42152, 55209, 16038, 68266) c5(ahN, beA, Fg); #c1(DDX5) c2(NP_004387) c3(2982) c4(29096, 42153, 55210, 16039, 68267) c5(en, cB, b, X, eG, eI, B, F, fO, gv, jk, A, O, iD, cs, x, bh, al, ad, u, y); #c1(DDX60) c2(NP_060101) c3(2983) c4(29097, 42154, 55211, 16040, 68268) c5(en); #c1(DDX6) c2(NP_004388) c3(2984) c4(29098, 42155, 55212, 16041, 68269) c5(m, dP, aC, eI, aiW, q, gm, T, iv, U, bT, O); #c1(DEAF1) c2(NP_001280563) c3(2985) c4(29099, 42156, 55213, 16042, 68270) c5(dj, f, hW, b, nU, tR, ar, wX, cA, bf, U, aE, cM, aM); #c1(DECI) c2(XP_011517055) c3(2986) c4(29100, 42157, 55214, 16043, 68271) c5(GK, b, dB, ajW, e, y, d, jh, ip, F, q, bu, ik, fy, bm, g, il, by, GB, T, u, GM, ag); #c1(DECRI) c2(NP_001350) c3(2987) c4(29101, 42158, 55215, 16044, 68272) c5(dx, B, pV, dN, bx, dD, sE, w, cO, aw, O, dv, cy, kJ, yS, CK, tE, Hs, TP, aC, du, aez, x, zQ, jE, qt, Dj, aei, hx, ag, bq, ael, asK, td, Kt, X, sF, av, qG, y, co, fm, pp, ml, f, cs, gg, bm, cj, be, ae, HV, v, Dp, alM, bt, ar, baK, py, oo, fw, ji, ci, ap, fn, hV, b, bL, aF, z, ey, beB, bb, fv, avN, gz, q, jV, ajJ, bf, u, dh, o, wR, aAf, I, ir, LR, ad, CM, aZ, jU, ao, acw, iR, eQ, vT, gd, dn, VT, xf, Mp, KG, Ib, A, MZ, k, IW, di, al, sx, m, qs, aX, ob, bj, h, n, qB, aV, cV, sB, dt, P, T, fO, mQ, aM, xk, lc, fP, OA, at, rr); #c1(DEDD) c2(NP_001034801) c3(2988) c4(29102, 42159, 55216, 16045, 68273) c5(hq); #c1(DEF6) c2(NP_071330) c3(2989) c4(29103, 42160, 55217, 16046, 68274) c5(m, at, dB); #c1(DEFA1B) c2(NP_001035965) c3(2990) c4(29104, 42161, 55218, 16047, 68275) c5(cy, Ob, b, f, jG, ar, cA, U, aeC, V); #c1(DEFA3) c2(NP_005208) c3(2991) c4(29105, 42162, 55219, 16048, 68276) c5(Ob, aei, aF, beC, aFy, jV, W, na, P, T, aC); #c1(DEFA4) c2(NP_001916) c3(2992) c4(29106, 42163, 55220, 16049, 68277) c5(fq, aeC, P, pW); #c1(DEFA5) c2(NP_066290) c3(2993) c4(29107, 42164, 55221, 16050, 68278) c5(MS, fl, bx, jd, fq, sH, aFy, gL, tO, W, ig, P, ar, bt, x, fP, jH); #c1(DEFA6) c2(NP_001917) c3(2994) c4(29108, 42165, 55222, 16051, 68279) c5(jH, fq, dB, by, P, fP, x, bu); #c1(DEFB103B) c2(NP_061131) c3(2995) c4(29109, 42166, 55223, 16052, 68280) c5(en, b, bx, yh, ln, ig, e, d, qc, fq, F, baz, pC, cs, Dp, gL, ad, ll, HK, pi, jH, DD); #c1(DEFB104B) c2(NP_001035792) c3(2996) c4(29110, 42167, 55224, 16053, 68281) c5(da, jH, A, jU, im, wG, re, B, m, P, bk, aZ, cs, vl, iT); #c1(DEFB105A) c2(NP_689463) c3(2997) c4(29111, 42168, 55225, 16054, 68282) c5(P); #c1(DEFB106A) c2(NP_689464) c3(2998) c4(29112, 42169, 55226, 16055, 68283) c5(P); #c1(DEFB108B) c2(NP_001002035) c3(2999) c4(29113, 42170, 55227, 16056, 68284) c5(P); #c1(DEFB112) c2(NP_001032587) c3(3000) c4(29114, 42171, 55228, 16057, 68285) c5(ao, dA); #c1(DEFB125) c2(NP_697020) c3(3001) c4(29115, 42172, 55229, 16058, 68286) c5(bq); #c1(DEFB126) c2(NP_112193) c3(3002) c4(29116, 42173, 55230, 16059, 68287) c5(BI, w, jl); #c1(DEFB1) c2(NP_005209) c3(3003) c4(29117, 42174, 55231, 16060, 68288) c5(jo, A, Fk, b, bx, aF, ey, ln, fq, gN, bk, ig, afo, e, al, vl, cM, oy, cy, jd, wG, AX, ak, yh, bu, eE, ago, pC, B, ff, fP, pY, aE, pW, R, da, d, I, jH, sH, dB, J, gL, Dp, bR, Fo, T, lM, bt, by, qe, P, Pw, ata, aoC, aei, ch, bX, axl, beD, tO, aDL, aY, kC, aZ, Bm, tl, dc, I, beE, aA, TP, bT, jU, ku); #c1(DEFB4A) c2(NP_004933) c3(3004) c4(29118, 42175, 55232, 16061, 68289) c5(Zm, oC, e, axx, bx, aF, sE, ud, aFy, IM, Kc, mk, xa, pu, vl, re, al, d, m, Ba, bb, aFd, wG, bX, ak, yh, bu, eE, pC, beE, beG, sd, pB, u, iT, TP, da, wF, V, ae, im, sj, Dp, gL, fq, wL, Zr, Fk, gC, fx, pi, jH, ata, U, P, gd, fP, bk, i, DD, I, bT, rZ); #c1(DEGS1) c2(NP_003667) c3(3005) c4(29119, 42176, 55233, 16062, 68290) c5(A, il, cY, zl, fl, bf, iu, ov, aM); #c1(DEGS2) c2(NP_996801) c3(3006) c4(29120, 42177, 55234, 16063, 68291) c5(do); #c1(DEK) c2(NP_001128181) c3(3007) c4(29121, 42178, 55235, 16064, 68292) c5(b, fr, oa, jz, lp, oU, y, jQ, oy, co, aX, h, f, e, cB, cs, jG, cq, u, yJ, d, ax, aC, J, ad, GB, P, T, ll, x, fx, ft, dH, pk, nJ, cT, i); #c1(DENND1A) c2(NP_065997) c3(3008) c4(29122, 42179, 55236, 16065, 68293) c5(bQ, kF, beH, Nq, cU, Ns, An, at); #c1(DENND1B) c2(NP_001287787) c3(3009) c4(29123, 42180, 55237, 16066, 68294) c5(aA, at, cy, bT, qe); #c1(DENND2A) c2(NP_056504) c3(3010) c4(29124, 42181, 55238, 16067, 68295) c5(ajZ, pk); #c1(DENND4A) c2(NP_001138295) c3(3011) c4(29125, 42182, 55239, 16068, 68296) c5(oy, A, hT, fO, gv, B, bh); #c1(DENR) c2(NP_003668) c3(3012) c4(29126, 42183, 55240, 16069, 68297) c5(c, ao, wK, f, v, dY, IR, IX, IS, Au, ey, bj, dh); #c1(DEPDC1B) c2(NP_001138680) c3(3013) c4(29127, 42184, 55241, 16070, 68298) c5(bL, bU); #c1(DEPDC5) c2(NP_001007189) c3(3014) c4(29128, 42185, 55242, 16071, 68299) c5(FR, q, bel, aOd, hS, iL, z, IL, al, akp); #c1(DEPTOR) c2(NP_073620) c3(3015) c4(29129, 42186, 55243, 16072, 68300) c5(f, b); #c1(DERA) c2(NP_057038) c3(3016) c4(29130, 42187, 55244, 16073, 68301) c5(et); #c1(DERL1) c2(NP_001128143) c3(3017) c4(29131, 42188, 55245, 16074, 68302) c5(Dr, b, pz, hl, ps, y, co, S, t, h, N, Uq, WO, qL, n, fy, bm, cj, FK, Be, Fs, J, fO, pF, G, T, beK, ao, u, ie, bed, Q, ci, pv); #c1(DERL2)

c2(NP_057125) c3(3018) c4(29132, 42189, 55246, 16075, 68303) c5(jB, b, PA, J, beL, by, gL, FF, Em, jT, pz, cl); #c1(DERL3) c2(NP_001002862) c3(3019) c4(29133, 42190, 55247, 16076, 68304) c5(jT, bb, b, dB, K, jo, avS, n, Kw, jx, oU, ff); #c1(DES) c2(NP_001918) c3(3020) c4(29134, 42191, 55248, 16077, 68305) c5(ml, Ir, dB, w, aYv, e, xl, beM, VI, mR, aMO, cc, fe, Gd, Ij, x, hR, fp, wh, aXi, vJ, bq, beO, cO, ahg, U, aWu, arW, y, pw, DG, f, beP, bu, alf, O, cs, iJ, oD, gg, d, V, cK, Bn, beQ, QG, kD, b, AA, aoa, Ag, nU, q, u, aE, cI, sX, qC, j, ad, ao, hU, beN, AG, xP, k, xj, xf, iL, iK, asN, adx, aX, LI, Uq, oJ, WG, HI, kG, cV, Fs, J, dt, dU, T, aoo, cr, fM, sK, alt, Jh, aTs, aWz, At, Af, Yv, at); #c1(DESI2) c2(NP_001284675) c3(3021) c4(29135, 42192, 55249, 16078, 68306) c5(X, av, Eu, b, cs); #c1(DEXI) c2(NP_054734) c3(3022) c4(29136, 42193, 55250, 16079, 68307) c5(fH, h, aV, fJ, aE); #c1(DFFB) c2(XP_011539165) c3(3023) c4(29137, 42194, 55251, 16080, 68308) c5(dx, A, b, eR, eH, vY, id, di, C, bW, U, y, dv, bb, h, q, jV, iZ, tE, aah, akk, u, V, I, cV, sj, xf, du, Fs, cM, P, bp, bq, ZF, jl, nV, dS, aY, bm, vK, ZL, fz, dc, vZ, at, ap); #c1(DFNA5) c2(NP_001120925) c3(3024) c4(29138, 42195, 55252, 16081, 68309) c5(by, beR, aX, V, b, f, cs, bu, na, Bx, U, ad, u, y); #c1(DFNB31) c2(NP_056219) c3(3025) c4(29139, 42196, 55253, 16082, 68310) c5(alH, ns, ow, nm, di, nq, nr, nn, no, np, U, ak, beT, cs, V, nQ, nW, ad, Gg, Nq, na, Ns, beS, Bx, nt); #c1(DFNB59) c2(NP_001036167) c3(3026) c4(29140, 42197, 55254, 16083, 68311) c5(beU, beV, Bx); #c1(DGAT1) c2(NP_036211) c3(3027) c4(29141, 42198, 55255, 16084, 68312) c5(oy, em, I, fN, gE, cx, cO, aA, dL, o); #c1(DGAT2) c2(NP_001240820) c3(3028) c4(29142, 42199, 55256, 16085, 68313) c5(fN, aA, iL); #c1(DGCR2) c2(NP_001167004) c3(3029) c4(29143, 42200, 55257, 16086, 68314) c5(cr, NX, beW, aKz, cV, K, aE, afb, bq, bf, bT, aM); #c1(DGCR6L) c2(NP_150282) c3(3030) c4(29144, 42201, 55258, 16087, 68315) c5(ih, afb, K, cz); #c1(DGCR8) c2(NP_001177255) c3(3031) c4(29145, 42202, 55259, 16088, 68316) c5(ahi, hW, BX, ip, aaz, dB, K, ff, ny, yA, u, y); #c1(DGKA) c2(NP_958853) c3(3032) c4(29146, 42203, 55260, 16089, 68317) c5(aX, nQ, b, q, cU, w, aw, iA, TP); #c1(DGKB) c2(NP_004071) c3(3033) c4(29147, 42204, 55261, 16090, 68318) c5(l, t, aoJ, do, bq, bh, gv); #c1(DGKD) c2(NP_003639) c3(3034) c4(29148, 42205, 55262, 16091, 68319) c5(beY, beX, l, b); #c1(DGKE) c2(NP_003638) c3(3035) c4(29149, 42206, 55263, 16092, 68320) c5(l, vT, aoJ, bh, gv, beZ); #c1(DGKG) c2(NP_001074213) c3(3036) c4(29150, 42207, 55264, 16093, 68321) c5(pk, aA, l, dA); #c1(DGKH) c2(NP_001191433) c3(3037) c4(29151, 42208, 55265, 16094, 68322) c5(vu, ak, o); #c1(DGKI) c2(NP_004708) c3(3038) c4(29152, 42209, 55266, 16095, 68323) c5(cV, jD, yQ, dA); #c1(DGKK) c2(NP_001013764) c3(3039) c4(29153, 42210, 55267, 16096, 68324) c5(bfb, bfa); #c1(DGKQ) c2(NP_001338) c3(3040) c4(29154, 42211, 55268, 16097, 68325) c5(bj, gn, nQ); #c1(DGKZ) c2(NP_001099010) c3(3041) c4(29155, 42212, 55269, 16098, 68326) c5(bq, ad, cs, b, Qm); #c1(DGUOK) c2(NP_550438) c3(3042) c4(29156, 42213, 55270, 16099, 68327) c5(aNN, gB, kW, b, cE, FJ, h, hT, J, bfc, aoJ, ag, awT, ex, I, awQ, bh, FH, oD, gv); #c1(DHCR7) c2(NP_001157289) c3(3043) c4(29157, 42214, 55271, 16100, 68328) c5(dx, A, nF, bff, fa, bfd, ix, al, U, bfe, bQ, nU, q, dW, hG, B, cs, nB, aV, aE, ax, V, I, du, ad, dt, P, dv, QZ, cz, AP, dH, wh, aai, bfg, bh, at, ap); #c1(DHDH) c2(NP_055290) c3(3044) c4(29158, 42215, 55272, 16101, 68329) c5(A, rm, bu, i, l, bh, at); #c1(DHFR) c2(NP_000782) c3(3045) c4(29159, 42216, 55273, 16102, 68330) c5(mZ, IJ, bfh, vg, b, X, sE, iX, eu, Dm, Nq, mk, m, di, sF, tG, Lq, U, ft, G, eV, y, V, c, jl, bfj, aX, i, ni, t, fa, fr, gP, asW, kt, nA, bfi, av, cq, u, sH, cr, g, em, bm, Lf, ae, bau, aC, bK, ajy, iv, J, gL, ad, pr, vc, fl, od, bp, xe, Vd, bb, ya, BV, pi, Ut, pq, jT, fy, cs, eF, Dj, cz, aq, P, Ns, ex, gd, gA, cZ, cB, I, at); #c1(DHFRLI) c2(NP_001182572) c3(3046) c4(29160, 42217, 55274, 16103, 68331) c5(jd); #c1(DHH) c2(NP_066382) c3(3047) c4(29161, 42218, 55275, 16104, 68332) c5(bfk, by, wp, bfo, UZ, Y, bfm, bu, ag, EM, agb, iD, bfl, Kw, bf, bfn, UR, afY, ac, aM); #c1(DHODH) c2(NP_001352) c3(3048) c4(29162, 42219, 55276, 16105, 68333) c5(afy, bfp, aX, gt, ae, aC, ch, be, VX, qt, pP, gl); #c1(DHPS) c2(NP_001193903) c3(3049) c4(29163, 42220, 55277, 16106, 68334) c5(ae, eF, b, TQ, kt, g, bu, gd, P, w, aZ, bf, by, bm, aE, pW, aM); #c1(DHRS11) c2(NP_077284) c3(3050) c4(29164, 42221, 55278, 16107, 68335) c5(bf, A, B); #c1(DHRS2) c2(NP_005785) c3(3051) c4(29165, 42222, 55279, 16108, 68336) c5(en, zE, Pv, f, vQ, ahJ, u, y); #c1(DHRS4) c2(NP_001269916) c3(3052) c4(29166, 42223, 55280, 16109, 68337) c5(d, e); #c1(DHRS7C) c2(NP_001099041) c3(3053) c4(29167, 42224, 55281, 16110, 68338) c5(cO); #c1(DHRS9) c2(NP_001276692) c3(3054) c4(29168, 42225, 55282, 16111, 68339) c5(A, er, gL, hS, T, B, pN, u, y); #c1(DHTKDI) c2(NP_061176) c3(3055) c4(29169, 42226, 55283, 16112, 68340) c5(bfr, bfq, cN); #c1(DHX15) c2(NP_001349) c3(3056) c4(29170, 42227, 55284, 16113, 68341) c5(QD, by, aOQ, iL, aYI, bu); #c1(DHX16) c2(NP_001157711) c3(3057) c4(29171, 42228, 55285, 16114, 68342) c5(bes, JH, b, beq, mk, gE, U, y, ahN, aX, ae, ml, f, O, aV, u, her, V, I, m, aC, nW, v, j, vc, ll, Nh, cl, eJ, ao, aYI, aVR, jR, aE, cH, fD); #c1(DHX32) c2(NP_060650) c3(3058) c4(29172, 42229, 55286, 16115, 68343) c5(jT, V, b, t, J, G, U, at); #c1(DHX34) c2(NP_055496) c3(3059) c4(29173, 42230, 55287, 16116, 68344) c5(aOQ, cy, at, bb); #c1(DHX36) c2(NP_001107869) c3(3060) c4(29174, 42231, 55288, 16117, 68345) c5(U, u, V, y); #c1(DHX38) c2(NP_054722) c3(3061) c4(29175, 42232, 55289, 16118, 68346) c5(nW, bfs); #c1(DHX40) c2(NP_001159773) c3(3062) c4(29176, 42233, 55290, 16119, 68347) c5(b, aC, lc, cs, ad, eH, aM, bW, bf, aV, dh, aO, ap); #c1(DHX58) c2(NP_077024) c3(3063) c4(29177, 42234, 55291, 16120, 68348) c5(en, aFj, ll, aV, vQ); #c1(DHX8) c2(NP_001289552) c3(3064) c4(29178, 42235, 55292, 16121, 68349) c5(aOQ, cy, at, bb); #c1(DHX9) c2(NP_001348) c3(3065) c4(29179, 42236, 55293, 16122, 68350) c5(bft, en, BL, cV, lb, AX, mW, m, jV, ll, wU, jT, u, gl, y); #c1(DIABLO) c2(NP_001265233) c3(3066) c4(29180, 42237, 55294, 16123, 68351) c5(A, aw, b, X, yh, dB, wn, xa, e, y, d, jh, co, aX, wP, h, f, F, q, fJ, fr, ik, O, cs, ar, av, fy, u, iT, fh, fU, si, il, cV, Bs, fO, ad, dt, hl, T, fH, x, ft, Yp, cW, wV, bm, bfu, re); #c1(DIAPH1) c2(NP_001073280) c3(3067) c4(29181, 42238, 55295, 16124, 68352) c5(aX, V, b, bfv, cs, eu, J, Bx, axD, U, ad, fM, aOO); #c1(DIAPH2) c2(NP_006720) c3(3068) c4(29182, 42239, 55296, 16125, 68353) c5(g, bfw, qi, agc, Lw, jw, Ap, aW); #c1(DIAPH3) c2(NP_001035982) c3(3069) c4(29183, 42240, 55297, 16126, 68354) c5(BO, bfx, X, cz, cO, av, o); #c1(DICERI) c2(NP_001182502) c3(3070) c4(29184, 42241, 55298, 16127, 68355) c5(jp, aw, gG, jt, dB, O, cp, bfB, fH, Uy, n, fe, bfE, nV, fx, Yp, bfD, BX, K, OJ, cT, i, aA, bfA, fl, X, wy, U, y, yV, co, rY, ip, f, bu, cs, av, fy, cj, V, anD, yF, ny, iA, fJ, QG, jR, Le, iu, ci, hV, b, bfC, ic, Em, nU, q, ar, ff, u, NT, I, ad, bfz, gQ, KK, hX, A, adK, iL, bfE, aOx, aW, aOy, S, h, F, cU, ans, cB, aq, bfG, LK, cV, J, T, aX, by, bfy, eG); #c1(DIDO1) c2(NP_071388) c3(3071) c4(29185, 42242, 55299, 16128, 68356) c5(bb, b, sG, pR, hV, jo, ff, aX, iu, o, n); #c1(DIEXF) c2(NP_055203) c3(3072) c4(29186, 42243, 55300, 16129, 68357) c5(sZ, tj); #c1(DIP2A) c2(NP_001139587) c3(3073) c4(29187, 42244, 55301, 16130, 68358) c5(vY, bb); #c1(DIP2B) c2(NP_775873) c3(3074) c4(29188, 42245, 55302, 16131, 68359) c5(bfH, aaz, nU); #c1(DIP2C) c2(NP_055789) c3(3075) c4(29189, 42246, 55303, 16132, 68360) c5(bq, fU, bb, o); #c1(DIRAS1) c2(NP_660156) c3(3076) c4(29190, 42247, 55304, 16133, 68361) c5(jh, apx, k, P, w, ajd, O); #c1(DIRAS2) c2(NP_060064) c3(3077) c4(29191, 42248, 55305, 16134, 68362) c5(at); #c1(DIRC1) c2(XP_011508847) c3(3078) c4(29192, 42249, 55306, 16135, 68363) c5(ff, b); #c1(DIRC2) c2(NP_116228) c3(3079) c4(29193, 42250, 55307, 16136, 68364) c5(jo, T, ff, dB); #c1(DIS3) c2(NP_001121698) c3(3080) c4(29194, 42251, 55308, 16137, 68365) c5(fe, V, b, hB, fO, W, T, U); #c1(DIS3L2) c2(NP_001244210) c3(3081) c4(29195, 42252, 55309, 16138, 68366) c5(fe, b); #c1(DIS3L) c2(NP_001137160) c3(3082) c4(29196, 42253, 55310, 16139, 68367) c5(aW); #c1(DISC1) c2(NP_001012975) c3(3083) c4(29197, 42254, 55311, 16140, 68368) c5(nU, td, FE, eH, ak, bfK, cA, xw, cM, bfJ, wZ, ahq, wr, f, vu, aNK, oN, jN, bfl, dj, hW, cV, Ib, bK, cz, bfL, bdw, jv, to, ao, hy, aY, tW, hT, he, cT, o, dc, bq, RB); #c1(DISP1) c2(NP_116279) c3(3084) c4(29198, 42255, 55312, 16141, 68369) c5(fy, aai); #c1(DIXDC1) c2(NP_001033043) c3(3085) c4(29199, 42256, 55313, 16142, 68370) c5(co, b, aY, cs, ad, T, qO, dc, U, cM); #c1(DKC1) c2(NP_001354) c3(3086) c4(29200, 42257, 55314, 16143, 68371) c5(wU, sn, aX, b, yE, aXd, h, bfM, eM, q, J, pr, A, mg, B, Nh, aYf, u, ss, y); #c1(DKK1) c2(NP_036374) c3(3087) c4(29201, 42258, 55315, 16144, 68372) c5(B, dB, aN, w, aK, O, cp, bQ, cy, kJ, gl, g, fe, aC, afh, fO, ft, od, x, ag, dc, pt, hT, bS, LD, afD, kY, U, cM, co, pp, bfO, ml, f, bu, cs, iJ, fy, iT, jB, ali, V, Bu, v, aY, jR, oM, bfN, ap, b, zH, z, ey, re, hV, q, jV, es, X, ar, ff, fv, u, o, fh, il, atr, j, ad, bfP, iO, afj, nV, aJA, agQ, Bt, dn, Mp, A, sO, fr, mW, og, bZ, m, aX, T, h, ik, y, nA, LR, cV, Zg, J, jo, ato, by, ac, mb, hq, AR, zM, eG); #c1(DKK2) c2(NP_055236) c3(3088) c4(29202, 42259, 55316, 16145, 68373) c5(aX, b, dB, q, es, bbb, ag, jo, ff, rb, av, O); #c1(DKK3) c2(XP_006718241) c3(3089) c4(29203, 42260, 55317, 16146, 68374) c5(f, b, k, X, Lv, pR, dB, w, dV, iG, O, bw, U, A, fx, y, d, aX, apx, Tq, apG, ajd, re, hV, e, q, zY, bu, cU, fr, dZ, ar, B, cs, av, fy, u, iT, ff, jB, og, V, nQ, cV, bp, ad, W, jo, T, iA, by, et, G, nV, ck, bm, P, jR, ag, i); #c1(DKK4) c2(XP_011542791) c3(3090) c4(29204, 42261, 55318, 16147, 68375) c5(m, ali, V, b, bm, dB, q, ad, ff, dn, cs, x, U, u); #c1(DKKL1) c2(NP_001184230) c3(3091) c4(29205, 42262, 55319, 16148, 68376) c5(aV); #c1(DLAT) c2(NP_001922) c3(3092) c4(29206, 42263, 55320, 16149, 68377) c5(tr, mW, bfR, C, ot, xe, m, h, Pc, gI, Gl, sH, nI, j, aNO, Wp, dL, bfQ, qT, fN, kh, bY, tO, gR, aA, at, bT); #c1(DLC1) c2(NP_006085) c3(3093) c4(29207, 42264, 55321, 16150, 68378) c5(jK, A, aw, b, X, dB, jc, iL, U, adr, y, BO, co, bb, il, kJ, jd, f, F, q, bu, jT, B, cs, av, fy, u, is, V, I, bp, ad, T, fO, x, jl, by, jE, bm, acj, jR, aAN, at); #c1(DLD) c2(NP_000099) c3(3094) c4(29208, 42265, 55322, 16151, 68379) c5(ake, KC, nU, aw, adn, b, fi, aF, arQ, ady, eu, KF, agx, U, OH, V, arR, co, pp, f, pu, gX, sL, mg, cs, as, fy, bfT, bfS, o, em, fs, bfU, an, awD, ad, dt, CM, T, eq, x, ct, aNO, baL, jH, ao, baK, dh); #c1(DLEC1) c2(NP_031361) c3(3095) c4(29209, 42266, 55323, 16152, 68380) c5(GK, A, aw, b, X, dB, jc, GM, iL, adr, e, y, d, jT, jI, ip, kJ, jd, f, F, q, bu, ik, B, cs, fy, bm, ff, is, bp, ad, GB, T, fO, by, jE, u, acj, jR, aAN); #c1(DLEU7) c2(NP_945340) c3(3096) c4(29210, 42267, 55324, 16153, 68381) c5(ao, aC, t, Ic, G, es, W, mk, cT, di, adh, Tk, at); #c1(DLG1) c2(NP_001191315) c3(3097) c4(29211, 42268, 55325, 16154, 68382) c5(bP, hW, vz, bfV, tW, jz, Nq, sJ, aiL, x, bf, bj, iT, jQ); #c1(DLG2) c2(NP_001136172) c3(3098) c4(29212, 42269, 55326, 16155, 68383) c5(m, aX, u, bj, WO, ff, qO, cO, bb, hW, bq); #c1(DLG3) c2(NP_001159750) c3(3099) c4(29213, 42270, 55327, 16156, 68384) c5(dj, nU, aw, b, FR, nx, nz, hT, nw, qP, cz, dt, bfW, w, ak, bK, cA, bM, KK, et); #c1(DLG4) c2(NP_001122299) c3(3100) c4(29214, 42271, 55328, 16157, 68385) c5(hS, cA, si, bj, Wk, ak, iZ, qu, o, Yk, dj, kF, cV, v, cz, aFE, alM, rV, pk, HN, fw, bfX, ih); #c1(DLG5) c2(NP_004738) c3(3101) c4(29215, 42272, 55329, 16158, 68386) c5(oy, jH, gC, V, kJ, aC, rr, alV, ig, fP, bw, vt); #c1(DLGAP1) c2(NP_001003809) c3(3102) c4(29216, 42273, 55330, 16159, 68387) c5(qf, dA, cV, ao, Eo, cO, at); #c1(DLGAP2) c2(XP_011533064) c3(3103) c4(29217, 42274, 55331, 16160, 68388) c5(aIX, aPZ, cz); #c1(DLGAP3) c2(XP_011540181) c3(3104) c4(29218, 42275, 55332, 16161, 68389) c5(nV, pw, bu, w, zb, qu, rV, by, O); #c1(DLGAP5) c2(NP_001139487) c3(3105) c4(29219, 42276, 55333, 16162, 68390) c5(A, aw, V, b, cV, jk, B, jz, q, sJ, fI, aiL, i, U, jQ, fx, vz); #c1(DLK1) c2(NP_003827) c3(3106) c4(29220, 42277, 55334, 16163, 68391) c5(g, jK, A, b, kN, Pv, jj, apC, eu, ig, w, di, lv, sN, pz, eV, O, m, QG, jT, cy, bfZ, Tq, mF, SQ, h, B, q, n, bu, hN, ff, cs, XH, FG, bm, aE, jH, cl, cj, iF, jB, fe, G, bfY, aC, nW, jG, dB, gm, j, J, bR, jo, T, jV, cV, pt, mQ, by, Nx, RV, rr, Hy, jE, qp, SH, aLQ, bX, P, fP, iw, mD, yE, CL, Bm, rv, bq, oM, aA, ci, pv); #c1(DLL1) c2(XP_011534060) c3(3107) c4(29221, 42278, 55335, 16164, 68392) c5(en, dB, bgd, O, cy, t, yh, g, aqQ, iw, aC, nW, iv, jT, bgc, aai, ie, sN, cT, aA, bgf, jB, ig, bcR, cM, co, rr, aDD, bu, bgb, cs, pP, aew, cj, bga, RV, SH, jo, Nx, ci, adJ, b, Pv, jJ, eV, ra, ff, jG, u, dh, o, I, j, ad, G, jH, aLQ, Ck, ih, CL, Bm, bge, adK, EN, di, lv, iL, awa, aX, SQ, h, M, hN, n, aV, dj, m, J, P, T, II, mQ, by, Y, fP, pI); #c1(DLL3) c2(NP_058637) c3(3108) c4(29222, 42279, 55336, 16165, 68393) c5(b, k, oH, ig, O, y, Wj, t, AY, q, aOg, Gs, ff, mR, u, n, Q, bga, fO, aoN, T, zS, AP, rM, qt, qN, bgg, G, cC, cT, agc, fI, lG, h); #c1(DLL4) c2(NP_061947) c3(3109) c4(29223, 42280, 55337, 16166, 68394) c5(mZ, A, b, X, pR, z, i, O, hS, w, jj, C, cO, U, y, kf, co, yG, kJ, t, h, B, bu, aMN, IY, bgf, ff, cs, av, aV, u, em, fU, kF, V, hZ, nz, afh, J, ad, dU, jo, bQ, T, II, x, fx, by, afj, qT, Jd, fy, Eu, fN, yC, akT, jR, bcR, ag, cZ, od, iu); #c1(DLST) c2(NP_001924) c3(3110) c4(29224, 42281, 55338, 16167, 68395) c5(GC, v, o, bT); #c1(DLX1) c2(NP_001033582) c3(3111) c4(29225, 42282, 55339, 16168, 68396) c5(rQ, Wk, ak, he, cz, hS, AP); #c1(DLX2) c2(NP_004396) c3(3112) c4(29226, 42283, 55340, 16169, 68397) c5(anJ, b, anI, AP, f, cz, hS, G, u, y); #c1(DLX3) c2(NP_005211) c3(3113) c4(29227, 42284, 55341, 16170, 68398) c5(Ur, od, bgh, pU, bgi); #c1(DLX4) c2(NP_612138) c3(3114) c4(29228, 42285, 55342, 16171, 68399) c5(d, A, X, ak, e, Ck, pU, J, ih, od, bp, th, av, jv, u, aT, y); #c1(DLX5) c2(NP_005212) c3(3115) c4(29229, 42286, 55343, 16172, 68400) c5(Al, b, X, jw, y, co, arl, av, fy, u, Qx, bgj, wp, bp, cz, bgk, Cf, jT, AP, aPc, Nq, na); #c1(DLX6) c2(NP_005213) c3(3116) c4(29230, 42287, 55344, 16173, 68401) c5(bgj, atj, arl, wp, Nq, cz, aPc, Cf, jw, AP, Qx); #c1(DMBT1) c2(NP_004397) c3(3117) c4(29231, 42288, 55345, 16174, 68402) c5(gG, by, A, b, k, Mj, gw, ud, q, O, w, ku, iL, z, U, hP, e, y, d, E, Fp, co, aX, ag, Mn, f, DC, bu, Mr, aFA, ar, B, cs, bgm, fy, u, dh, g, sE, V, cV, C, qJ, Fs, jU, gv, W, P, T, lo, x, fx, ad, fU, jH, bgn, jR, aE, bgl, kC, qP, fP, i, bh, yA, bT, ap); #c1(DMC1) c2(NP_008999) c3(3118) c4(29232, 42289, 55346, 16175, 68403) c5(NT, b, wn, jw, Ap, u, y); #c1(DMD) c2(NP_000100) c3(3119) c4(29233, 42290, 55347, 16176, 68404) c5(dx, WE, ml, aw, Rx, bgA, arn, cO, bf, arE, xI, cp, dv, kz, mR, si, cc, g, arp, aC, nI, afh, yz, hR, OA, f, ark, mE, bgr, ag, cT, bk, WB, id, bgq, oH, ig, H, kG, xw, co, BL, aeh, pp, Ks, ak, O, oD, av, afL, yJ, dA, v, cK, pk, Rz, bgB, QG, fK, bgv, PK, fn, b, ayE, AA, dk, aeP, yU, aoa, aeQ, qf, bgz, oB, nU, arm, bgp, as, Jm, dh, lk, kF, I, eI, aDv, bgs, aFj, mm, gH, rO, afj, bgu, ao, VQ, amJ, ahe, xP, Au, di, BK, iG, gd, zF, gw, ds, arc, jw, iK, c, aX, wp, kn, ajc, bgt, tF, cg, arh, HP, dj, du, hW, nQ, an, mc, BC, dt, ll, aoo, bgw, aro, fM, aM, arq, bgy, aWz, At, bgo, at, lk, bgx); #c1(DMGDH) c2(NP_037523) c3(3120) c4(29234, 42291, 55348, 16177, 68405) c5(oy, ni, bgC, Nq, Ns, at); #c1(DMKN) c2(NP_001030593) c3(3121) c4(29235, 42292, 55349, 16178, 68406) c5(d, aen, mk, x, U, e, V); #c1(DMPI) c2(NP_001073380) c3(3122) c4(29236, 42293, 55350, 16179, 68407) c5(AQ, e, y, oy, QV, co, awi, bfO, amK, ar, AO, fy, u, d, po, bp, T, iD, x, jT, AR, kC, arA, amL); #c1(DMPK) c2(NP_001075029) c3(3123) c4(29237, 42294, 55351, 16180, 68408) c5(dx, nU, aIN, AA, ig, bf, kV, xI, aao, KA, f, VI, mg, awS, oD, hj, sK, aPs, cc, si, el, du, afB, dt, mX, bgD, US, aPt, wn, ex, xP, fY, bgE); #c1 (DMRTI) c2(NP_068770) c3(3124) c4(29238, 42295, 55352, 16181, 68409) c5(A, Rr, Lv, wy, bey, ck, aAM, Lr, yK, bb, aNA, aNC, QJ, UR, dh, fh, wp, bgE, sB, sf, T, Lt, pq, wV, Ck, wP, yM, ap); #c1(DMRT2) c2(XP_006716781) c3(3125) c4(29239, 42296, 55353, 16182, 68410) c5(jh); #c1(DMRT3) c2(NP_067063) c3(3126) c4(29240, 42297, 55354, 16183, 68411) c5(PX, bK, q, wy, hl, QJ); #c1 (DMRTAI) c2(NP_071443) c3(3127) c4(29241, 42298, 55355, 16184, 68412) c5(bbg, oy, bu, Eo, dA); #c1(DMTFI) c2(NP_001135798) c3(3128) c4(29242, 42299, 55356, 16185, 68413) c5(QV, jT, co, awi, bfO, amK, ak, po, bp, AR, T, y, arA, AQ, fy, u, AO, amL); #c1(DMTN) c2(NP_001107611) c3(3129) c4(29243, 42300, 55357, 16186, 68414) c5(aU, pq); #c1(DMWD) c2(NP_004934) c3(3130) c4(29244, 42301, 55358, 16187, 68415) c5(el, NT, am); #c1(DMXLI) c2(NP_001277250) c3(3131) c4(29245, 42302, 55359, 16188, 68416) c5(w, er, O); #c1(DMXL2) c2(NP_001167587) c3(3132) c4(29246, 42303, 55360, 16189, 68417) c5(cy, ap, bq, bb, at, fh); #c1(DNA2) c2(NP_001073918) c3(3133) c4(29247, 42304, 55361, 16190, 68418) c5(aNN, bgG, f, J, avF, P, pt, i, oD, oM, WS, Mr); #c1(DNAAFI) c2(NP_848547) c3(3134) c4(29248, 42305, 55362, 16191, 68419) c5(bgH, xc, Pu, aCg, MW, Nz); #c1(DNAAF2) c2(NP_001077377) c3(3135) c4(29249, 42306, 55363, 16192, 68420) c5(bgl); #c1 (DNAAF3) c2(NP_001243643) c3(3136) c4(29250, 42307, 55364, 16193, 68421) c5(aaQ, Pu, b, cV, Mi, MW, DT, fO, eo, bgJ, cz, cU, VE, amo, CL, bgK, xw, vt, iA, o); #c1 (DNAAF5) c2(NP_060272) c3(3137) c4(29251, 42308, 55365, 16194, 68422) c5(MW, Pu, bgL); #c1(DNAHI2) c2(NP_001264044) c3(3138) c4(29252, 42309, 55366, 16195, 68423) c5(Pu, ZR, hT, fO, MW, bgM, aem, aXS, CI, at, bgN, fW, o); #c1(DNAHI2) c2(NP_001278590) c3(3139) c4(29253, 42310, 55367, 16196, 68424) c5(A, bb); #c1(DNAHI7) c2(NP_775899) c3(3140) c4(29254, 42311, 55368, 16197, 68425) c5(MW, vt); #c1(DNAH1) c2(NP_056327) c3(3141) c4(29255, 42312, 55369, 16198, 68426) c5(MW); #c1(DNAH2) c2(NP_001290199) c3(3142) c4(29256, 42313, 55370, 16199, 68427) c5(aE); #c1(DNAH3) c2(NP_060009) c3(3143) c4(29257, 42314, 55371, 16200, 68428) c5(MW, vt); #c1(DNAH5) c2(NP_001360) c3(3144) c4(29258, 42315, 55372, 16201, 68429) c5(oy, Pu, cy, ZR, Mi, aCb, DT, fO, MW, bgO, VE, amo, aYQ, bgK, Mw, vt); #c1(DNAH6) c2(NP_001361) c3(3145) c4(29259, 42316, 55373, 16202, 68430) c5(dA) #c1(DNAH7) c2(NP_061720) c3(3146) c4(29260, 42317, 55374, 16203, 68431) c5(Eo, MW, cV); #c1(DNAH8) c2(NP_001193856) c3(3147) c4(29261, 42318, 55375, 16204, 68432) c5(akC, akQ, ml, dN, sE, iU, vB, aoJ, HC, nm, dd, ak, cO, Ux, bf, ajf, e, O, hR, am, gB, mR, IV, Qx, mz, asd, KH, bK, nW, bgW, fO, lq, akr, bN, JT, vc, x, bgQ, akK, Oz, mO, f, aaz, mB, mE, fc, cT, bk, xf, cB, bq, aA, bT, bS, kN, aiV, dE, ag, mk, pd, bo, U, alp, y, tp, co, gd, Mw, ml, lw, bu, B, qq, cs, fB, oD, gg, fy, bm, me, fd, V, ae, cJ, NZ, v, JY, akg, bt, bB, VP, cK, Bn, akc, aCK, W, sK, aYm, akA, er, fK, ajg, ap, ake, b, PC, akO, m, z, ey, eV, d, xi, bb, kW, akJ, vf, bgR, q, akP, bgP, mL, hb, aYK, Wy, u, dh, o, aly, bU, vD, bgS, el, LR, ad, akq, akw, aPY, jH, qs, Eu, alm, ayz, ov, na, xP, Bm, D, yA, Lq, A, bE, qd, bZ, sv, di, alu, gE, bgU, aks, aW, oy, c, baV, aX, I, bj, h, F, akl, aYv, ik, aE, Jf, p, aq, dj, xc, tP, bC, XC, akd, akH, J, dt, T, bp, ji, cr, gF, by, aM, wU, jT, ii, Y, TU, zl, bgV, bgT, At, sp, rw, bM, at); #c1(DNAH9) c2(NP_001363) c3(3148) c4(29262, 42319, 55376, 16205, 68433) c5(Bt, Bu, Pu, MW, eO); #c1(DNAI1) c2(NP_036276) c3(3149) c4(29263, 42320, 55377, 16206, 68434) c5(Pu, jl, aeq, ZR, Mi, DT, fO, MW, VE, n, amo, CI, bgK, Ap, vt, ci, jw); #c1(DNAI2) c2(NP_001166281) c3(3150) c4(29264, 42321, 55378, 16207, 68435) c5(MW, bgX, Pu, dQ, ll); #c1(DNAJA1) c2(NP_001530) c3(3151) c4(29265, 42322, 55379, 16208, 68436) c5(bw, m, Kz, aw, apz); #c1(DNAJA2) c2(NP_005871) c3(3152) c4(29266, 42323, 55380, 16209, 68437) c5(X, aC, av, f, z); #c1 (DNAJA3) c2(NP_001128582) c3(3153) c4(29267, 42324, 55381, 16210, 68438) c5(b, X, xQ, mR, et, u, O); #c1 (DNAJBI1) c2(NP_057390) c3(3154) c4(29268, 42325, 55382, 16211, 68439) c5(X, av); #c1(DNAJBI3) c2(NP_705842) c3(3155) c4(29269, 42326, 55383, 16212, 68440) c5(do); #c1(DNAJB1) c2(NP_001287843) c3(3156) c4(29270, 42327, 55384, 16213, 68441) c5(oC, f, Hv, dB, ck, iL, bQ, cy, ak, q, Kz, mR, fy, bm, kG, ae, jH, v, gL, KL, bcL, IX, IR, IS, fl); #c1(DNAJB2) c2(NP_001034639) c3(3157) c4(29271, 42328, 55385, 16214, 68442) c5(c, ao, si, cN, Y, qZ, v, bgY, cH, Kz, afw, oD); #c1(DNAJB5) c2(NP_001128476) c3(3158) c4(29272, 42329, 55386, 16215, 68443) c5(jH); #c1(DNAJB6) c2(NP_005485) c3(3159) c4(29273, 42330, 55387, 16216, 68444) c5(aX bgZ, f, kG, X, aC, oD, av, u); #c1(DNAJB7) c2(NP_660157) c3(3160) c4(29274, 42331, 55388, 16217, 68445) c5(d, b, mb, F, eu, e, rR, cs, re); #c1(DNAJB8) c2(NP_699161) c3(3161) c4(29275, 42332, 55389, 16218, 68446) c5(ck, V, dB, ad, cs, U); #c1(DNAJB9) c2(NP_036460) c3(3162) c4(29276, 42333, 55390, 16219, 68447) c5(sX, f, hT); #c1(DNAJC10) c2(NP_001258510) c3(3163) c4(29277, 42334, 55391, 16220, 68448) c5(fI, b, cV, f, q, v, A); #c1(DNAJC12) c2(NP_068572) c3(3164) c4(29278, 42335, 55392, 16221, 68449) c5(o); #c1(DNAJC13) c2(NP_056083) c3(3165) c4(29279, 42336, 55393, 16222, 68450) c5(bj, at, u, y); #c1(DNAJC14) c2(NP_115740) c3(3166) c4(29280, 42337, 55394, 16223, 68451) c5(X, aC, av, f); #c1(DNAJC15) c2(NP_037370) c3(3167) c4(29281, 42338, 55395, 16224, 68452) c5(g, aX, b, X, jq, jR, bu, av, by, u, y); #c1(DNAJC18) c2(NP_689899) c3(3168) c4(29282, 42339, 55396, 16225, 68453) c5(l, n, i); #c1 (DNAJC19) c2(NP_660304) c3(3169) c4(29283, 42340, 55397, 16226, 68454) c5(dt, bha, hR, mR, cK); #c1 (DNAJC1) c2(NP_071760) c3(3170) c4(29284, 42341, 55398, 16227, 68455) c5(bb, bj, aX); #c1(DNAJC27) c2(NP_057628) c3(3171) c4(29285, 42342, 55399, 16228, 68456) c5(aA, hP); #c1(DNAJC28) c2(NP_060303) c3(3172) c4(29286, 42343, 55400, 16229, 68457) c5(aX); #c1(DNAJC2) c2(NP_001123359) c3(3173) c4(29287, 42344, 55401, 16230, 68458) c5(d, b, h, J, jG, e); #c1 (DNAJC3) c2(NP_006251) c3(3174) c4(29288, 42345, 55402, 16231, 68459) c5(A, q, V); #c1(DNAJC5)

c2(NP_079495) c3(3175) c4(29289, 42346, 55403, 16232, 68460) c5(apU, bhb, aPZ, b, fy, aPX, kt, nU, v, ih, sp, Gr, T, aPe, bK, aQa, aPY, u, y); #c1(DNAJC7) c2(NP_001138238) c3(3176) c4(29290, 42347, 55404, 16233, 68461) c5(P); #c1(DNALI) c2(NP_113615) c3(3177) c4(29291, 42348, 55405, 16234, 68462) c5(MW, bhc); #c1(DNASEI) c2(XP_011520696) c3(3178) c4(29292, 42349, 55406, 16235, 68463) c5(bm, f, iq, b, cO, m, id, di, Vy, z, vp, U, A, fD, y, awa, jT, aVK, aFH, q, B, cs, u, gl, fe, yV, cV, aC, J, ad, P, aZ, qt, by, iz, if, hU, pP, ag, bk, rv, bq, iu, sU); #c1(DNASEIL2) c2(NP_001288609) c3(3179) c4(29293, 42350, 55407, 16236, 68464) c5(A); #c1(DNASEIL3) c2(NP_001243489) c3(3180) c4(29294, 42351, 55408, 16237, 68465) c5(bhf, jT, rQ, m, fr, ft, tW, bp, he, cz, ep, aC, bhd, qu, O, ajR, wz, bhe, cM); #c1(DNASE2B) c2(XP_011540180) c3(3181) c4(29295, 42352, 55409, 16238, 68466) c5(al); #c1(DNASE2) c2(NP_001366) c3(3182) c4(29296, 42353, 55410, 16239, 68467) c5(m, aC, pi, dh, et, gl); #c1(DNDI) c2(NP_919225) c3(3183) c4(29297, 42354, 55411, 16240, 68468) c5(Lr, ck, wy); #c1(DNER) c2(NP_620711) c3(3184) c4(29298, 42355, 55412, 16241, 68469) c5(dx, b, dv, Kt, I, cV, t, h, du, J, fO, P, jR, cO, G); #c1(DNHDI) c2(NP_653267) c3(3185) c4(29299, 42356, 55413, 16242, 68470) c5(dB); #c1 (DNLZ) c2(NP_001074318) c3(3186) c4(29300, 42357, 55414, 16243, 68471) c5(GD, b, gG, Dm, iL, bf, rY, re, q, rR, bm, iT, oP, jB, apx, cV, P, aM, jE, fI, Ez, ja); #c1(DNMI) c2(NP_001005336) c3(3187) c4(29301, 42358, 55415, 16244, 68472) c5(Yk, cG, lC, bK, hT, fN, wz, Qx, hS, aTR, dL, CG, o); #c1(DNMIL) c2(NP_001265392) c3(3188) c4(29302, 42359, 55416, 16245, 68473) c5(A, SS, bhg, lW, ey, bj, e, y, d, b, f, ar, B, fy, u, dh, o, awS, wK, v, Oc, lX, QZ, lR, ao, pQ, lS, Au, at); #c1(DNM2) c2(NP_001005360) c3(3189) c4(29303, 42360, 55417, 16246, 68474) c5(bhI, by, gk, aw, b, Rx, akL, lW, cW, jH, AA, w, W, VI, iL, cO, bf, O, A, aTI, y, bL, qs, bhk, cN, cb, Vj, re, f, q, hV, bu, bhj, hN, mR, B, bK, bw, asa, u, o, cc, bhn, em, Am, ayv, ac, nl, cs, v, gL, ad, bhm, P, PL, T, BW, bhi, oD, k, xP, mO, aM, bhh, dt, ao, amy, Y, aiy, jR, iw, At, ag, cH, di, at, cG, Vi); #c1(DNM3) c2(NP_001129599) c3(3190) c4(29304, 42361, 55418, 16247, 68475) c5(fG, yh, aeU, b, bo); #c1(DNMBP) c2(NP_056036) c3(3191) c4(29305, 42362, 55419, 16248, 68476) c5(o); #c1(DNMTI) c2(NP_001124295) c3(3192) c4(29306, 42363, 55420, 16249, 68477) c5(jp, IJ, ml, aw, gG, dB, w, cO, e, O, arY, cy, b, kJ, fp, do, gl, oJ, bho, aC, cs, wV, bp, od, x, fx, jT, av, wh, f, hD, ag, cT, i, gk, bS, kN, X, iP, LM, hS, cA, U, cM, co, js, yE, ak, vQ, bu, B, iv, gg, fy, bm, iT, if, V, jh, v, gv, iA, aaa, er, jR, bhq, ck, am, bg, wn, oi, aFh, FG, d, Ag, jd, re, q, vu, ar, n, jG, iR, NT, I, qL, Fw, LR, j, ad, ct, cW, ao, PL, RS, u, he, ih, wP, A, Lv, pR, mW, iL, m, cr, bhp, fq, h, F, qr, cU, iZ, y, cB, nA, dj, hW, Be, J, T, ll, aX, by, WS, Jh, fP, bh, eG); #c1(DNMT3A) c2(NP_715640) c3(3193) c4(29307, 42364, 55421, 16250, 68478) c5(lJ, A, jT, b, X, jL, dB, mW, hS, w, oR, lv, iL, ct, U, re, ps, e, Ld, d, m, co, cr, wh, pp, t, h, nU, zh, q, vQ, bu, iZ, ik, y, cB, iv, sR, av, fy, u, gI, iT, oJ, fe, V, il, hf, jG, J, bp, gv, G, T, fO, jl, fx, oV, AP, FG, HL, ao, jV, n, iR, zX, by, ag, xr, i, bh, eG, ci); #c1(DNMT3B) c2(NP_001193984) c3(3194) c4(29308, 42365, 55422, 16251, 68479) c5(aeB, gG, dB, alO, ct, e, az, b, kJ, gI, g, aC, fO, gm, bp, Ce, x, jT, fp, BX, ag, cT, bk, X, cA, U, cM, tp, co, pw, pp, B, vQ, bu, Em, cs, av, fy, bm, iT, is, fi, V, gv, ny, iA, W, aaa, jR, qO, ji, am, bhr, au, d, re, nU, q, vu, ar, HE, jG, iR, il, gL, by, CM, rO, wV, u, Bg, zX, ih, wP, A, mW, m, cr, h, F, cU, ik, y, cB, aq, jN, dj, fU, hW, cV, dt, P, T, ll, aX, ad, AP, to, ip, Af, iB, bh, eG); #c1(DNMT3L) c2(NP_787063) c3(3195) c4(29309, 42366, 55423, 16252, 68480) c5(arY, wV, am, b, wP, h, FE, wn, PM, av, fp, n); #c1(DNPEP) c2(NP_036232) c3(3196) c4(29310, 42367, 55424, 16253, 68481) c5(aw, b, i, hS, U, fx, iK, co, F, apw, bu, fB, fy, iF, V, BC, gm, fO, by, T, J, jT, VF, eQ, vU, cT, E); #c1(DNTT) c2(NP_001017520) c3(3197) c4(29311, 42368, 55425, 16254, 68482) c5(ak, ahS, jJ, A, di, m, Mw, cy, yQ, zo, h, f, mR, B, oO, aE, zb, aC, J, cz, ahO, jv, rQ, acw, Nq, fP, aA, at, iu); #c1(DOC2A) c2(XP_011544277) c3(3198) c4(29312, 42369, 55426, 16255, 68483) c5(A, Dd, b, X, iR, B, do, cz, BY, T, i, od, av, ZU, aol, fx); #c1(DOC2B) c2(NP_003576) c3(3199) c4(29313, 42370, 55427, 16256, 68484) c5(re, jD, iT); #c1(DOCK10) c2(NP_001277192) c3(3200) c4(29314, 42371, 55428, 16257, 68485) c5(cT, fl, aX); #c1(DOCK11) c2(NP_653259) c3(3201) c4(29315, 42372, 55429, 16258, 68486) c5(Qv, ajF, aiW, bV, iL, Fh, bf, y, aW, ady, PH, qT, pP, qw, dA, cz, afJ, nP, YY, aM, u, rq, cT); #c1(DOCK1) c2(NP_001371) c3(3202) c4(29316, 42373, 55430, 16259, 68487) c5(nk, bh, aJB, b, X, bu, cy, av, by, IV, O, Ne); #c1(DOCK2) c2(NP_004937) c3(3203) c4(29317, 42374, 55431, 16260, 68488) c5(fl, cy, py, J, v, cO, bh, bq, o); #c1(DOCK3) c2(NP_004938) c3(3204) c4(29318, 42375, 55432, 16261, 68489) c5(en, axx, b, nQ, aBb, aDM, f, lg, aX, qh, u, y); #c1(DOCK4) c2(NP_055520) c3(3205) c4(29319, 42376, 55433, 16262, 68490) c5(oy, yg, yQ, b, X, cz, pr, T, n, av, Fg); #c1(DOCK5) c2(NP_079216) c3(3206) c4(29320, 42377, 55434, 16263, 68491) c5(rd, bq, aA); #c1(DOCK6) c2(NP_065863) c3(3207) c4(29321, 42378, 55435, 16264, 68492) c5(bhs, aeE, h, at); #c1(DOCK7) c2(XP_011540628) c3(3208) c4(29322, 42379, 55436, 16265, 68493) c5(IC, IY, w, bht); #c1(DOCK8) c2(NP_982272) c3(3209) c4(29323, 42380, 55437, 16266, 68494) c5(bhv, b, Ip, bhu, NH, bbC, cO, y, co, pp, fq, nU, Dc, zQ, QJ, u, CM, Il, pi, dP, NG, agc, CV, Xz); #c1 (DOCK9) c2(NP_001123520) c3(3210) c4(29324, 42381, 55438, 16267, 68495) c5(ak, bhw, cT, w, cO, at); #c1 (DOHH) c2(XP_011526642) c3(3211) c4(29325, 42382, 55439, 16268, 68496) c5(w, A, gm, ae, B); #c1(DOK1) c2(NP_001184189) c3(3212) c4(29326, 42383, 55440, 16269, 68497) c5(by, jT, b, X, N, q, bp, J, cT, pD, kY, av, bu, jG); #c1(DOK2) c2(NP_003965) c3(3213) c4(29327, 42384, 55441, 16270, 68498) c5(by, co, aw, X, J, bp, bu, ji, av, JY, jG, ae, zD); #c1(DOK3) c2(NP_001138347) c3(3214) c4(29328, 42385, 55442, 16271, 68499) c5(bp); #c1(DOK4) c2(NP_060580) c3(3215) c4(29329, 42386, 55443, 16272, 68500) c5(pR, co, fy, bp); #c1(DOK5) c2(NP_060901) c3(3216) c4(29330, 42387, 55444, 16273, 68501) c5(td, I, ak, j, aA, aW); #c1(DOK6) c2(NP_689934) c3(3217) c4(29331, 42388, 55445, 16274, 68502) c5(cp); #c1(DOK7) c2(NP_001158145) c3(3218) c4(29332, 42389, 55446, 16275, 68503) c5(xQ, AA, xz, xC, bhy, Ms, nI, aOp, xS, y, bhx, iB, oD, aCT, u, b); #c1(DOLK) c2(NP_055723) c3(3219) c4(29333, 42390, 55447, 16276, 68504) c5(mR, bhz); #c1(DONSON) c2(NP_060083) c3(3220) c4(29334, 42391, 55448, 16277, 68505) c5(A, B); #c1(DOPEY2) c2(NP_001307643) c3(3221) c4(29335, 42392, 55449, 16278, 68506) c5(nU, aq, ans); #c1(DOT1L) c2(NP_115871) c3(3222) c4(29336, 42393, 55450, 16279, 68507) c5(mI, V, b, J, pr, mR, U); #c1(DPAGT1) c2(NP_001373) c3(3223) c4(29337, 42394, 55451, 16280, 68508) c5(avO, KC, afE, WW, nI, e, q, bhB, xQ, bhA, mg, ck, bfg, aQX, Th, bm, bu, d); #c1(DPCD) c2(NP_056263) c3(3224) c4(29338, 42395, 55452, 16281, 68509) c5(MW, Pu); #c1(DPCR1) c2(NP_543146) c3(3225) c4(29339, 42396, 55453, 16282, 68510) c5(da, m, aZS, V, ix, U); #c1(DPEP1) c2(NP_001121613) c3(3226) c4(29340, 42397, 55454, 16283, 68511) c5(A, pV, b, If, U, y, co, Zk, B, qB, FG, u, Bm, V, cs, akr, ad, W, axI, cz, akG, kJ, ag, kA, abs, bM); #c1(DPEP2) c2(NP_071750) c3(3227) c4(29341, 42398, 55455, 16284, 68512) c5(A, b, mW, w, U, y, m, BL, B, q, bu, ar, QJ, iR, gI, V, Be, Ij, j, J, W, fx, fy, u); #c1(DPEP3) c2(NP_071752) c3(3228) c4(29342, 42399, 55456, 16285, 68513) c5(co, pV, b, bx, qB, fy); #c1(DPF1) c2(NP_001128627) c3(3229) c4(29343, 42400, 55457, 16286, 68514) c5(A); #c1(DPF3) c2(NP_001267471) c3(3230) c4(29344, 42401, 55458, 16287, 68515) c5(bf, Ns, u, Nq, ac); #c1(DPH1) c2(NP_001374) c3(3231) c4(29345, 42402, 55459, 16288, 68516) c5(X, t, av, G); #c1(DPH3) c2(NP_001040899) c3(3232) c4(29346, 42403, 55460, 16289, 68517) c5(aX); #c1(DPH6) c2(NP_001135444) c3(3233) c4(29347, 42404, 55461, 16290, 68518) c5(aC, bw, ao); #c1(DPH7) c2(NP_620133) c3(3234) c4(29348, 42405, 55462, 16291, 68519) c5(jT); #c1(DPM1) c2(NP_003850) c3(3235) c4(29349, 42406, 55463, 16292, 68520) c5(KC, SZ, eq, ag); #c1(DPM2) c2(NP_003854) c3(3236) c4(29350, 42407, 55464, 16293, 68521) c5(hS, bhC, xl); #c1(DPM3) c2(NP_061846) c3(3237) c4(29351, 42408, 55465, 16294, 68522) c5(A, eq, bhD); #c1(DPP10) c2(NP_001171505) c3(3238) c4(29352, 42409, 55466, 16295, 68523) c5(oy, nk, bb, dP, Wk, DM, ak, ti, oi, cy, aA, rQ, bm, Dl); #c1(DPP3) c2(NP_001243599) c3(3239) c4(29353, 42410, 55467, 16296, 68524) c5(b); #c1(DPP4) c2(NP_001926) c3(3240) c4(29354, 42411, 55468, 16297, 68525) c5(dx, B, dB, bf, O, dv, yh, fH, mz, du, gm, fO, x, jT, dH, fc, De, cT, dc, bq, aA, sU, td, X, Wp, iP, jz, eu, rd, mk, ws, iG, vl, cM, co, pp, eX, cs, av, fy, azi, Bd, V, gv, cK, fJ, aY, P, xe, fG, ap, WH, b, aF, jJ, oi, ic, ey, jd, hV, es, ra, ar, ff, jG, u, sQ, I, Iy, gL, ad, bhE, CF, et, Ha, ig, hX, Du, ih, A, di, al, U, jQ, aHA, aX, fq, Bi, y, aV, be, J, jo, T, Il, aFt, jI, gF, fM, aM, eg, fP, bh, at, eG); #c1(DPP6) c2(NP_001034439) c3(3241) c4(29355, 42412, 55469, 16298, 68526) c5(bhG, rQ, si, an, Wk, h, mM, bN, Vr, bhE, bw, arL, sK); #c1(DPP7) c2(NP_037511) c3(3242) c4(29356, 42413, 55470, 16299, 68527) c5(cT); #c1(DPP8) c2(NP_060213) c3(3243) c4(29357, 42414, 55471, 16300, 68528) c5(dx, dv, b, jd, du, av, u, y); #c1(DPP9) c2(XP_005259730) c3(3244) c4(29358, 42415, 55472, 16301, 68529) c5(dx, dv, jd, LR, du, cC, cT); #c1(DPPA2) c2(NP_620170) c3(3245) c4(29359, 42416, 55473, 16302, 68530) c5(TY, U, V, bp); #c1(DPPA3) c2(NP_954980) c3(3246) c4(29360, 42417, 55474, 16303, 68531) c5(Lr); #c1(DPPA4) c2(NP_060659) c3(3247) c4(29361, 42418, 55475, 16304, 68532) c5(wP, wV); #c1(DPT) c2(NP_001928) c3(3248) c4(29362, 42419, 55476, 16305, 68533) c5(HI, wh, A, ar, aeq, b, zJ, cp, B, MP, aE, afz, fl, T, oJ, bf, di, ap, hd, aM); #c1(DPY19L2) c2(NP_776173) c3(3249) c4(29363, 42420, 55477, 16306, 68534) c5(bhH, am); #c1(DPY19L3) c2(XP_011524828) c3(3250) c4(29364, 42421, 55478, 16307, 68535) c5(ak); #c1(DPY30) c2(NPJI5963) c3(3251) c4(29365, 42422, 55479, 16308, 68536) c5(J, bhl); #c1(DPYS) c2(NP_001376) c3(3252) c4(29366, 42423, 55480, 16309, 68537) c5(IZ, b, ayz, z, cV, nv, bu, bhJ, bhK, Ij, cD, oD, by, aW); #c1(DPYSL2) c2(NP_001184222) c3(3253) c4(29367, 42424, 55481, 16310, 68538) c5(b, hM, ai, y, oy, co, aPX, ak, iZ, cs, aV, aq, o, fh, hW, dA, qA, v, T, cV, aj, jv, fy, u, he); #c1(DPYSL3) c2(NP_001184223) c3(3254) c4(29368, 42425, 55482, 16311, 68539) c5(Xw, A, iy, ag, f, sB, hS, co, B, cV, aq); #c1(DPYSL4) c2(NP_006417) c3(3255) c4(29369, 42426, 55483, 16312, 68540) c5(bhL, aq); #c1(DPYSL5) c2(NP_001240652) c3(3256) c4(29370, 42427, 55484, 16313, 68541) c5(ach, fU, nb, oa, bp, apy, pw, vL); #c1(DRAM1) c2(NP_060840) c3(3257) c4(29371, 42428, 55485, 16314, 68542) c5(jE, b, fr, f, q, jV, ft, w, di, bm); #c1(DRAP1) c2(NP_006433) c3(3258) c4(29372, 42429, 55486, 16315, 68543) c5(aX); #c1(DRC1) c2(NP_659475) c3(3259) c4(29373, 42430, 55487, 16316, 68544) c5(MW, bhM); #c1(DRD1) c2(NP_000785) c3(3260) c4(29374, 42431, 55488, 16317, 68545) c5(de, oC, ak, Yk, vh, Ib, aby, ns, in, nm, dd, nq, nr, nn, wX, no, np, bj, ey, gO, oy, qs, Wj, wP, sG, Ks, f, do, zb, bM, Gj, o, oJ, Ew, dj, xM, si, fD, I, cV, Jt, dc, hv, cz, aFE, P, xq, eX, bdw, iN, di, Gl, to, wh, wV, ck, ch, bhN, acg, he, jd, aiY, jN, i, HV, I, nt, aA, jP, aUr, gl); #c1(DRD2) c2(NP_000786) c3(3261) c4(29375, 42432, 55489, 16318, 68546) c5(KS, ak, aw, Gt, Gm, Hv, avW, ns, iN, nm, dd, nq, nr, nn, bf, no, np, bhZ, bhQ, rh, GL, do, zb, IV, si, oN, oJ, aqQ, aOb, HX, bK, gY, aQL, GI, bdw, bhS, jv, cq, wh, GA, Ww, qN, yE, w, i, dc, UU, nt, aA, aUr, gk, X, aqu, rd, hS, aCB, GM, wX, cA, If, bhU, io, cM, TC, co, ip, aqK, f, ky, av, fy, bhO, if, ajs, Gr, V, nu, gv, Js, eX, ny, hH, zf, Wh, bhR, Ib, GB, ack, OW, aY, in, bcK, bhY, Gn, RB, vf, b, GK, jJ, Ey, qa, rV, ey, gZ, abq, fD, bhW, Iz, Qi, nU, je, vu, Wf, qu, HE, Gj, aM, u, rX, o, fh, FD, I, hv, cz, aaB, xq, bhT, jH, DY, ch, tW, aQX, he, dh, ih, aaf, HV, I, aaT, FY, de, oC, tZ, Jj, di, bj, U, Wi, Wj, aX, hk, sG, iI, aqs, hB, GF, oE, bhV, ik, y, nI, aV, aPI, dj, bdj, hW, cV, W, P, jI, xM, vv, bhP, Sp, to, jP, eG, acg, Jz, vW, aiY, aaI, fP, jN, Rj, bM, ap, bhX, gI); #c1(DRD3) c2(NP_001269492) c3(3262) c4(29376, 42433, 55490, 16319, 68547) c5(de, Ib, UU, Yk, Hv, Jz, bib, jJ, ns, cA, nm, nt, nq, nr, nn, kF, agL, no, np, bj, zf, cM, vW, jv, bQ, jI, si, jP, sG, fH, Qi, ak, oE, PV, y, qu, bia, Gj, aV, aTV, Wj, o, zb, Ew, dj, akH, hW, V, HX, aUj, dc, nu, cz, bic, P, xq, wX, Gl, aaT, iN, di, xM, et, fJ, Sp, to, rQ, ro, aY, u, tW, he, bcK, ih, eB, aiY, Ql, jN, HV, dd, GJ, aUr); #c1(DRD4) c2(NP_000788) c3(3263) c4(29377, 42434, 55491, 16320, 68548) c5(abu, Gm, ns, nm, nt, ng, nr, nn, wX, no, np, bhZ, bid, zb, IV, aqQ, nl, sH, GI, bhS, jv, f, agU, i, dc, GF, aA, tW, aUr, cA, cM, co, ak, fy, tQ, bih, aUh, Gr, V, nu, cx, Js, rV, bhR, agZ, ack, aaf, nc, axk, jR, gA, abw, jP, GL, jJ, qa, gZ, yQ, aqB, Wk, Qi, vu, bif, qu, Gj, bii, o, Jt, hv, cz, xq, big, iN, Ut, rQ, eQ, he, ih, aY, HV, I, Ib, tR, adT, bj, oy, bie, bdL, aqs, hB, Ai, oE, cB, aq, dj, bdj, hW, alF, Sw, GR, vv, to, acg, vW, sG, jN); #c1(DRD5) c2(NP_000789) c3(3264) c4(29378, 42435, 55492, 16321, 68549) c5(ak, ns, nm, nt, ng, nr, nn, wX, no, np, bj, cM, jI, sG, vv, aqs, GF, Gj, o, Yk, hW, ayv, Ia, nu, aDW, jv, aVc, Wz, eB, dc, aVk, bM, aUr); #c1(DRG1) c2(NP_004138) c3(3265) c4(29379, 42436, 55493, 16322, 68550) c5(jh, co, b, Qm, B, ad, W, A, ar, i, cs, u, y); #c1(DRGX) c2(NP_001263380) c3(3266) c4(29380, 42437, 55494, 16323, 68551) c5(cO); #c1(DROSHA) c2(NP_001093882) c3(3267) c4(29381, 42438, 55495, 16324, 68552) c5(aw, iD, b, X, dB, kY, jw, fx, co, am, ip, f, cU, ik, ff, ar, av, fy, bfG, n, cj, wp, J, W, T, ny, iA, BX, aaz, cT, i, ji, ci); #c1(DRP2) c2(NP_001164655) c3(3268) c4(29382, 42439, 55496, 16325, 68553) c5(Qi, ak, he); #c1(DSC1) c2(NP_004939) c3(3269) c4(29383, 42440, 55497, 16326, 68554) c5(aX, bbH, bik, ar, bij, U, jU); #c1(DSC2) c2(NP_004940) c3(3270) c4(29384, 42441, 55498, 16327, 68555) c5(B, aw, bim, b, xj, mk, A, ic, U, e, y, d, jh, co, XZ, cn, f, bu, qL, ik, alx, bil, mR, av, QJ, u, V, il, cV, Be, cs, ad, T, ar, x, cK, by, jU, bin, fl, akD); #c1(DSC3) c2(NP_001932) c3(3271) c4(29385, 42442, 55499, 16328, 68556) c5(A, aw, him, b, X, xj, mk, akD, U, e, y, d, jh, co, XZ, cn, f, bu, tF, ar, cM, alx, av, QJ, u, V, cV, Be, by, qL, T, jU, bbH, aY, bin, B, cT, dc, wr, ic); #c1(DSCAM) c2(NP_001380) c3(3272) c4(29386, 42443, 55500, 16329, 68557) c5(ak, cr, wn, IC, nU, ahS, hS, ahO, fy, aC, IV, at, aq); #c1(DSCAML1) c2(NP_065744) c3(3273) c4(29387, 42444, 55501, 16330, 68558) c5(bb); #c1(DSCC1) c2(NP_076999) c3(3274) c4(29388, 42445, 55502, 16331, 68559) c5(U, V, b); #c1(DSCR4) c2(NP_005858) c3(3275) c4(29389, 42446, 55503, 16332, 68560) c5(aq); #c1(DSE) c2(NP_037484) c3(3276) c4(29390, 42447, 55504, 16333, 68561) c5(bio, bb, Ex); #c1(DSEL) c2(NPJI5536) c3(3277) c4(29391, 42448, 55505, 16334, 68562) c5(bq, yi); #c1(DSG1) c2(NP_001933) c3(3278) c4(29392, 42449, 55506, 16335, 68563) c5(b, Zy, aFd, mk, ali, PO, e, d, aX, cn, eE, aFL, aRN, awi, aq, Yb, TP, em, bir, ma, dt, bs, bip, Mk, nk, biq, dP, axC, aRQ, aln); #c1(DSG2) c2(NP_001934) c3(3279) c4(29393, 42450, 55507, 16336, 68564) c5(ec, wF, bs, jH, xj, bin, cK, gm, j, bit, by, ad, fP, T, cs, bis, aX, bu, mR); #c1(DSG3) c2(NP_001935) c3(3280) c4(29394, 42451, 55508, 16337, 68565) c5(b, qd, aHc, afD, ba, bj, e, d, co, bs, ip, F, aFL, fy, ar, QJ, biu, Yb, bp, biv, T, pF, Jl, qp, mk, axC, aln); #c1(DSG4) c2(NP_001127925) c3(3281) c4(29395, 42452, 55509, 16338, 68566) c5(bix, bir, qd, yl, aey, biw, alJ, aFd, axC, alx); #c1(DSP) c2(NP_001008844) c3(3282) c4(29396, 42453, 55510, 16339, 68567) c5(fl, aw, biD, biF, mk, Ku, cO, biy, e, biz, d, jh, co, aX, b, XZ, jd, cn, aFQ, mR, ar, fy, o, awq, Hl, biB, LR, bp, xj, dt, T, amR, cK, hR, biA, Pw, GQ, biE, Ty, aey, aof, cT, aOY, Yb, biC); #c1(DSPP) c2(NP_055023) c3(3283) c4(29397, 42454, 55511, 16340, 68568) c5(A, aw, b, Hl, xj, cK, PO, e, oy, aX, biD, B, biG, biJ, aV, o, biH, biB, dt, bil, awi, hR, d, awj, RO, fc, na, RN, anx); #c1(DST) c2(NP_001714) c3(3284) c4(29398, 42455, 55512, 16341, 68569) c5(amC, A, JH, b, X, dj, bci, mk, aFh, cA, aaf, cM, d, aX, XZ, biK, jy, B, arU, e, ar, y, av, aV, u, Yb, JP, biL, fl, pF, Ey, biM, T, x, aqR, et, ac, PL, RS, Y, aum, aY, tl, dc, bM, aRQ); #c1(DSTN) c2(XP_011527445) c3(3285) c4(29399, 42456, 55513, 16342, 68570) c5(BO, b, k, f, ad, ag, w, i, cs, x, av, O); #c1(DSTYK) c2(NP_056190) c3(3286) c4(29400, 42457, 55514, 16343, 68571) c5(biN); #c1(DTD1) c2(NP_543010) c3(3287) c4(29401, 42458, 55515, 16344, 68572) c5(aQI); #c1(DTHD1) c2(NP_001130008) c3(3288) c4(29402, 42459, 55516, 16345, 68573) c5(nR, aV, at); #c1(DTL) c2(NP_001273158) c3(3289) c4(29403, 42460, 55517, 16346, 68574) c5(fl, b, X, U, e, d, bb, N, q, bu, ik, cs, av, u, V, nz, by, ad, fp, Lc, fg, rb); #c1(DTNA) c2(NP_001121647) c3(3290) c4(29404, 42461, 55518, 16347, 68575) c5(bgc, Ex, nl, biO, oD, at, BK, xl); #c1(DTNB) c2(NP_001243232) c3(3291) c4(29405, 42462, 55519, 16348, 68576) c5(cK, at, fO); #c1(DTNBP1) c2(NP_001258596) c3(3292) c4(29406, 42463, 55520, 16349, 68577) c5(IY, oC, bdy, KS, EE, ns, nm, nt, nq, nr, nn, cA, no, np, cM, oy, xw, bb, IZ, ak, IV, Ew, dj, hW, cV, XS, nu, eu, bdx, jv, to, aY, he, ih, jN, dc, biP); #c1(DTX1) c2(XP_011536311) c3(3293) c4(29407, 42464, 55521, 16350, 68578) c5(zi, fr, Fs, iZ, Ql, ft, P, w, apT, BQ, O); #c1(DTX2) c2(NP_001096064) c3(3294) c4(29408, 42465, 55522, 16351, 68579) c5(g); #c1(DTX3) c2(NP_001273174) c3(3295) c4(29409, 42466, 55523, 16352, 68580) c5(u); #c1(DTX4) c2(NP_001287656) c3(3296) c4(29410, 42467, 55524, 16353, 68581) c5(BQ, rb); #c1(DTYMK) c2(NP_036277) c3(3297) c4(29411, 42468, 55525, 16354, 68582) c5(A, gt, b, fr, B, ad, P, fl, cs, x, ft, cM); #c1(DUOX1) c2(NP_787954) c3(3298) c4(29412, 42469, 55526, 16355, 68583) c5(fn, B, aw, b, w, di, cO, biQ, bf, A, aO, co, dN, ra, Dq, f, q, CK, ar, aV, dh, J, bp, P, aM, aQF, xd, I, bh); #c1(DUOX2) c2(NP_054799) c3(3299) c4(29413, 42470, 55527, 16356, 68584) c5(fn, hV, aw, dN, Sc, cO, di, aAb, bf, aO, co, ra, Dq, f, q, CK, aV, dh, biR, biT, VD, J, bp, P, bh, jU, aM, jH, xd, aE, I, hM, biS); #c1(DUOXA1) c2(NP_001263193) c3(3300) c4(29414, 42471, 55528, 16357, 68585) c5(co, b, aQF, P, w, O, biU, u, y); #c1(DUOXA2) c2(NP_997464) c3(3301) c4(29415, 42472, 55529, 16358, 68586) c5(jH, co, Sc, biW, biU, biV, jU); #c1(DUPD1) c2(NP_001003892) c3(3302) c4(29416, 42473, 55530, 16359, 68587) c5(aW); #c1(DUS2) c2(NP_001258691) c3(3303) c4(29417, 42474, 55531, 16360, 68588) c5(co, fy); #c1(DUSP10) c2(NP_009138) c3(3304) c4(29418, 42475, 55532, 16361, 68589) c5(acE, A, ER, V, aiU, f, ig, bn, fl, cy, U, oT); #c1(DOSP11) c2(NP_003575) c3(3305) c4(29419, 42476, 55533, 16362, 68590) c5(cs); #c1(DUSP12) c2(NP_009171) c3(3306) c4(29420, 42477, 55534, 16363, 68591) c5(M, co, I, b, cV, X, aF, h, f, F, cU, ag, jG, Il, iA, Di, av, fy, aA); #c1(DUSP13) c2(NP_001007272) c3(3307) c4(29421, 42478, 55535, 16364, 68592) c5(fD, ac, cV); #c1(DUSP14) c2(NP_008957) c3(3308) c4(29422, 42479, 55536, 16365, 68593) c5(aX); #c1(DUSP15) c2(NP_542178) c3(3309) c4(29423, 42480, 55537, 16366, 68594) c5(fc, aV); #c1 (DUSP16) c2(XP_005253545) c3(3310) c4(29424, 42481, 55538, 16367, 68595) c5(A, vZ, B, J); #c1(DUSP18) c2(NP_001291723) c3(3311) c4(29425, 42482, 55539, 16368, 68596) c5(bb); #c1(DUSP1) c2(NP_004408) c3(3312) c4(29426, 42483, 55540, 16369, 68597) c5(dx, Dr, fr, A, b, X, aF, sE, dB, aE, BY, bn, di, cO, cA, bw, U, e, cM, Ne, d, vr, biX, co, cy, iR, h, f, F, q, bu, cU, gX, ar, y, oO, MU, av, aV, u, dh, da, bm, si, V, m, aC, du, J, bp, ft, aGS, P, dv, T, Il, og, iA, jT, M, fy, zE, aY, ch, kJ, PB, B, ag, cT, dc, vZ, aA, at, eG); #c1(DUSP21) c2(NP_071359) c3(3313) c4(29427, 42484, 55541, 16370, 68598) c5(q); #c1 (DUSP22) c2(NP_001273484) c3(3314) c4(29428, 42485, 55542, 16371, 68599) c5(ig, u, y); #c1(DUSP23) c2(NP_060293) c3(3315) c4(29429, 42486, 55543, 16372, 68600) c5(cI, ac, cV); #c1(DUSP27) c2(XP_005245660) c3(3316) c4(29430, 42487, 55544, 16373, 68601) c5(di, bj, bb, aWt); #c1(DUSP28) c2(NP_001028747) c3(3317) c4(29431, 42488, 55545, 16374, 68602) c5(w, f, O, b, cV); #c1(DUSP2) c2(NP_004409) c3(3318) c4(29432, 42489, 55546, 16375, 68603) c5(B, Ey, A, ak, O, co, jI, kJ, qc, f, y, cB, cs, av, u, hW, cV, iv, Fs, J, fO, ad, Fr, qp, eG, sG, Oi, vt); #c1(DUSP3) c2(NP_004081) c3(3319) c4(29433, 42490, 55547, 16376, 68604) c5(A, b, X, B, T, av, fy); #c1(DUSP4) c2(NP_001385) c3(3320) c4(29434, 42491, 55548, 16377, 68605) c5(co, aw, V, b, dA, X, f, F, qP, w, T, O, cK, ji, U, u, y); #c1(DUSP5) c2(NP_004410) c3(3321) c4(29435, 42492, 55549, 16378, 68606) c5(WH, if, jT, b, X, P, bu, by, cT, aFN, u, Ct, y); #c1(DUSP6) c2(NP_001937) c3(3322) c4(29436, 42493, 55550, 16379, 68607) c5(ak, biZ, b, X, w, bw, y, Ag, co, Ml, Bc, hV, q, cU, qL, bn, ar, fy, av, QJ, u, fh, dj, og, I, cV, Be, sX, W, T, iA, nV, f, bm, YA, jh, ag, biY, Af, aA, at); #c1(DUSP7) c2(NP_001938) c3(3323) c4(29437, 42494, 55551, 16380, 68608) c5(b, t, h, J, M, G, iv); #c1(DUSP8) c2(XP_011518235) c3(3324) c4(29438, 42495, 55552, 16381, 68609) c5(cT, fO); #c1(DUSP9) c2(XP_011529425) c3(3325) c4(29439, 42496, 55553, 16382, 68610) c5(aw, I, pR, eX, bf, aA, aM); #c1(DUT) c2(NP_001020419) c3(3326) c4(29440, 42497, 55554, 16383, 68611) c5(da, jT, b, k, q, atK, T, fl, bja, bq, fy); #c1(DUX4) c2(XP_011529816) c3(3327) c4(29441, 42498, 55555, 16384, 68612) c5(QV, Ir, aiQ, f, es, cc, Il, rO, oD, BK, xl, cl); #c1(DVL2) c2(NP_004413) c3(3328) c4(29442, 42499, 55556, 16385, 68613) c5(jR, V, aLp, bp, aY, w, T, O, Qt, U, u, y); #c1(DVL3) c2(NP_004414) c3(3329) c4(29443, 42500, 55557, 16386, 68614) c5(d, jh, co, aLv, b, k, q, bp, ar, aZ, I, fy, e); #c1(DXO) c2(XP_006715068) c3(3330) c4(29444, 42501, 55558, 16387, 68615) c5(m, eX, cr, alX, dD, nU, cz, cT, bjb, o, aA, aE, aW); #c1(DYM) c2(NP_060123) c3(3331) c4(29445, 42502, 55559, 16388, 68616) c5(dx, bL, nU, b, aF, IW, bf, U, Co, dv, cy, yQ, re, f, tF, iT, bU, rv, du, aZL, IR, IX, aZ, hR, fM, aM, rM, aL, Ic, bH, lS, IP, Ol, aNS, bq, wl, aRK, ap); #c1(DYNAP) c2(NP_775900) c3(3332) c4(29446, 42503, 55560, 16389, 68617) c5(b); #c1(DYNC1H1) c2(NP_001367) c3(3333)

c4(29447, 42504, 55561, 16390, 68618) c5(b, cG, WW, Pv, aNI, bjd, ey, ho, nP, gZ, nU, q, Vr, do, kz, cc, OA, DY, Yb, mz, Ad, OF, gF, QZ, PZ, bje, ao, bjc, Y, FT); #c1(DYNC1I1) c2(NP_001129029) c3(3334) c4(29448, 42505, 55562, 16391, 68619) c5(aPc, ac); #c1(DYNCI12) c2(NP_001258715) c3(3335) c4(29449, 42506, 55563, 16392, 68620) c5(b); #c1(DYNC1L11) c2(NP_057225) c3(3336) c4(29450, 42507, 55564, 16393, 68621) c5(en); #c1(DYNC2H1) c2(NP_001073932) c3(3337) c4(29451, 42508, 55565, 16394, 68622) c5(bjh, fU, bjg, bjf, O, at, zW, o, bji); #c1(DYNLL1) c2(NP_001032584) c3(3338) c4(29452, 42509, 55566, 16395, 68623) c5(A, aw, b, X, dB, jc, iL, adr, e, y, d, jT, jl, kJ, jd, f, F, q, bu, ar, B, cs, Xi, fy, bm, fh, is, cV, bp, ad, T, fO, Fr, by, jE, aEs, u, acj, jR, aAN); #c1(DYNLL2) c2(NP_542408) c3(3339) c4(29453, 42510, 55567, 16396, 68624) c5(cU, aX, f, q, tR, ih, Rj, wX, iA, zf); #c1(DYNLRB1) c2(NP_001268658) c3(3340) c4(29454, 42511, 55568, 16397, 68625) c5(fU, b, bu, co, dQ, fy); #c1(DYNLT1) c2(NP_001278531) c3(3341) c4(29455, 42512, 55569, 16398, 68626) c5(ck, lX, Co); #c1(DYNLT3) c2(NP_006511) c3(3342) c4(29456, 42513, 55570, 16399, 68627) c5(aeQ, nW, Bu, Ik, ayr); #c1(DYRKIA) c2(NP_001387) c3(3343) c4(29457, 42514, 55571, 16400, 68628) c5(jK, nU, bS, b, cO, bg, hS, w, HS, pu, Em, O, xw, cM, bjk, aX, KA, f, agw, ans, aq, o, hW, KH, zv, v, P, gk, QZ, cr, aY, HN, bjj, qa, dc, aT); #c1(DYRK1B) c2(NP_004705) c3(3344) c4(29458, 42515, 55572, 16401, 68629) c5(ag, co, b, kJ, X, eX, ad, fr, ar, cl, cs, fy, av, ft); #c1(DYRK2) c2(NP_003574) c3(3345) c4(29459, 42516, 55573, 16402, 68630) c5(aHE, js, b, cV, bu, fl, ar, y, by, u, ib); #c1(DYRK3) c2(NP_001004023) c3(3346) c4(29460, 42517, 55574, 16403, 68631) c5(f, bjl, mU); #c1(DYSF) c2(NP_001123927) c3(3347) c4(29461, 42518, 55575, 16404, 68632) c5(A, aTt, Ik, aBK, AA, aK, xl, aBO, oB, f, bjn, cc, arh, oD, aV, WG, atW, kG, nl, v, vw, cK, bjm, Rz, At, Au, adF, aT, ap); #c1(DYX1C1) c2(NP_001028731) c3(3348) c4(29462, 42519, 55576, 16405, 68633) c5(yQ, V, am, b, cV, bK, cz, MW, alW, I, U, u, y, bjo); #c1(DZIP1) c2(NP_055749) c3(3349) c4(29463, 42520, 55577, 16406, 68634) c5(u, y); #c1(E2F1) c2(NP_005216) c3(3350) c4(29464, 42521, 55578, 16407, 68635) c5(B, aw, dB, w, e, O, jR, kJ, yh, n, g, cs, bp, ft, aiL, Jj, x, fx, jT, cq, jE, ie, ag, cT, i, bq, iF, cY, DO, anF, U, cM, co, yE, ml, f, bu, aOg, xl, iv, av, fy, bm, iT, cj, em, Bd, V, gv, bt, dY, vH, aCa, ji, kD, ci, b, ic, GE, d, jh, ra, re, q, X, ar, ff, u, dh, o, fs, il, qL, el, gL, ad, bjq, nV, iR, aE, cX, QU, A, fr, pR, gn, pD, aFe, nJ, iL, gE, bj, iK, c, aX, Qm, h, F, bjp, ik, y, cB, aPI, fU, si, cV, YR, J, P, T, fO, jl, nP, by, fM, XH, bh, Bi); #c1(E2F3) c2(NP_001230005) c3(3351) c4(29465, 42522, 55579, 16408, 68636) c5(A, b, X, w, U, e, y, d, co, aX, h, B, q, es, aHY, ff, cB, ar, av, u, iF, fe, cV, bp, T, fH, fx, jG, cq, pb, iR, fJ, i, ji); #c1(E2F4) c2(NP_001941) c3(3352) c4(29466, 42523, 55580, 16409, 68637) c5(B, b, X, aCb, jz, pD, A, Iv, U, bu, hP, y, jQ, h, f, q, bjr, cs, hV, av, u, V, bp, ad, T, x, by, bjs, jH, nV, bg, at, kD); #c1(E2F5) c2(NP_001077057) c3(3353) c4(29467, 42524, 55581, 16410, 68638) c5(X, u, y, b); #c1(E2F6) c2(NP_001265204) c3(3354) c4(29468, 42525, 55582, 16411, 68639) c5(fy, dP, X, q, fr, jT); #c1(E2F7) c2(NP_976328) c3(3355) c4(29469, 42526, 55583, 16412, 68640) c5(oy, d, BX, ip, X, h, hT, q, cT, ny, e, aW); #c1(E2F8) c2(NP_078956) c3(3356) c4(29470, 42527, 55584, 16413, 68641) c5(X, av, q, b); #c1(E4F1) c2(NP_004415) c3(3357) c4(29471, 42528, 55585, 16414, 68642) c5(M, h, f); #c1(EAF1) c2(NP_149074) c3(3358) c4(29472, 42529, 55586, 16415, 68643) c5(J); #c1(EAF2) c2(NP_060926) c3(3359) c4(29473, 42530, 55587, 16416, 68644) c5(aEg, A, b, h, B, q, bp, gm, ih, bjt, ji); #c1(EARS2) c2(NP_001077083) c3(3360) c4(29474, 42531, 55588, 16417, 68645) c5(dx, m, dv, du, bju, at, iu); #c1(EBAG9) c2(NP_001265867) c3(3361) c4(29475, 42532, 55589, 16418, 68646) c5(A, b, X, iP, dB, bw, e, y, d, co, Bc, B, q, bu, cU, aC, ar, O, av, u, gG, Be, sH, J, by, T, iA, Wp, JY, kh, mA, i, eG, bT); #c1(EBF1) c2(NP_076870) c3(3362) c4(29476, 42533, 55590, 16419, 68647) c5(Hl, jT, aV, aw, b, cV, t, J, Eo, G, fH, bb, at, fJ); #c1(EBF2) c2(NP_073150) c3(3363) c4(29477, 42534, 55591, 16420, 68648) c5(dA, fr, yD, ft, cH, jG, at, ac); #c1(EBF3) c2(NP_001005463) c3(3364) c4(29478, 42535, 55592, 16421, 68649) c5(g, d, b, e, jR, bu, Eo, by, yw, o); #c1(EBF4) c2(NP_001103984) c3(3365) c4(29479, 42536, 55593, 16422, 68650) c5(aC); #c1(EBI3) c2(NP_005746) c3(3366) c4(29480, 42537, 55594, 16423, 68651) c5(dx, en, aw, zr, b, F, eu, Ka, w, iL, jy, Bz, G, Bb, y, m, co, aX, ae, pp, jd, t, h, N, bu, M, sb, fP, aV, u, aE, jS, aEq, pe, nl, I, aC, Dg, du, gm, DT, IR, IX, P, dv, aox, aAB, cy, J, by, cW, jH, jT, fy, dP, fq, ag, IS, rl, pJ, DM, aAp); #c1(EBP) c2(NP_006570) c3(3367) c4(29481, 42538, 55595, 16424, 68652) c5(by, hV, iL, b, aeB, arF, bfd, w, di, jV, aVo, U, A, fx, y, bfe, qs, co, aX, ae, pp, t, h, f, q, n, M, aVn, B, cs, ky, jG, u, cc, Ps, og, fs, V, I, cV, aC, J, aAA, P, Ql, od, cy, gF, ad, dL, bjv, aht, jT, bm, hq, ie, G, fw, bk, i, fN, QP, aA, ci); #c1(EBPL) c2(NP_001265565) c3(3368) c4(29482, 42539, 55596, 16425, 68653) c5(tF, aaz, Pv, PK, ak, IM, K, ahj, alM, afb, aht, o); #c1(ECD) c2(NP_001129224) c3(3369) c4(29483, 42540, 55597, 16426, 68654) c5(b, u, bu, cO, iB, PE, by, iu, y); #c1(ECE2) c2(NP_001032401) c3(3370) c4(29484, 42541, 55598, 16427, 68655) c5(dx, dv, du, aV, qs); #c1(ECEL1) c2(NP_001277716) c3(3371) c4(29485, 42542, 55599, 16428, 68656) c5(Am, cV, bjy, AB, bjx, bjw); #c1(ECHDC1) c2(NP_001099014) c3(3372) c4(29486, 42543, 55600, 16429, 68657) c5(X, aX, u, y); #c1(ECHDC3) c2(NP_078969) c3(3373) c4(29487, 42544, 55601, 16430, 68658) c5(bq, bb); #c1(ECHS1) c2(NP_004083) c3(3374) c4(29488, 42545, 55602, 16431, 68659) c5(ake, ni, q, bu, w, C, iL, aA, u, y); #c1(ECI1) c2(NP_001171500) c3(3375) c4(29489, 42546, 55603, 16432, 68660) c5(ml, b); #c1(ECI2) c2(NP_006108) c3(3376) c4(29490, 42547, 55604, 16433, 68661) c5(yt, cy, cO, J, M, n, eM, fR, jD); #c1(ECSCR) c2(NP_001071161) c3(3377) c4(29491, 42548, 55605, 16434, 68662) c5(JD, fy, n); #c1(ECSIT) c2(NP_001135936) c3(3378) c4(29492, 42549, 55606, 16435, 68663) c5(f); #c1(ECT2) c2(NP_001245244) c3(3379) c4(29493, 42550, 55607, 16436, 68664) c5(ji, fl, aw, V, b, fr, pR, f, ft, BY, w, ar, bw, ack, U, fy, fT, O); #c1(EDA2R) c2(NP_001186616) c3(3380) c4(29494, 42551, 55608, 16437, 68665) c5(V, LD, afW, U, u, y); #c1(EDA) c2(NP_001005609) c3(3381) c4(29495, 42552, 55609, 16438, 68666) c5(bjA, b, fr, biF, Hr, mk, HJ, y, tp, bjC, aX, aC, as, u, bjD, an, bjB, ft, dt, YS, amR, et, bjE, bjF, uH, bjG, bjz); #c1(EDARADD) c2(NP_542776) c3(3382) c4(29496, 42553, 55610, 16439, 68667) c5(bjA, bjH, bjF, bjl, bjJ, amR); #c1(EDAR) c2(NP_071731) c3(3383) c4(29497, 42554, 55611, 16440, 68668) c5(bjA, bjH, bjF, bjD, bjG, o, amR, u, y); #c1(EDC4) c2(NP_055144) c3(3384) c4(29498, 42555, 55612, 16441, 68669) c5(at, oG); #c1(EDEM1) c2(NP_055489) c3(3385) c4(29499, 42556, 55613, 16442, 68670) c5(oy, cA, f, Ey, UE); #c1(EDIL3) c2(NP_001265571) c3(3386) c4(29500, 42557, 55614, 16443, 68671) c5(DP, b, Ip, hS, di, bhK, U, FA, aW, oy, aX, t, h, f, wN, q, y, pt, u, aO, nl, sH, cs, ad, G, oM, jl, fx, Mw, jH, fw, gA, i, ds, aA, at); #c1(EDN1) c2(NP_001946) c3(3387) c4(29501, 42558, 55615, 16444, 68672) c5(dx, gK, ml, pV, dN, dD, sX, dB, sA, w, cO, vp, e, O, vr, dv, LL, acL, wd, hu, eQ, iT, mR, wY, aD, bfi, Hs, xc, og, aeM, aC, sH, du, gJ, US, bp, ft, bfE, aip, od, cV, x, qt, fx, hR, hj, su, cq, wh, xO, gs, dS, Fr, mE, tO, we, bjL, cT, Fi, dh, uO, i, vJ, bq, aA, bT, bP, wa, id, td, X, aZP, aYW, aCY, kB, aZO, dV, kY, bf, lw, U, Co, y, ez, co, ml, f, dZ, k, B, cs, bv, av, fY, bk, bgj, em, V, ae, Bs, qC, bjO, gv, IR, eX, cy, iA, pi, Tl, xd, pk, dy, er, jo, in, jd, aNw, qB, re, vL, aG, vl, vf, bW, b, zH, aF, vh, eR, Hr, bg, A, jj, z, HJ, ey, fD, d, bb, eA, Bc, bjQ, bX, hV, q, ap, pn, bjK, sR, aJ, aRv, sK, u, dr, o, fh, da, sz, bjN, hb, I, Dg, Fw, LR, aH, j, ad, BZ, IX, vS, Sq, aZ, uw, et, P, ao, nV, hU, ch, Jv, hT, rq, Cr, El, Ns, IS, I, wR, cK, bL, Ic, sO, fr, pR, IW, sv, di, DM, wf, sx, vl, oy, m, qs, EG, aX, sG, bj, wN, Aq, cU, bjP, bn, oJ, gg, Ek, dj, ma, tP, bau, hZ, sB, W, bjM, ti, T, fl, cr, mQ, AP, ac, aM, jT, ii, YQ, iu, Jh, aDd, Nq, HM, aEb, Dl, fP, Sv, wG, bh, at, gf, oT); #c1(EDN3) c2(NP_001289385) c3(3388) c4(29502, 42559, 55616, 16445, 68673) c5(S, ahS, ahP, bjR, bjS, ad, bjT, ahO, di, bk, cs, aPM, aX, u, aTh, y, w); #c1(EDNRA) c2(NP_001159527) c3(3389) c4(29503, 42560, 55617, 16446, 68674) c5(dx, mI, dN, F, gG, yz, sA, w, cO, O, vr, jv, dv, cy, yl, Mu, mR, cl, Hs, xc, og, aC, nW, du, bp, ft, Nz, nd, fy, akK, su, wh, xO, f, ym, cT, bk, fD, bq, aA, bP, fl, yu, eu, hS, yD, dV, yn, IW, Co, y, bjV, yr, co, ak, ys, bu, k, B, av, yB, bgj, jh, Bs, gv, IR, yF, afb, jC, Tl, xd, pk, er, jo, T, iu, ap, aGP, vf, b, Dr, A, ic, cK, yp, bb, ra, re, hV, g, Jq, bjU, X, ar, u, aE, o, sz, I, Dg, el, j, by, IX, uw, et, yG, P, Mk, ch, rq, yy, aG, IS, I, xf, yA, yo, bL, uk, sO, fr, bir, di, gE, yv, Ic, qs, aX, sG, il, h, sF, wN, yx, oE, bn, oJ, cB, Ig, tP, cV, dB, bd, W, bjM, ti, yk, fO, ML, cr, AP, QK, aDd, vW, gu, bh, at); #c1(EDNRB) c2(NP_000106) c3(3390) c4(29504, 42561, 55618, 16447, 68675) c5(dx, ml, bjW, F, gG, dB, sA, w, cO, aTh, O, vr, cy, aJm, e, mR, bir, aG, du, bp, ft, ahO, od, QZ, fx, pb, wh, aJI, hn, bk, i, vJ, bg, Jy, cY, jj, ahS, fU, dV, IW, bw, Co, y, co, cK, B, aG, xg, k, aPM, fy, bjY, Bs, aZz, bjS, sz, gv, IR, Fr, iA, xd, er, acj, bjZ, ap, aGP, b, ic, jC, d, jh, bb, jd, vf, q, bjU, ar, u, o, PJ, I, j, lX, aZ, et, yG, Mk, sh, IS, bka, I, A, Tl, fr, bjX, pR, HJ, di, gE, nT, aX, sG, wN, cU, oJ, aq, ma, cV, Fs, J, W, dU, bjM, T, Jh, aDd, bh, at); #c1(EEA1) c2(NP_003557) c3(3391) c4(29505, 42562, 55619, 16448, 68676) c5(bf, P, aM); #c1(EED) c2(NP_003788) c3(3392) c4(29506, 42563, 55620, 16449, 68677) c5(jH, b, bm, afY, es, vZ, iD, u, y); #c1(EEF1A1) c2(XP_011533816) c3(3393) c4(29507, 42564, 55621, 16450, 68678) c5(B, b, bkb, wy, A, hA, U, y, Ag, co, aX, wP, f, q, bu, X, cs, av, u, Af, fU, V, cJ, ad, T, wV, yy, ag, fP, zO); #c1(EEF1A2) c2(NP_001949) c3(3394) c4(29508, 42565, 55622, 16451, 68679) c5(dx, eX, aw, dN, aHH, dD, ud, aN, eH, w, bW, cp, dv, cy, kJ, Zl, fH, uL, aC, nl, du, Ej, fO, ft, qt, dS, cT, bk, bq, aA, id, X, hS, iG, bf, bkc, U, y, co, px, f, bu, B, cs, oD, av, V, Fy, fJ, dy, vH, ji, ap, b, bkb, eR, aO, bb, q, jV, ar, u, dh, o, da, I, hv, ad, aaN, I, BK, bL, A, OB, fr, eO, gE, al, aW, uK, aX, tF, aV, Dt, si, m, J, W, T, Il, aM, wU, Ic, Oi, at); #c1(EEF1B2) c2(NP_001032752) c3(3395) c4(29509, 42566, 55623, 16452, 68680) c5(nU, u, b); #c1(EEF1D) c2(NP_001123525) c3(3396) c4(29510, 42567, 55624, 16453, 68681) c5(b, il, jR, kz, T, u); #c1(EEF1E1) c2(NP_001129122) c3(3397) c4(29511, 42568, 55625, 16454, 68682) c5(wa, aX, jd, f, q, fO, J, jF, n, i, iv, aA, fy, fx); #c1(EEF1G) c2(NP_001395) c3(3398) c4(29512, 42569, 55626, 16455, 68683) c5(V, il, et, ag, ar, cs, bw, U); #c1(EEF2) c2(NP_001952) c3(3399) c4(29513, 42570, 55627, 16456, 68684) c5(yJ, A, V, b, sE, v, bp, dB, dl, ar, ayt, u, o); #c1(EEFSEC) c2(NP_068756) c3(3400) c4(29514, 42571, 55628, 16457, 68685) c5(A, cO); #c1(EFCAB11) c2(NP_001271195) c3(3401) c4(29515, 42572, 55629, 16458, 68686) c5(ix, q); #c1(EFCAB1) c2(XP_005251361) c3(3402) c4(29516, 42573, 55630, 16459, 68687) c5(di); #c1(EFEMP1) c2(NP_001034438) c3(3403) c4(29517, 42574, 55631, 16460, 68688) c5(dx, aw, b, X, Af, O, w, cO, GV, bf, U, aW, Ag, co, Vx, yE, ml, bw, q, nv, cU, ar, y, bkd, bke, fv, av, nR, u, iT, arb, V, nQ, wU, an, du, bp, dt, qO, SF, aM, W, an, fy, ag, xr, ard, agN, dX, bkf, T, re, as); #c1(EFEMP2) c2(NP_058634) c3(3404) c4(29518, 42575, 55632, 16461, 68689) c5(bL, A, bkh, b, QZ, mI, bkg, j, Aq, dt, x, T, y, Jf, bkd, Ux, aC, u, xl); #c1(EFHB) c2(NP_653316) c3(3405) c4(29519, 42576, 55633, 16462, 68690) c5(aE); #c1(EFHC1) c2(NP_001165891) c3(3406) c4(29520, 42577, 55634, 16463, 68691) c5(avQ, sG, td, hY, Id, hS, pu, jr, bki, CG); #c1(EFHC2) c2(NP_079460) c3(3407) c4(29521, 42578, 55635, 16464, 68692) c5(ahj, wp, jr); #c1(EFHD1) c2(NP_001230181) c3(3408) c4(29522, 42579, 55636, 16465, 68693) c5(rb); #c1 (EFNA1) c2(NP_004419) c3(3409) c4(29523, 42580, 55637, 16466, 68694) c5(id, aw, b, oi, U, e, y, d, co, aX, q, bu, O, cs, av, fy, iR, bm, V, sH, by, W, dU, T, Qt, cy, fx, u, i, ji); #c1(EFNA2) c2(NP_001396) c3(3410) c4(29524, 42581, 55638, 16467, 68695) c5(fn, m, h, cU, P, cB, hP, re, iT); #c1(EFNA3) c2(NP_004943) c3(3411) c4(29525, 42582, 55639, 16468, 68696) c5(co, o); #c1(EFNA4) c2(NP_005218) c3(3412) c4(29526, 42583, 55640, 16469, 68697) c5(agu, cT, atS, tz); #c1(EFNA5) c2(NP_001953) c3(3413) c4(29527, 42584, 55641, 16470, 68698) c5(m, ma, aX, b, t, vj, eO, sd, kB, GF, fO, bj, bb, hW, u, y, rZ); #c1(EFNB1) c2(NP_004420) c3(3414) c4(29528, 42585, 55642, 16471, 68699) c5(dx, Al, bjA, b, k, fr, w, U, dv, nU, wN, g, bu, ar, Uf, V, aC, du, J, tz, by, bkj, AP, bjE, bjF, jR, aA); #c1(EFNB2) c2(NP_004084) c3(3415) c4(29529, 42586, 55643, 16472, 68700) c5(bP, b, k, w, U, e, y, d, jh, il, ml, hV, q, bu, O, cs, afA, u, dh, ma, V, I, cV, J, gL, ad, P, T, x, by, et, yG, nV, bm, oi, fD, ap); #c1(EFNB3) c2(NP_001397) c3(3416) c4(29530, 42587, 55644, 16473, 68701) c5(cV, w, T, aec, i, fy, O); #c1(EFR3A) c2(NP_055952) c3(3417) c4(29531, 42588, 55645, 16474, 68702) c5(fl); #c1(EFR3B) c2(NP_055786) c3(3418) c4(29532, 42589, 55646, 16475, 68703) c5(aE); #c1(EFS) c2(NP_001264103) c3(3419) c4(29533, 42590, 55647, 16476, 68704) c5(fe, aX, b, cV, t, h, J, bkk, P, gR, Dg, jC, fR, Tv, G); #c1(EFTUD1) c2(NP_001035700) c3(3420) c4(29534, 42591, 55648, 16477, 68705) c5(bq, eO); #c1 (EFTUD2) c2(NP_001136077) c3(3421) c4(29535, 42592, 55649, 16478, 68706) c5(bkl, nW, aNb, bkm, QZ, Xt); #c1(EGF) c2(NP_001171601) c3(3422) c4(29536, 42593, 55650, 16479, 68707) c5(dx, by, B, aw, iD, bx, jE, EM, gG, dB, ajo, Ip, auJ, w, iT, bu, adr, ra, O, BO, wo, dv, cy, Vx, kJ, Si, e, bkr, nZ, eE, kz, Xi, cl, jg, Dd, jC, jM, ajz, n, g, xc, og, aBE, nl, Qf, du, fO, wh, bp, ft, Nz, rQ, od, x, YT, fx, jT, Yp, ja, ata, gE, vz, agb, bjF, Dz, jh, Ql, aKv, ag, cT, Bh, bk, i, aC, mD, aA, bku, bP, is, sa, fl, axq, bkw, fi, X, Hk, afY, oa, py, ig, ma, kY, av, cA, bw, U, Oh, y, anJ, tp, co, pp, anl, uj, f, cs, aG, xb, gX, k, il, iJ, NB, fy, bm, fY, yJ, iF, vR, ca, V, ae, yg, ze, Dp, gv, IR, bkv, cU, ny, amR, iy, iA, qH, aec, JY, iP, bkq, hp, zJ, xe, aih, jd, sH, TQ, T, EG, aox, Dr, amG, ck, b, bkb, QB, Xj, eR, Hr, A, jj, ic, bkt, z, asl, Al, fD, aul, d, Me, bb, Dx, eA, Bc, re, hV, aEq, q, ND, IY, OC, ar, ff, aJ, EB, as, HE, bko, u, dh, kP, da, NT, hb, VD, Fr, anZ, LR, acv, j, ad, IX, G, Ca, aZ, oi, Mw, et, jG, jU, apG, Al, VH, ao, nV, auK, eQ, bkp, uH, xY, xK, IS, dn, fl, I, asg, Mp, Qv, iG, asx, fr, pR, IW, HJ, qY, di, xa, iL, eM, ji, al, hP, vl, aW, MT, aX, I, bj, h, anM, F, aBd, bkn, DO, ik, oJ, pN, gg, ZU, jZ, fp, Ps, fU, E, cV, ui, sB, Dw, p, bks, yE, W, jo, uF, SF, Il, Oi, nP, cz, ac, LI, qp, ip, Jh, Ic, Nq, ajx, fP, kA, Yv, fq, bh, ap, eG, gf, iE); #c1(EGFL6) c2(NP_001161362) c3(3423) c4(29537, 42594, 55651, 16480, 68708) c5(X, jd, av, aJX, bgB); #c1(EGFL7) c2(XP_011517068) c3(3424) c4(29538, 42595, 55652, 16481, 68709) c5(fl, b, LF, aYW, aN, ey, aK, y, jb, m, co, bb, yl, pp, q, gX, aYX, O, u, aYh, qL, aYi, sB, LG, x, aYY); #c1(EGFL8) c2(NP_085155) c3(3425) c4(29539, 42596, 55653, 16482, 68710) c5(m, V, b, U, aE, aW); #c1(EGFLAM) c2(NP_001192230) c3(3426) c4(29540, 42597, 55654, 16483, 68711) c5(oy, xl, cO); #c1(EGFR) c2(NP_005219) c3(3427) c4(29541, 42598, 55655, 16484, 68712) c5(jp, en, EM, Vz, Tw, Ip, bkJ, aoK, e, PP, kJ, nZ, dl, mR, cl, bkH, anu, xc, fe, aC, wV, ft, ME, kN, pb, jE, Tu, bjF, OJ, ag, bkQ, acM, aA, avz, Dr, mZ, aal, X, oa, eu, ig, iG, bw, Oh, avA, cM, aAH, adr, AZ, hg, av, fy, OT, is, fi, vR, V, aFo, jC, bkO, Mp, aAE, auK, aY, cS, aAN, Tz, ji, vL, ck, auW, Ty, azn, Ag, Bc, pi, fv, aJ, aE, da, il, Mi, bc, gL, ad, Tt, aeC, aeo, cU, an, nV, hp, agb, yA, OS, af, QQ, Qv, fr, pR, iH, NA, jc, xa, iL, gE, aJi, RX, awz, bjp, rR, bky, bkK, dB, J, jo, YX, OW, bkB, asx, Af, E, rb, gl, dx, awh, iU, HG, auJ, qP, bkG, bf, O, RR, yg, DE, FN, Xi, Zv, oJ, ng, aGW, aeM, nl, du, agh, bp, auf, Ce, Gl, x, Lw, Yp, wh, aEN, bP, QF, Hk, afY, iP, py, mk, kY, cA, U, co, pw, f, bu, aoe, bkP, iJ, aEs, gv, YS, ny, Qt, cl, aH, bkp, QG, bkU, ti, JO, tl, apT, ajF, GD, jg, MS, QR, oi, z, apF, d, Dx, eA, jd, PA, q, ra, RF, hb, ar, iR, rX, o, ff, jj, VD, qL, anZ, LR, iD, et, Ut, jU, jH, Eu, ch, kM, bkF, xU, aof, fl, anE, k, afX, zY, LI, cB, fP, Xu, Fs, T, Ze, di, by, nk, js, auy, bkz, gj, bkE, aw, aZ, jt, ps, jR, iy, Vx, yJ, eE, g, p, bkx, Dt, fO, azo, fx, hR, OR, m, cT, kq, QD, Al, cY, kB, tp, agn, pp, aBO, aAa, B, gX, aEu, WE, ag, aUj, iT, aEg, bkl, v, Qz, bav, afn, bt, Fr, iA, Lx, bkM, JY, bkV, nJ, b, zH, jq, Bh, Mr, Sl, bkN, re, hV, OC, vu, iQ, bkD, Dg, et, cW, jM, Bg, cX, agf, atb, zO, asg, IO, gw, mW, ds, in, bkA, jx, QV, aIT, Qm, ajo, gT, avu, aBE, iZ, ik, bkS, PQ, Be, bks, W, bkL, Ql, asO, Xj, nP, AP, fM, aM, adu, zM, Yv, Ez, eG, ja, bx, F, gG, mC, w, cO, dv, cy, fp, Me, acy, Dd, Hs, gl, R, vO, lb, zU, od, Jj, jT, dL, ata, auk, fN, Qk, os, yE, Lo, i, dc, axq, wy, Kc, y, bkT, VO, ip, aOg, cs, NB, bm, iF, jB, YV, jh, Xr, aol, GQ, bkR, iY, aNp, gA, TQ, Xk, OG, An, QB, eR, ic, Og, anY, nS, zJ, jV, es, dQ, jG, Tv, u, wR, I, Tx, agg, Lc, ew, Ca, aAB, bjg, wP, dn, I, A, alg, aBK, ot, BY, D, hP, yw, ahF, bkG, MT, aX, fq, h, anM, auh, aoY, aJQ, QJ, Lg, fU, cV, P, bh, ac, qp, awA, QN, XH, IN, Oi, oT); #c1 (EGLN1) c2(NP_071334) c3(3428) c4(29542, 42599, 55656, 16485, 68713) c5(cY, si, pR, dB, vB, tH, e, y, d, aX, bkY, re, f, F, cU, pn, bla, iT, fh, tP, aC, be, ad, bkX, T, iA, jU, pq, anG, bkZ, u, bkW, in); #c1(EGLN2) c2(NP_444274) c3(3429) c4(29543, 42600, 55657, 16486, 68714) c5(bA, b, GL, hX, u, dB, Uq, WO, qL, fP, Iv, jU, aD, I, O, fy, aqp, y); #c1(EGLN3) c2(NP_071356) c3(3430) c4(29544, 42601, 55658, 16487, 68715) c5(A, bA, b, dB, tH, U, y, cp, hh, bb, kJ, B, F, q, bu, pn, O, aD, u, dh, HI, V, cV, ad, sf, T, VP, cK, by, jU, jH, ao, uJ, bm, ag, bg); #c1(EGR1) c2(NP_001955) c3(3431) c4(29545, 42602, 55659, 16488, 68716) c5(dx, pm, B, aw, Ob, dB, w, dd, bf, fR, ps, e, O, cU, dv, cy, Si, GG, ik, zR, Hs, oJ, g, JI, fe, aC, Gd, du, fO, ft, x, fx, jT, av, pq, wh, M, qt, vz, bm, hx, i, fN, pt, aA, gk, X, iP, jz, ld, hS, IW, JE, O, xw, cM, co, awA, rr, f, N, bu, cs, gg, fy, hD, iT, cj, aKq, V, cd, Fy, bt, mD, Fr, iA, P, add, oM, ci, gB, b, Ey, aBk, ey, d, jh, bb, re, q, ar, ff, hb, pB, n, HL, u, dh, o, fh, fs, il, LR, j, ad, sf, aZ, apm, et, wV, nV, Bu, ih, wP, fg, Ol, fl, I, bL, oC, A, k, fr, pR, ds, hA, jx, aHA, aX, awz, gD, h, F, HY, bn, aHY, y, jQ, NO, ma, ez, cV, sB, J, jo, T, Il, ji, by, pc, aM, Lc, Jh, Ic, fP, at); #c1(EGR2) c2(NP_001129650) c3(3432) c4(29546, 42603, 55660, 16489, 68717) c5(oC, cC, ER, cG, bld, sE, mW, hS, iL, bu, HQ, qZ, blc, ak, es, M, X, iZ, oJ, Qx, o, cV, aC, nl, j, cz, IG, by, ac, xV, wh, PL, Y, Jh, ble, blb, gl, m, ahe, at); #c1(EGR3) c2(NP_001186810) c3(3433) c4(29547, 42604, 55661, 16490, 68718) c5(oC, aw, b, jz, mW, dk, Iv, iL, jQ, m, u, gl, o, hW, j, IG, jv, hS, Jh, cT, T, at); #c1(EGR4) c2(NP_001956) c3(3434) c4(29548, 42605, 55662, 16491, 68719) c5(oC, NT, I, am); #c1 (EHBP1) c2(NP_001136087) c3(3435) c4(29549, 42606, 55663, 16492, 68720) c5(blf, A, B, cV); #c1(EHD1) c2(NP_001269374) c3(3436) c4(29550, 42607, 55664, 16493, 68721) c5(bQ, aX, I, Bu, cz, cK, aV); #c1(EHD2) c2(NP_055416) c3(3437) c4(29551, 42608, 55665, 16494, 68722) c5(dx, mi, b, aiW, jt, dB, akB, hS, iL, O, aBz, U, blg, G, yw, xl, cy, aAH, m, co, aX, DG, fy, qz, t, h, f, ajW, bgp, es, bfB, y, bgW, QJ, u, ahe, ff, g, le, V, I, qb, aC, NZ, J, cz, jo, dv, Il, aZ, be, BL, jT, P, du, aOB, Y, acK, cV, jR, fP, bk, gR, bM, dR, oT); #c1(EHD3) c2(NP_055415) c3(3438) c4(29552, 42609, 55666, 16495, 68723) c5(jS, IO, b, aGu, cO, cA, bli, ps, cM, m, aX, I, bj, h, N, blh, jV, O, adK, n, g, em, nl, aOb, lb, GS, aeU, P, zk, T, cy, apm, hR, qp, dP, py, aY, ci, ag, zp, dc, aA, at, fW); #c1(EHD4) c2(NP_644670) c3(3439) c4(29553, 42610, 55667, 16496, 68724) c5(c, aX, b, I, p, h, bl, aA, cp); #c1(EHF) c2(NP_001193545) c3(3440) c4(29554, 42611, 55668, 16497, 68725) c5(yg, A, bb, b, agQ, B, T, iG, cy, av, u); #c1(EHHADH) c2(NP_001159887) c3(3441) c4(29555, 42612, 55669, 16498, 68726) c5(oC, Zz, rf, blk, aF, oB, ak, q, ex, blj, T, cs, z, x, IV, o); #c1(EHMT1) c2(NP_001138999) c3(3442) c4(29556, 42613, 55670, 16499, 68727) c5(id, eu, bf, ey, aW, bll, rr, nU, u, aE, hW, V, I, blm, gF, aM, to, jR, jN, mD, aA, at, ap); #c1(EHMT2) c2(NP_001276342) c3(3443) c4(29557, 42614, 55671, 16500, 68728) c5(to, m, jV, V, b, lb, bp, dd, jN, iv, T, U, aV, u, jZ, aW); #c1(EI24) c2(XP_011541371) c3(3444) c4(29558, 42615, 55672, 16501, 68729) c5(A, aw, b, re, T, cB, yA, u, y); #c1(EID1) c2(NP_055150) c3(3445) c4(29559, 42616, 55673, 16502, 68730) c5(oi, Gj, iP, iG, o); #c1(EIF1AD) c2(NP_001229411) c3(3446) c4(29560, 42617, 55674, 16503, 68731) c5(aX); #c1(EIF1AX) c2(NP_001403) c3(3447) c4(29561, 42618, 55675, 16504, 68732) c5(jC, aX); #c1(EIF1AY) c2(NP_001265541) c3(3448) c4(29562, 42619, 55676, 16505, 68733) c5(wn, cz); #c1(EIF1) c2(NP_005792) c3(3449) c4(29563, 42620, 55677, 16506, 68734) c5(m, cy, q, vQ, gd, T, bV, iL, bh, eG); #c1(EIF2A) c2(NP_114414) c3(3450) c4(29564, 42621, 55678, 16507, 68735) c5(ma, f, fO, dl, fP, gE, at); #c1(EIF2AK1) c2(NP_055228) c3(3451) c4(29565, 42622, 55679, 16508, 68736) c5(da, aCy, JH, aCx, b, f, xe, mk, Oi, il, bb, u, y); #c1(EIF2AK2) c2(NP_001129124) c3(3452) c4(29566, 42623, 55680, 16509, 68737) c5(Dr, sa, en, jT, b, X, ik, mW, aN, EN, dk, w, iL, gE, al, A, e, sb, d, m, wZ, co, aX, I, cV, T, DM, f, g, fr, dQ, y, hZ, qj, hV, aV, u, gl, o, fh, aaQ, si, il, cV, bK, iv, bp, v, gL, J, P, fl, T, Il, bh, bb, ft, qT, eJ, an, fy, aeq, bm, ie, G, ag, cT, bq, oM, at, pt, Dg, ap); #c1(EIF2AK3) c2(NP_004827) c3(3453) c4(29567, 42624, 55681, 16510, 68738) c5(acE, Ir, b, dk, gE, bf, al, O, f, y, u, aE, TT, gL, dL, aM, fN, mB, cf, dh, fl, at); #c1(EIF2AK4) c2(NP_001013725) c3(3454) c4(29568, 42625, 55682, 16511, 68739) c5(beO, beQ, aeq, b, blo, cJ, bln, f, ZE, IR, IX, IS, II, IW, sc, oD, aey, pp); #c1(EIF2B1) c2(NP_001405) c3(3455) c4(29569, 42626, 55683, 16512, 68740) c5(hT, cJ, bK, f, v, dt, blq, ak, jw, blp, Ap); #c1(EIF2B2) c2(NP_055054) c3(3456) c4(29570, 42627, 55684, 16513, 68741) c5(hT, cJ, bK, f, v, Dm, dt, blq, ak, jw, blp, Ap); #c1(EIF2B3) c2(XP_011540698) c3(3457) c4(29571, 42628, 55685, 16514, 68742) c5(blp, blq); #c1(EIF2B4) c2(NP_001029288) c3(3458) c4(29572, 42629, 55686, 16515, 68743) c5(hT, kF, cJ, bK, f, v, jw, dt, blq, ak, ji, bc, blp, aA, Ap); #c1(EIF2B5) c2(NP_003898) c3(3459) c4(29573, 42630, 55687, 16516, 68744) c5(blr, aV, b, f, acg, hS, blq, ji, blp); #c1(EIF2S1) c2(NP_004085) c3(3460) c4(29574, 42631, 55688, 16517, 68745) c5(Dr, blo, nU, Ir, pF, b, fN, fr, bo, dk, fl, HS, iL, gE, bf, e, y, d, co, f, iZ, cs, fH, u, dh, o, jE, fl, v, gv, W, P, T, Il, QZ, ft, fJ, aM, ao, nV, aAu, bm, Yg, jZ, fP, TT, bh); #c1(EIF2S2) c2(NP_003899) c3(3461) c4(29575, 42632, 55689, 16518, 68746) c5(blo, ak, bo, gE, bf, jw, blp, e, y, d, f, blq, u, dh, jE, cJ, bK, v, gv, dt, P, Il, bh, QZ, Ap, aM, ao, bm, hT, TT, nU); #c1(EIF2S3) c2(NP_001406) c3(3462) c4(29576, 42633, 55690, 16519, 68747) c5(blo, nU, bo, gE, bf, e, y, d, f, bm, dh, jE, aC, bK, v, gv, P, Il, QZ, aM, ao, u, TT, bh); #c1(EIF3A) c2(NP_003741) c3(3463) c4(29577, 42634, 55691, 16520, 68748) c5(WE, A, td, b, k, X, w, gE, Ir, e, O, d, co, t, h, fr, ar, y, av, fy, u, cc, g, J, ft, G, T, by, jG, ji); #c1(EIF3B) c2(NP_001032360) c3(3464) c4(29578, 42635, 55692, 16521, 68749) c5(A, b, cV, B, q, P, T, i, la, fx, fy, oP); #c1(EIF3C) c2(NP_001254503) c3(3465) c4(29579, 42636, 55693, 16522, 68750) c5(wP, wV, EM); #c1(EIF3E) c2(NP_001559) c3(3466) c4(29580, 42637, 55694, 16523, 68751) c5(b, X, bp, T, x, fy, u, y, fh); #c1(EIF3F) c2(NP_003745) c3(3467) c4(29581, 42638, 55695, 16524, 68752) c5(aX, b, aY, ag, fv, bw); #c1(EIF3H) c2(NP_003747) c3(3468) c4(29582, 42639, 55696, 16525, 68753) c5(A, V, b, Ec, Si, q, T, B, iL, U, fy, u, y); #c1(EIF3J) c2(NP_001271265) c3(3469) c4(29583, 42640, 55697, 16526, 68754) c5(co, fy, b); #c1(EIF3K) c2(NP_037366) c3(3470) c4(29584, 42641, 55698, 16527, 68755) c5(dx, bL, lw, afb, b, asx, blt, Ik, FM, AA, id, wh, cO, ai, acU, U, xl, c, xQ, BM, cy, kW, Jm, XH, oB, bIs, q, VI, cc, blu, aaZ, jT, oJ, IS, cl, aNN, kz, atW, kG, I, nl, el, du, Dw, J, IR, IX, hR, dv, AF, Ij, oD, rO, aCT, dt, ao, at, f, mz, Y, wD, tJ, P, cK, QV, At, aEb, xP, adg, iB, dR, cG, IZ); #c1(EIF3M) c2(NP_006351) c3(3471) c4(29585, 42642, 55699, 16528, 68756) c5(at, cs, b, ad); #c1(EIF4A1) c2(NP_001191439) c3(3472) c4(29586, 42643, 55700, 16529, 68757) c5(en, b, f, gm, J, P, gE, Yr, jT, u, y); #c1(EIF4A2) c2(NP_001958) c3(3473) c4(29587, 42644, 55701, 16530, 68758) c5(fl, en, iP, I, b, py, f, gm, J, co, jT, gE, fy, u, y); #c1(EIF4A3) c2(NP_055555) c3(3474) c4(29588, 42645, 55702, 16531, 68759) c5(bIv, re, DH, bu, bw, by, arJ); #c1(EIF4B) c2(NP_001408) c3(3475) c4(29589, 42646, 55703, 16532, 68760) c5(cA, d, B, e); #c1(EIF4E2) c2(NP_001263265) c3(3476) c4(29590, 42647, 55704, 16533, 68761) c5(fy, b); #c1(EIF4E3) c2(NP_001128121) c3(3477) c4(29591, 42648, 55705, 16534, 68762) c5(U, u, V, y); #c1 (EIF4EBP1) c2(NP_004086) c3(3478) c4(29592, 42649, 55706, 16535, 68763) c5(bP, A, lr, b, cY, aF, jj, O, kB, w, NH, gE, bf, U, ey, y, jh, jv, co, aX, pp, h, ak, q, jV, cU, cc, B, cs, jG, fy, u, o, ff, fi, gG, V, m, GS, gm, fO, ad, W, P, fl, T, iy, gF, by, aM, jT, NG, ih, ag, pH, fD, th, ji, aA, eG); #c1(EIF4EBP2) c2(NP_004087) c3(3479) c4(29593, 42650, 55707, 16536, 68764) c5(m, V, b, X, cz, gF, bf, U, aA, aM); #c1(EIF4EBP3) c2(NP_003723) c3(3480) c4(29594, 42651, 55708, 16537, 68765) c5(YR, U, V); #c1(EIF4E) c2(NP_001124150) c3(3481) c4(29595, 42652, 55709, 16538, 68766) c5(en, aw, gG, aN, w, ps, e, O, BO, kJ, dI, fH, Qx, og, lb, cs, fD, bp, nV, x, jT, jE, ag, Dr, GD, avX, X, iP, jz, kY, bo, U, xw, kV, y, aIS, co, ip, B, bu, DP, iv, av, fy, bm, iT, fi, V, Dp, iA, fJ, py, cz, ji, b, aF, d, jh, Bc, re, nU, q, ar, pB, u, da, Kx, wp, gL, by, bIw, aeq, KK, iR, Sk, fI, A, gE, jw, jQ, m, aX, iI, h, F, cU, ik, n, aCr, Be, J, W, T, II, ad, ast, js, Oi); #c1(EIF4ENIF1) c2(NP_001157974) c3(3482) c4(29596, 42653, 55710, 16539, 68767) c5(jw, wp, Fg); #c1(EIF4G1) c2(NP_001181876) c3(3483) c4(29597, 42654, 55711, 16540, 68768) c5(en, b, iP, bg, gE, bj, e, y, d, m, MT, f, QJ, u, BT, gL, P, T, aYj, jT, bly, aeq, bdW, py, blx, fl); #c1(EIF4G2) c2(NP_001036024) c3(3484) c4(29598, 42655, 55712, 16541, 68769) c5(azz, A, bS, b, aIV, U, e, y, d, co, aX, Os, iR, re, f, F, q, jV, bu, awd, KL, cs, oD, u, o, V, cV, v, bp, ad, W, T, jl, fx, by, ao, dP, bkg, blz, hq, B, ag, amS, iT, i, apU); #c1(EIF4H) c2(NP_071496) c3(3485) c4(29599, 42656, 55713, 16542, 68770) c5(b, V, I, aC, fl, ad, di, aIM, cs, U, at, aE); #c1(EIF5A2) c2(NP_065123) c3(3486) c4(29600, 42657, 55714, 16543, 68771) c5(jh, aw, b, am, X, q, oH, w, T, fx, i, aX, av, fy, iR, U); #c1(EIF5A) c2(NP_001137232) c3(3487) c4(29601, 42658, 55715, 16544, 68772) c5(B, aw, b, X, eW, w, bw, bf, U, A, Ag, co, f, q, ar, cs, as, av, fy, aE, V, ae, an, kt, J, bp, ad, P, T, jT, aM, Af, ji); #c1(EIF5) c2(NP_892116) c3(3488) c4(29602, 42659, 55716, 16545, 68773) c5(ae, X, bp, ar, ji, av); #c1(EIF6) c2(NP_001254739) c3(3489) c4(29603, 42660, 55717, 16546, 68774) c5(co, V, b, J, bu, W, P, T, U, by, u, y); #c1(ELAC1) c2(NP_061166) c3(3490) c4(29604, 42661, 55718, 16547, 68775) c5(sE, A, B); #c1(ELAC2) c2(NP_001159434) c3(3491) c4(29605, 42662, 55719, 16548, 68776) c5(A, cy, b, bIB, B, bIA, T, o, bF, Up, sK); #c1(ELANE) c2(NP_001963) c3(3492) c4(29606, 42663, 55720, 16549, 68777) c5(dx, ml, aw, sE, blF, blE, cO, blD, cy, lZ, Mu, fH, ael, lb, du, bp, jT, dL, zQ, f, pP, aFI, mx, dh, bk, fN, bq, aA, aFd, vl, y, co, bi, ln, cs, gg, fy, bm, cj, jB, le, aXd, pi, fJ, xd, dy, ci, ap, b, aF, bb, q, jV, vu, atT, jG, u, dr, o, aP, blG, im, ad, rw, aZ, XR, jU, iw, hU, ex, gd, I, aXD, aYa, eb, oy, m, h, M, hN, n, aq, wF, be, J, dt, T, gF, blC, gf, bh, at, ja); #c1(ELAVL1) c2(NP_001410) c3(3493) c4(29607, 42664, 55721, 16550, 68778) c5(dx, b, iP, w, Eh, ba, e, y, d, m, aX, apd, jd, aEz, f, F, bu, ar, O, cs, av, u, aC, Dg, du, ad, W, T, x, ao, jR, eG, AX); #c1(ELAVL2) c2(NP_001164668) c3(3494) c4(29608, 42665, 55722, 16551, 68779) c5(A, b, beC, cO, y, cy, oy, qf, co, aX, h, ak, bu, cU, O, cs, HE, fy, u, Fg, fU, hW, I, cV, bp, ad, bb, by, qe, ao, o, at); #c1(ELAVL3) c2(NP_001411) c3(3495) c4(29609, 42666, 55723, 16552, 68780) c5(fU, kF, bm, q, akT, i, fl, fx, iR); #c1(ELAVL4) c2(NP_001281277) c3(3496) c4(29610, 42667, 55724, 16553, 68781) c5(co, cV, beC, xJ, bp, MO, dk, fU, hM, bj); #c1(ELF1) c2(NP_001138825) c3(3497) c4(29611, 42668, 55725, 16554, 68782) c5(fn, m, h, q, bT, cU, P, cB, re, iT); #c1(ELF2) c2(NP_001263386) c3(3498) c4(29612, 42669, 55726, 16555, 68783) c5(h, lv, vQ); #c1(ELF3) c2(NP_001107781) c3(3499) c4(29613, 42670, 55727, 16556, 68784) c5(B, b, pR, aYW, eH, A, iC, e, y, jx, d, ed, co, cy, LN, h, f, F, YX, aJQ, cM, sh, ar, u, aC, bc, LG, wV, sg, aY, aUN, bIH, wP, dc, wz); #c1(ELF4) c2(XP_005262446) c3(3500) c4(29614, 42671, 55728, 16557, 68785) c5(BO, fs, b, X, hZ, h, aiW, fO, iV, aof, w, O, rT, av, jT, u, Ry, y); #c1(ELF5) c2(NP_001230009) c3(3501) c4(29615, 42672, 55729, 16558, 68786) c5(ao, cy, hT, T, Wo, u, y); #c1(ELK1) c2(NP_001244097) c3(3502) c4(29616, 42673, 55730, 16559, 68787) c5(dx, f, bg, w, vZ, aaZ, U, A, y, jx, m, dv, gC, yQ, h, aqs, q, bu, kz, ar, B, u, fs, V, cV, nx, nz, du, v, lR, lX, zi, Nh, Lt, iR, lS, mD); #c1(ELK3) c2(XP_006719338) c3(3503) c4(29617, 42674, 55731, 16560, 68788) c5(fn, Zm, ak, b, aF, EM, sE, dj, tR, di, aWt, vl, wX, cA, bw, U, pl, cM, bb, yX, ahj, PK, aFH, oE, tF, y, qq, Pv, fy, u, o, aBs, fU, V, im, blI, IM, Ej, Zr, jJ, aIM, afb, VP, qV, qp, aaz, K, aei, aiY, dc, abt, aY, FY); #c1(ELK4) c2(NP_068567) c3(3504) c4(29618, 42675, 55732, 16561, 68789) c5(Zm, A, V, ae, aF, sE, Dp, Zr, B, sj, w, Ba, beG, O, pB, U, u, y); #c1(ELL2) c2(NP_036213) c3(3505) c4(29619, 42676, 55733, 16562, 68790) c5(oy); #c1(ELL) c2(NP_006523) c3(3506) c4(29620, 42677, 55734, 16563, 68791) c5(A, b, h, B, jL, J, M, iv); #c1(ELMO1) c2(NP_569709) c3(3507) c4(29621, 42678, 55735, 16564, 68792) c5(jH, I, u, t, hT, dA, py, ig, aE, fD, bq, et, bT, O, n); #c1(ELMO2) c2(NP_877496) c3(3508) c4(29622, 42679, 55736, 16565, 68793) c5(1); #c1(ELMOD1) c2(NP_001123509) c3(3509) c4(29623, 42680, 55737, 16566, 68794) c5(do, bb, beH); #c1(ELMOD2)

c2(NP_714913) c3(3510) c4(29624, 42681, 55738, 16567, 68795) c5(LR); #c1(ELMOD3) c2(NP_001128494) c3(3511) c4(29625, 42682, 55739, 16568, 68796) c5(Bx, bIJ); #c1(ELMSAN1) c2(NP_919254) c3(3512) c4(29626, 42683, 55740, 16569, 68797) c5(ho); #c1(ELN) c2(NP_000492) c3(3513) c4(29627, 42684, 55741, 16570, 68798) c5(dx, eX, lr, ael, w, bV, cO, Ux, bW, gO, dv, Vx, bIQ, nv, kP, Jf, sH, du, bIR, vc, aiL, FW, mO, AL, K, tO, dX, fD, cB, bq, lu, bIK, hS, sF, IW, GV, vl, azq, y, bC, hi, pp, f, bIN, tv, gg, hf, cd, lh, aIM, rT, aiv, aYY, xd, dy, er, IP, bIL, wl, Iz, ap, nU, b, PC, cK, bIU, bIM, bIO, vj, bIP, vu, wj, hV, u, dr, o, aIy, bU, aP, bIS, cz, da, G, IG, pD, aZ, rO, Mw, mk, ch, cC, gd, Ol, l, bL, UA, tR, di, aW, qs, cr, bbT, h, wN, qr, aCM, Ex, Hx, NO, HI, wF, wo, dt, wX, aX, bh, at, bIT); #c1(ELOF1) c2(NP_115753) c3(3514) c4(29628, 42685, 55742, 16571, 68799) c5(fn, m, h, cU, P, cB, aV, re, iT); #c1(ELOVL2) c2(NP_060240) c3(3515) c4(29629, 42686, 55743, 16572, 68800) c5(am); #c1(ELOVL4) c2(NP_073563) c3(3516) c4(29630, 42687, 55744, 16573, 68801) c5(b, bIX, lr, or, nQ, bIW, nI, mI, UA, bIV, nv, ea, SF, IL, cK, kV, nW, aW); #c1(ELOVL5) c2(NP_001229757) c3(3517) c4(29631, 42688, 55745, 16574, 68802) c5(lg, ez, er, rw, aA, kV, ey); #c1(ELOVL6) c2(XP_011530536) c3(3518) c4(29632, 42689, 55746, 16575, 68803) c5(dx, da, du, f, JH, bIY, Ks, LR, xe, gF, fq, dv, pt, fl, aAM, Xx, gj, oM, aA, gg, ac); #c1(ELOVL7) c2(NP_001098028) c3(3519) c4(29633, 42690, 55747, 16576, 68804) c5(bb, A, mg, B); #c1(ELP2) c2(NP_001229804) c3(3520) c4(29634, 42691, 55748, 16577, 68805) c5(av, nU, f, bk); #c1(ELP3) c2(NP_001271151) c3(3521) c4(29635, 42692, 55749, 16578, 68806) c5(aqR, ao, cy, v); #c1(ELP4) c2(NP_001275654) c3(3522) c4(29636, 42693, 55750, 16579, 68807) c5(IL, kl, akp); #c1(ELP6) c2(NP_001026873) c3(3523) c4(29637, 42694, 55751, 16580, 68808) c5(aE, Y); #c1(ELSPBPI) c2(NP_071425) c3(3524) c4(29638, 42695, 55752, 16581, 68809) c5(kB, dA); #c1(EMB) c2(NP_940851) c3(3525) c4(29639, 42696, 55753, 16582, 68810) c5(m, hU, sE, J, mW, q, P, vQ, gE, gj, cr, gl, fp, C); #c1(EMC10) c2(NP_778233) c3(3526) c4(29640, 42697, 55754, 16583, 68811) c5(O, VX, EC, b, k); #c1(EMC2) c2(NP_055488) c3(3527) c4(29641, 42698, 55755, 16584, 68812) c5(cO); #c1(EMC3) c2(NP_060917) c3(3528) c4(29642, 42699, 55756, 16585, 68813) c5(bIZ, kJ, h, mR, Bm, sK); #c1(EMC7) c2(NP_064539) c3(3529) c4(29643, 42700, 55757, 16586, 68814) c5(cK); #c1(EMC8) c2(NP_001135760) c3(3530) c4(29644, 42701, 55758, 16587, 68815) c5(bb, et, BX, ny, ip); #c1(EMCN) c2(NP_001153166) c3(3531) c4(29645, 42702, 55759, 16588, 68816) c5(VM, aC, t, mk, G, JC, fq); #c1(EMD) c2(NP_000108) c3(3532) c4(29646, 42703, 55760, 16589, 68817) c5(g, afE, Ik, eu, QY, AA, id, rO, xl, bC, fe, cK, M, mL, mR, cc, sX, Yr, oD, bma, bU, IO, kG, c, aC, nI, J, gL, FM, P, Nh, Hh, hR, aLz, aTs, aWz, fP, fl, BK); #c1(EME1) c2(NP_689676) c3(3533) c4(29647, 42704, 55761, 16590, 68818) c5(g, b, ad, w, cs, aV, u, O); #c1(EMG1) c2(NP_006322) c3(3534) c4(29648, 42705, 55762, 16591, 68819) c5(fe, es, u, P, bmb); #c1(EMILIN1) c2(NP_008977) c3(3535) c4(29649, 42706, 55763, 16592, 68820) c5(X, av, di, VJ, qs); #c1(EMILIN2) c2(NP_114437) c3(3536) c4(29650, 42707, 55764, 16593, 68821) c5(b, di, bw, ar, u, y); #c1(EMILIN3) c2(NP_443078) c3(3537) c4(29651, 42708, 55765, 16594, 68822) c5(ik); #c1(EML1) c2(NP_001008707) c3(3538) c4(29652, 42709, 55766, 16595, 68823) c5(o, kJ); #c1(EML2) c2(NP_001180197) c3(3539) c4(29653, 42710, 55767, 16596, 68824) c5(aX, ag, vu, T, u, y); #c1(EML4) c2(NP_001138548) c3(3540) c4(29654, 42711, 55768, 16597, 68825) c5(g, d, jT, fU, aw, QN, b, bp, Ty, co, T, fy, ji, ar, av, YY, e); #c1(EML5) c2(NP_899243) c3(3541) c4(29655, 42712, 55769, 16598, 68826) c5(aX, ag, vu, T, u, y); #c1(EML6) c2(NP_001034842) c3(3542) c4(29656, 42713, 55770, 16599, 68827) c5(bw, qf, aA); #c1(EMPI) c2(NP_001414) c3(3543) c4(29657, 42714, 55771, 16600, 68828) c5(fn, aEg, A, b, sE, e, y, d, co, B, bu, awd, fy, u, g, Uv, by, P, zk, BV, eF, Fo, fw, zp, bq); #c1(EMP2) c2(XP_006720927) c3(3544) c4(29658, 42715, 55772, 16601, 68829) c5(b, cG, cV, bd, iA, iR, RR); #c1(EMX1) c2(NP_004088) c3(3545) c4(29659, 42716, 55773, 16602, 68830) c5(yD); #c1(EMX2) c2(NP_001159396) c3(3546) c4(29660, 42717, 55774, 16603, 68831) c5(aw, b, GF, cM, co, js, ak, bu, cU, ar, sV, UF, FR, bp, by, Ao, iA, vA, bmc, aY, ji, at, eG); #c1(EN1) c2(NP_001417) c3(3547) c4(29661, 42718, 55775, 16604, 68832) c5(bK, bj, aV, arl, rb); #c1(EN2) c2(NP_001418) c3(3548) c4(29662, 42719, 55776, 16605, 68833) c5(A, b, Nw, bj, B, dB, jR, Wh, rQ, jG, cz, u); #c1(ENAH) c2(NP_001008493) c3(3549) c4(29663, 42720, 55777, 16606, 68834) c5(m, fl, P, T, sU, cO, U, u); #c1(ENAM) c2(NP_114095) c3(3550) c4(29664, 42721, 55778, 16607, 68835) c5(Ur, gE, be, bY, bme, kC, ku, bh, bmd, bcD, gv, bmf); #c1(ENC1) c2(XP_011541999) c3(3551) c4(29665, 42722, 55779, 16608, 68836) c5(g, b, cV, f, dB, q, ad, P, cs, U, u, zD); #c1(ENDOG) c2(NP_004426) c3(3552) c4(29666, 42723, 55780, 16609, 68837) c5(d, A, V, b, Be, h, B, q, fO, bu, cc, cB, cO, n, U, u, e, y, fh); #c1(ENDOU) c2(NP_001165910) c3(3553) c4(29667, 42724, 55781, 16610, 68838) c5(ak, hW, aY, rr, f, v, ih, Ey, dc, cA, u, cM); #c1(ENDOV) c2(NP_001158109) c3(3554) c4(29668, 42725, 55782, 16611, 68839) c5(x, Lq, Dj, cq); #c1(ENGASE) c2(NP_001036038) c3(3555) c4(29669, 42726, 55783, 16612, 68840) c5(aC, u, y, b); #c1(ENG) c2(NP_000109) c3(3556) c4(29670, 42727, 55784, 16613, 68841) c5(jp, B, aw, dB, w, cO, pz, e, gB, Hs, fe, aC, sH, bp, ft, Ce, od, su, cq, wh, CB, ag, cT, i, bq, X, eu, kB, sF, IW, bw, U, Co, y, co, f, N, bu, cs, IS, av, iT, cj, V, IR, iA, xd, py, jd, VE, Gw, CA, ci, ap, b, z, fD, d, jh, bb, MX, re, q, es, Cu, vu, ar, ff, oO, u, amO, il, gL, ad, IX, aHG, aeC, jH, ao, iR, eQ, Cr, Cv, fg, bmg, I, Mp, bL, A, fr, og, di, JC, Iw, wf, aI, Ct, oy, aX, h, F, cU, Cz, ik, n, ax, dU, jo, T, j, bh, cr, by, fM, Jh, G, fP, Q, eN, rb); #c1(ENH0) c2(NP_940975) c3(3557) c4(29671, 42728, 55785, 16614, 68842) c5(em, aA, rf); #c1(ENO2) c2(NP_001966) c3(3558) c4(29672, 42729, 55786, 16615, 68843) c5(A, MZ, jT, b, fN, Pv, EM, jt, aN, w, abr, jR, xw, aK, y, jx, axd, fe, co, bb, ml, f, es, ND, jQ, bmi, Dg, Tk, apv, aFN, u, dh, o, oP, aaQ, ma, cV, hZ, Vh, aB, kp, W, bmh, jz, T, bp, ji, wy, Qx, fU, eJ, pk, fy, gt, ch, aq, fw, B, yE, cT, i, fl, rw, Nx, aA, jP, h, vL); #c1(ENO3) c2(NP_001180432) c3(3559) c4(29673, 42730, 55787, 16616, 68844) c5(kG, bmj, hx, sO, J, Ip, tF, z, jT); #c1(ENO4) c2(NP_001229628) c3(3560) c4(29674, 42731, 55788, 16617, 68845) c5(am); #c1(ENOPH1) c2(NP_067027) c3(3561) c4(29675, 42732, 55789, 16618, 68846) c5(vt, nU, bmk, aiy); #c1(ENOSF1) c2(NP_001119595) c3(3562) c4(29676, 42733, 55790, 16619, 68847) c5(dx, b, aVH, xf, iL, U, aIS, bb, apx, cU, u, fh, V, ae, kt, du, cd, dt, Nh, iA, ast, aVI); #c1(ENOX1) c2(NP_001121087) c3(3563) c4(29677, 42734, 55791, 16620, 68848) c5(oy, aC, aCT, b); #c1(ENOX2) c2(XP_011529546) c3(3564) c4(29678, 42735, 55792, 16621, 68849) c5(by, cl, b, bu); #c1(ENPEP) c2(NP_001968) c3(3565) c4(29679, 42736, 55793, 16622, 68850) c5(A, aw, eu, w, di, cA, e, y, d, Hq, azb, re, B, WO, aoQ, sb, n, u, ff, cj, Mi, Fw, dB, J, cz, W, P, od, wd, Fz, sh, dR, ci); #c1(ENPPI) c2(NP_006199) c3(3566) c4(29680, 42737, 55794, 16623, 68851) c5(bP, dx, aDX, dN, ag, ey, gE, VY, big, aE, asZ, et, w, AQ, cO, amK, bf, rH, rJ, A, bmo, AO, zM, bQ, bb, b, dy, bmn, bfO, bmI, B, om, y, mm, pq, u, dr, amO, amL, ae, mz, nl, kF, fD, I, aC, sH, du, fO, cx, dK, dt, dv, me, rT, gF, et, su, aM, rd, bfN, LO, fN, Io, mA, AR, eX, rh, zD, o, i, bq, di, aA, at, eG, bmm, ap); #c1(ENPP2) c2(NP_001035181) c3(3567) c4(29681, 42738, 55795, 16624, 68852) c5(gK, B, b, X, dB, A, si, gE, aI, y, dN, hV, q, ra, fH, u, be, VD, cV, aC, LR, bmp, fO, fJ, nV, ch, DR, nJ, bh, eN); #c1(ENPP3) c2(NP_005012) c3(3568) c4(29682, 42739, 55796, 16625, 68853) c5(dP, b, h, zh, q, x, apP, T, iL, et, bkc, bm, bmo, QM, ap); #c1(ENPP5) c2(XP_005249317) c3(3569) c4(29683, 42740, 55797, 16626, 68854) c5(A); #c1(ENPP7) c2(NP_848638) c3(3570) c4(29684, 42741, 55798, 16627, 68855) c5(x, cs, bk, ad); #c1(ENTHD2) c2(NP_653280) c3(3571) c4(29685, 42742, 55799, 16628, 68856) c5(da); #c1(ENTPDI) c2(NP_001091645) c3(3572) c4(29686, 42743, 55800, 16629, 68857) c5(bP, bL, eX, b, mZ, aF, pD, GE, hM, bf, jD, rY, nU, bmr, cy, aV, pP, dh, gD, I, bx, aX, P, bb, hR, jU, aM, ch, fw, bmq, ag, cT, fP, fD, vZ, at); #c1(ENTPD2) c2(NP_001237) c3(3573) c4(29687, 42744, 55801, 16630, 68858) c5(gK, aX, q, ag, di, bm, bT); #c1(ENTPD4) c2(NP_001122402) c3(3574) c4(29688, 42745, 55802, 16631, 68859) c5(b); #c1(ENTPD5) c2(XP_006720387) c3(3575) c4(29689, 42746, 55803, 16632, 68860) c5(A, V, b, f, gT, GB, BY, ck, B, Lr, Ez, U, wy, u, rR); #c1(ENTPDG) c2(NP_001107561) c3(3576) c4(29690, 42747, 55804, 16633, 68861) c5(wP, wV); #c1(ENTPD7) c2(NP_065087) c3(3577) c4(29691, 42748, 55805, 16634, 68862) c5(o); #c1(EOGT) c2(NP_001265618) c3(3578) c4(29692, 42749, 55806, 16635, 68863) c5(aeE, bms); #c1(EOMES) c2(NP_001265111) c3(3579) c4(29693, 42750, 55807, 16636, 68864) c5(ao, Dc, dB, wV, wP, Lo, II, i, cO, QZ, Ez, fx, aV); #c1(EP300) c2(NP_001420) c3(3580) c4(29694, 42751, 55808, 16637, 68865) c5(KC, IJ, A, b, X, aF, jL, Rf, w, di, wf, U, aCX, y, d, aIS, co, aX, iR, t, h, f, N, q, e, cU, bmu, B, cs, Ek, av, fy, u, n, ma, V, jh, by, nl, gm, J, ad, T, iA, hR, dL, jG, fU, jT, gs, ch, bmt, LE, G, HM, m, i, fN, vZ, aA, rh); #c1(EP400) c2(NP_056224) c3(3581) c4(29695, 42752, 55809, 16638, 68866) c5(h, q, jZ, cB, U, bmv); #c1(EPASI) c2(NP_001421) c3(3582) c4(29696, 42753, 55810, 16639, 68867) c5(fh, wa, hq, jT, b, k, X, pR, bmz, VP, i, pD, O, kB, A, tH, kY, IW, GV, U, bmy, y, d, tp, co, Ml, ip, t, h, f, e, q, bu, pn, ar, B, cs, oO, av, Hs, u, iT, ff, da, Hl, jB, fU, V, bmx, aC, dB, J, dA, ad, jo, T, cV, ji, x, aX, D, by, pq, jE, fy, Eu, anG, bkZ, bm, bmw, G, ag, yM, zS, at); #c1(EPB41L1) c2(NP_001245258) c3(3583) c4(29697, 42754, 55811, 16640, 68868) c5(bmA, aw, b); #c1(EPB41L2) c2(NP_001129026) c3(3584) c4(29698, 42755, 55812, 16641, 68869) c5(qf, Fg); #c1(EPB41L3) c2(NP_001268462) c3(3585) c4(29699, 42756, 55813, 16642, 68870) c5(A, b, X, jq, pR, dB, FE, vY, ajf, y, oy, co, jd, B, ar, av, fy, u, EM, g, fU, bp, zU, T, ao, ji, at); #c1(EPB41L4A) c2(NP_071423) c3(3586) c4(29700, 42757, 55814, 16643, 68871) c5(aW); #c1(EPB41L4B) c2(NP_060894) c3(3587) c4(29701, 42758, 55815, 16644, 68872) c5(A, aw, b, B, u, y); #c1(EPB42) c2(NP_001107606) c3(3588) c4(29702, 42759, 55816, 16645, 68873) c5(CY, bmB, VX, EC, aU); #c1(EPC1) c2(NP_001258933) c3(3589) c4(29703, 42760, 55817, 16646, 68874) c5(h, jz, J, Tw, aeR, jQ); #c1(EPC2) c2(NP_056445) c3(3590) c4(29704, 42761, 55818, 16647, 68875) c5(jh, h, ik, J, i, o); #c1(EPCAM) c2(NP_002345) c3(3591) c4(29705, 42762, 55819, 16648, 68876) c5(B, aw, dB, iq, e, gO, yg, kJ, FN, og, arp, bp, Ce, od, x, fx, pq, pb, jE, os, ag, i, mD, Dr, X, eu, wy, bw, U, Oh, y, co, bmD, f, bu, cs, av, fy, bm, iT, jB, V, jh, iA, py, ji, hV, kE, b, Og, d, Ag, re, gz, q, ar, as, u, iI, by, sf, nV, ab, fl, Mp, af, bmE, A, bmC, gE, nT, aX, Qm, F, Lh, cU, ik, cB, an, W, T, fO, ad, pp, Af, afV, Oi, bmF); #c1(EPDR1) c2(NP_060019) c3(3592) c4(29706, 42763, 55820, 16649, 68877) c5(bq, A); #c1(EPG5) c2(NP_066015) c3(3593) c4(29707, 42764, 55821, 16650, 68878) c5(d, bmG, V, b, gT, ik, cK, U, u, e, y, pp); #c1(EPGN) c2(NP_001257918) c3(3594) c4(29708, 42765, 55822, 16651, 68879) c5(Fh, qw, dA); #c1(EPHA1) c2(NP_005223) c3(3595) c4(29709, 42766, 55823, 16652, 68880) c5(AI, b, qP, kB, w, ic, U, hP, e, y, d, aX, t, q, gT, ar, O, cs, u, o, QD, V, aC, gm, ad, W, G, Ql, T, ji, jT, yG, ao, bjE, bm, ie, cT, bmH, Oi, yA, C); #c1(EPHA3) c2(NP_005224) c3(3596) c4(29710, 42767, 55824, 16653, 68881) c5(fr, jT, b, X, yz, pD, ajW, EN, IB, w, akL, dV, bw, oU, y, co, aX, akJ, f, q, bu, Vr, bml, ar, O, iv, Jm, zR, u, cl, Kx, cV, bmJ, cs, dB, bp, ad, P, T, dZ, Ij, ft, av, mO, an, ii, hS, akO, IV, ie, jR, by, oj, agm, t); #c1(EPHA4) c2(NP_001291465) c3(3597) c4(29711, 42768, 55825, 16654, 68882) c5(A, b, cY, bmL, mk, w, z, U, bj, O, V, co, aX, kJ, B, je, ar, bmK, P, T, HL, ao, vz, fG, ag, ji); #c1(EPHA5) c2(NP_001268694) c3(3598) c4(29712, 42769, 55826, 16655, 68883) c5(Pv, PL, u, O, y); #c1(EPHA6) c2(NP_001073917) c3(3599) c4(29713, 42770, 55827, 16656, 68884) c5(aA, at, agw); #c1(EPHA7) c2(NP_001275559) c3(3600) c4(29714, 42771, 55828, 16657, 68885) c5(fU, cs, V, b, B, bmL, gm, ad, w, T, co, iv, fH, U, jT, A, fJ, vz); #c1(EPHB1) c2(NP_004432) c3(3601) c4(29715, 42772, 55829, 16658, 68886) c5(fn, jJ, b, EM, dj, tR, di, jP, vl, O, cA, wX, U, oE, bj, pi, cM, d, bb, yX, aFH, e, q, bu, ik, dc, aBs, fU, V, I, im, aC, qq, Ej, by, QI, T, VP, qV, jT, qp, aei, aY, bll, at, FY); #c1(EPHB3) c2(NP_004434) c3(3602) c4(29716, 42773, 55830, 16659, 68887) c5(d, qf, fy, V, b, W, T, asj, ct, U, QJ, e); #c1(EPHB4) c2(NP_004435) c3(3603) c4(29717, 42774, 55831, 16660, 68888) c5(A, uy, b, X, iP, Iw, U, e, y, d, jh, co, LS, t, mI, B, F, q, bu, cU, O, cs, av, u, aE, og, V, il, J, bp, ad, gO, G, T, Qt, et, fx, by, et, yG, jT, bm, vT, Cr, ag, i, re); #c1(EPHB6) c2(NP_001267724) c3(3604) c4(29718, 42775, 55832, 16661, 68889) c5(GD, aw, b, iL, bf, y, co, rY, pp, ja, q, rR, fy, bm, jB, apx, cV, P, ji, aX, aM, u, Qk, cT, Ez); #c1(EPHX1) c2(NP_000111) c3(3605) c4(29719, 42776, 55833, 16662, 68890) c5(B, e, cy, t, bmM, fH, g, aBE, sH, bp, vc, GI, x, fx, jT, pq, cT, i, bq, GD, X, iP, mk, GI, IW, U, y, yt, co, hi, ip, f, bu, tv, cs, av, fy, bm, iT, VfC, jh, gv, fJ, GB, qh, fW, b, Fc, tG, z, nS, d, Ag, re, q, ac, iR, kF, il, gL, ad, G, xq, rB, hS, u, eQ, GM, gd, Zu, I, GK, A, iL, TQ, aaP, anq, C, vg, gE, aI, bj, aW, jl, I, h, ik, rR, QJ, jZ, J, W, T, fO, by, AP, qe, aBe, Y, zM, Af, at, eG); #c1(EPHX2) c2(NP_001243411) c3(3606) c4(29720, 42777, 55834, 16663, 68891) c5(dx, jI, A, aw, vg, dD, dE, jJ, eR, mk, fl, di, tG, cO, bf, fD, aO, ed, dv, bb, ip, B, IW, mL, mm, fh, V, I, du, gL, BZ, jm, vc, eO, eX, ny, cy, aM, hU, BX, fw, cT, i, I, at, ap); #c1(EPHX3) c2(NP_001136358) c3(3607) c4(29721, 42778, 55835, 16664, 68892) c5(ak, aw, Kt, b, cG, EM, gG, dB, A, Ku, et, O, y, co, aX, yN, jd, f, q, bu, Vr, kr, k, B, wh, u, oJ, aaQ, Kx, v, kp, jo, T, iy, eJ, ao, hT, PY, eo); #c1(EPM2A) c2(NP_001018051) c3(3608) c4(29722, 42779, 55836, 16665, 68893) c5(jT, xJ, yQ, b, zn, f, v, yH, hS, zj, w, ajw, zk, xw, zp); #c1(EPM2A1P1) c2(NP_055620) c3(3609) c4(29723, 42780, 55837, 16666, 68894) c5(zk, aA, zj, u, zp); #c1(EPN1) c2(NP_001123543) c3(3610) c4(29724, 42781, 55838, 16667, 68895) c5(b); #c1(EPO) c2(NP_000790) c3(3611) c4(29725, 42782, 55839, 16668, 68896) c5(avO, jK, B, aw, qE, gG, Vz, aE, eW, w, bmX, cO, bf, pz, e, O, gO, afY, kT, t, aIz, fp, sL, kX, n, g, mz, asd, bmN, bK, kJ, gJ, wh, fO, dB, Mg, ME, Q, cV, hR, mm, pg, bmT, aDb, qt, bm, mE, we, acw, cT, pv, bk, fD, fN, pt, aA, bP, yJ, wa, id, X, Hk, att, iP, eu, dV, iG, IW, Fh, U, xw, y, CZ, Ei, bmR, RD, pp, mI, f, N, vQ, dZ, ky, aNC, ss, Ch, av, fy, pP, ye, iT, cj, d, jB, qw, V, ae, zA, afe, v, pr, wt, bq, VP, cK, iA, qD, wR, aH, kU, jo, fw, aZM, yM, ci, ap, uy, b, Y, jq, dk, aO, yK, bb, jd, re, q, fJ, pn, fv, ff, jG, u, dh, bmU, jE, I, pF, xk, G, bmV, MD, fH, et, et, Ut, px, P, ao, nV, bmP, bkZ, hT, Ck, ov, ih, fg, ah, fl, I, aU, fh, C, QU, bL, A, pR, gE, xc, ds, HS, rj, eM, wf, aI, bmO, baV, IE, aX, bmW, GW, fq, h, F, qr, oE, Vr, bmQ, aV, ma, si, nQ, RX, yO, GS, J, dt, dU, aoN, T, di, Pk, aM, CY, at, ip, bmS, fP, aT, aG, eG, aIw, oT); #c1(EPOR) c2(NP_000112) c3(3612) c4(29726, 42783, 55840, 16669, 68897) c5(avO, g, A, b, X, jq, iP, jz, dB, di, HS, iG, O, pz, e, y, jQ, d, aX, RD, ip, t, f, N, pn, ar, bmQ, aJ, n, av, fy, u, dh, o, ff, yJ, jB, gG, cV, YR, J, fO, pF, dU, jo, T, VP, iA, pq, nV, bkZ, G, jR, B, mx, pv, fD, ji, at, eG, ap); #c1(EPPIN) c2(NP_001289790) c3(3613) c4(29727, 42784, 55841, 16670, 68898) c5(am); #c1(EPPIN-WFDC6) c2(NP_001185915) c3(3614) c4(29728, 42785, 55842, 16671, 68899) c5(am); #c1(EPPK1) c2(XP_011515627) c3(3615) c4(29729, 42786, 55843, 16672, 68900) c5(aYK, NB); #c1(EPRS) c2(NP_004437) c3(3616) c4(29730, 42787, 55844, 16673, 68901) c5(dx, at, du, hS, dv, QZ, bq, hR, dh, ap); #c1(EPS15L1) c2(NP_001245303) c3(3617) c4(29731, 42788, 55845, 16674, 68902) c5(aV, q); #c1 (EPS8) c2(XP_005253396) c3(3618) c4(29732, 42789, 55846, 16675, 68903) c5(yJ, d, gG, b, iF, X, nU, cz, do, w, T, av, u, e, y); #c1(EPS8L2) c2(NP_073609) c3(3619) c4(29733, 42790, 55847, 16676, 68904) c5(fP); #c1(EP-STI1) c2(NP_001002264) c3(3620) c4(29734, 42791, 55848, 16677, 68905) c5(u, y, b); #c1(EPX) c2(NP_000493) c3(3621) c4(29735, 42792, 55849, 16678, 68906) c5(A, b, bmY, w, ds, U, O, RD, t, ml, B, alz, q, pn, bmZ, cs, fy, bm, dh, n, g, mz, V, dB, J, ad, G, MD, pF, pq, ao, bkZ, fD, Di, alw); #c1(EPYC) c2(NP_004941) c3(3622) c4(29736, 42793, 55850, 16679, 68907) c5(Bu, aso, bna); #c1 (ERAL1) c2(NP_005693) c3(3623) c4(29737, 42794, 55851, 16680, 68908) c5(m, ax, u, be, cO, et, y, dH); #c1(ERAP1) c2(NP_001185470) c3(3624) c4(29738, 42795, 55852, 16681, 68909) c5(JH, TH, b, ix, di, nI, U, qs, Bc, re, cU, fH, aV, aE, da, ax, sH, be, P, II, fJ, bnb, dH, xe, gA, fP); #c1(ERAP2) c2(NP_001123612) c3(3625) c4(29739, 42796, 55853, 16682, 68910) c5(qs, cV, sH, nI, P, gA, di, II, aE); #c1(ERAS) c2(NP_853510) c3(3626) c4(29740, 42797, 55854, 16683, 68911) c5(ik, T, VM, bp); #c1(ERBB2) c2(NP_001005862) c3(3627) c4(29741, 42798, 55855, 16684, 68912) c5(jp, mI, EM, dB, Ip, Ir, e, kJ, dl, mR, cl, xc, fe, asQ, aC, ft, aiL, pq, qN, WY, ag, aA, Mq, avz, bni, Dr, GD, if, X, eu, ig, bw, aAy, aYP, av, fy, OT, is, V, fJ, gR, ji, jy, hh, jh, Bc, fv, aJ, fs, il, Mi, j, ad, bnf, aeC, nV, Ns, hi, Mp, af, fr, jc, C, iL, awz, wG, rR, apb, an, mc, J, jo, Zd, bnn, Jh, Af, E, rb, HG, auJ, hC, YB, O, bnm, DE, Zv, oJ, og, nl, Gd, gm, bp, Ce, x, avi, amq, Lz, aex, aIU, QF, Hk, afY, kY, Bo, U, co, sT, f, bu, aoe, ky, fB, gv, ny, anG, QG, aoD, bkU, Mo, ajF, aGk, bns, d, bku, Dx, jd, PA, q, RF, hb, iR, ff, aWU, qL, dT, iD, Ut, aeq, GM, bnq, fl, k, FE, amf, hA, Sj, Ll, bnt, cB, bnu, T, apl, js, bnj, DP, aw, avk, bnc, adr, aga, BO, bnh, fH, oP, g, p, Dt, fx, hR, cT, Tx, sa, cG, cY, fE, bnr, ajE, bno, tp, agn, pp, aof, B, LI, gX, avh, gg, iT, yg, v, afn, MW, Qz, bt, Fr, iA, Lx, JY, aum, nJ, b, Bh, Mr, apG, re, hV, bne, as, sh, sz, aEf, Zz, Dg, avo, Fo, cW, SJ, Bg, agf, atb, Bm, afG, GK, IO, bmQ, auo, jl, xf, in, bkA, jx, QV, Bi, yw, cU, ik, ZU, Be, akd, agh, W, bkL, QI, asO, jl, nP, fM, qT, avB, zM, bnl, Yv, Ez, at, eG, ja, gG, w, bV, cO, jT, t, aIx, tE, R, aIu, zU, od, Jj, YY, of, xO, bnd, QK, Nv, os, i, bnp, wy, bnk, y, jh, ip, Eg, cs, avu, bm, aal, Bd, Ag, cK, apg, aol, py, jR, bng, fG, ape, gO, An, QB, ic, jV, AK, ar, Yr, jG, u, by, G, Ca, iO, jf, I, aff, A, BY, pu, aWV, hP, adR, bkC, MT, aX, Ec, qn, anM, F, Dd, QJ, ajt, Lg, fU, cV, aUV, GB, Nx, bh, gF, ac, qp, awA, QN, Nq, XH, Oi, iE); #c1(ERBB2IP) c2(NP_001006600) c3(3628) c4(29742, 42799, 55856, 16685, 68913) c5(b, XZ, Y, gG, asX, mR, fl, ot, bT, rb); #c1(ERBB3) c2(NP_001005915) c3(3629) c4(29743, 42800, 55857, 16686, 68914) c5(B, dB, HG, w, e, O, kJ, cl, iz, g, aC, bp, ft, od, Jj, bnw, x, av, dH, aV, ag, i, cG, X, Hk, ig, U, y, jh, co, pp, f, bu, aoe, cs, gg, fy, is, d, V, Qz, Qt, bny, aol, py, nJ, ji, b, hh, jd, zc, re, AK, ar, fv, yW, Tv, u, aE, il, Mi, by, bnx, nV, Uu, iR, Bg, yV, I, A, k, fr, adu, IE, di, m, aX, I, Tq, ja, F, cU, Dd, oJ, ZU, cV, Be, W, Ql, T, fO, Oi, ad, QJ, XH, Yv, bnv, at); #c1(ERBB4) c2(NP_001036064) c3(3630) c4(29744, 42801, 55858, 16687, 68915) c5(f, aw, dB, HG, ns, nm, nt, nq, nr, cO, no, np, e, O, dl, g, lb, bp, ft, od, Jj, fx, ag, w, i, aA, auz, X, Hk, nn, hS, bw, U, y, co, ak, cs, av, fy, iT, is, d, V, aol, eF, jR, aG, b, GL, ic, hh, jh, bh, re, jV, es, ar, ff, u, o, il, by, jU, ao, rQ, iR, tW, A, amn, fr, pR, jc, MT, aX, I, F, bnA, ik, bnz, hW, cV, jo, T, ad, Ll, bkB, fP, Yv, iB, XO); #c1(ERC1) c2(XP_011519238) c3(3631) c4(29745, 42802, 55859, 16688, 68916) c5(nV, aw, dA, h, hV, og, aod); #c1(ERC2) c2(NP_056391) c3(3632) c4(29746, 42803, 55860, 16689, 68917) c5(dx, Hl, xc, dv, aX, Kt, alh, bj, du, EC, dB, di, jU, cO, hW, jT, VX, bq, aw); #c1(ERCC1) c2(NP_001159521) c3(3633) c4(29747, 42804, 55861, 16690, 68918) c5(B, w, hC, e, O, M, b, t, jM, n, g, Dt, gm, bp, ahO, x, fx, cq, pb, aV, Qk, os, ag, cT, qP, i, pt, GD, X, ahS, bkF, fU, GM, iG, bw, U, Oh, y, co, ip, f, bu, gX, cs, av, fy, iT, QD, V, cx, ny, rT, bnC, JY, wp, py, tl, oM, apT, ci, ck, am, wn, Og, Lq, iA, d, jh, re, q, ar, u, NT, Pz, il, el, ad, G, et, iw, Ck, Dj, I, yA, GK, A, fr, Lv, iH, Lr, wf, hP, yw, aX, I, Qm, h, bnB, F, cU, hN, ik, rR, bnD, IG, ma, J, GB, T, ji, jl, by, ac, wU, iE); #c1(ERCC2) c2(NP_000391) c3(3634) c4(29748, 42805, 55862, 16691, 68919) c5(B, aw, dB, ck, e, O, M, b, NR, t, dl, mg, nB, fH, rR, g, aeM, nl, sH, cs, gm, bp, ft, zU, fx, jT, kN, BX, bm, DO, jh, os, ag, cT, i, pt, GO, axq, cG, nF, iP, mk, W, Dj, kY, bw, vl, Oh, y, co, ip, f, bu, gX, ky, Mp, iv, av, fy, QD, iT, is, V, aub, Qz, bnH, rT, iA, bnE, fJ, Vx, dt, bnG, py, in, tl, oM, pv, hV, am, wn, aBx, ic, Lq, nS, BQ, d, Ag, bb, jd, re, nU, q, X, ar, ff, oO, n, u, il, by, G, pD, rB, Nh, aXL, cW, iw, nV, iR, Bg, dn, CV, I, yA, IA, A, iG, fr, Lv, gN, jc, iL, gE, U, aW, jx, m, aX, h, F, qr, yw, cU, hN, ik, oJ, aV, fU, qO, Fs, J, GB, T, fO, bnF, ji, jl, pF, ac, iK, Y, Oi, at, eG, iE); #c1(ERCC3) c2(NP_000113) c3(3635) c4(29749, 42806, 55863, 16692, 68920) c5(A, b, X, F, mk, bnl, Lq, O, y, co, aX, hg, aBx, q, ky, B, ik, av, aV, u, Pz, V, nl, bp, dt, bnF, Nh, jl, ac, iw, bnG, f, Dj, i, I, yA); #c1(ERCC4) c2(NP_005227) c3(3636) c4(29750, 42807, 55864, 16693, 68921) c5(GD, bnK, bnB, aw, GM, b, GK, X, F, Lq, i, O, A, hC, ic, bw, wf, bf, U, yw, y, d, ec, co, aX, am, ip, fv, jd, f, PA, agm, GF, bu, dl, fr, ik, rR, il, ar, av, aV, u, rT, g, fx, wU, Pz, V, I, jh, J, Qz, ft, GB, zU, e, bp, pt, iA, Lr, et, ac, aM, cU, fy, ck, bnJ, DO, Dj, by, ag, cT, GQ, Zu, tl, I, oM); #c1(ERCC5) c2(NP_000114) c3(3637) c4(29751, 42808, 55865, 16694, 68922) c5(GD, A, aw, b, X, rR, Lq, dB, O, ic, cO, e, U, yw, y, jx, bnL, jh, co, aX, NR, jd, h, f, F, q, bu, cU, fr, hN, fx, B, fH, av, aV, u, iT, ff, g, d, bm, V, Qz, ft, GB, QP, zU, T, bp, rB, pt, jl, iA, by, M, fJ, aoO, iw, jT, fy, iK, iR, DO, Dj, cT, i, I, oM, eG, iE); #c1(ERCC6) c2(NP_000115) c3(3638) c4(29752, 42809, 55866, 16695, 68923) c5(dx, GD, A, aw, cT, b, nF, i, O, Lq, U, fD, aW, co, jl, dg, f, F, q, nv, bu, y, Lf, nB, av, aV, u, rR, QD, V, bK, du, v, bp, by, dt, T, Nh, QZ, fx, AP, kN, GB, aXL, aYm, Dj, xr, tl, fl, I, yA, kD, bnM, IA); #c1 (ERCCGL2) c2(NP_001010895) c3(3639) c4(29753, 42810, 55867, 16696, 68924) c5(bnN, pr); #c1(ERCC6-PGBD3) c2(NP_001263988) c3(3640) c4(29754, 42811, 55868, 16697, 68925) c5(ca, Lq, aYm); #c1(ERCC8) c2(NP_000073) c3(3641) c4(29755, 42812, 55869, 16698, 68926) c5(ae, aXL, i, b, Lq, kt, f, N, v, tz, J, dt, mg, Lf, Nh, bK, aV, u, bnO); #c1(EREG) c2(NP_001423) c3(3642) c4(29756, 42813, 55870, 16699, 68927) c5(fr, fl, b, X, w, U, e, O, d, Ll, gX, q, bu, nY, ar, jU, iJ, av, fy, u, V, aC, bp, ft, as, T, by, fM, ata, Lc, ji, rb); #c1(ERF) c2(NP_001287964) c3(3643) c4(29757, 42814, 55871, 16700, 68928) c5(iF, co, aQT, V, bnR, ag, J, bnQ, bnP, fP, AI, U, AP, fp); #c1(ERG) c2(NP_001129626) c3(3644) c4(29758, 42815, 55872, 16701, 68929) c5(jK, B, aw, jt, sJ, e, Up, t, Si, cl, aC, nW, Dt, ie, OJ, dX, dV, U, TD, y, co, pw, SK, ml, f, bu, dZ, bkd, Tk, av, nR, YV, V, ae, hf, bnS, Fr, anf, nJ, T, b, ZE, Em, d, aeQ, qf, jV, es, ar, VM, u, aE, o, bnW, hb, qL, by, G, bnU, bnT, Bg, xU, QP, A, Pa, mW, jR, JC, aI, aW, jx, h, bgm, gT, M, Bj, aq, bnV, fU, nQ, J, P, SF, iv, bgn, ayr, avB, bnX); #c1(ERGIC1) c2(NP_001026881) c3(3645) c4(29759, 42816, 55873, 16702, 68930) c5(bb, A, et, B); #c1(ERGIC2) c2(NP_057654) c3(3646) c4(29760, 42817, 55874, 16703, 68931) c5(iF, A, B, W, fl, Xt); #c1(ERGIC3) c2(NP_057050) c3(3647) c4(29761, 42818, 55875, 16704, 68932) c5(ji, co, q); #c1(ERI3) c2(NP_001288628) c3(3648) c4(29762, 42819, 55876, 16705, 68933) c5(bb); #c1(ERICH5) c2(NP_001164277) c3(3649) c4(29763, 42820, 55877, 16706, 68934) c5(ali); #c1(ERICH6B) c2(NP_872348) c3(3650) c4(29764, 42821, 55878, 16707, 68935) c5(bb); #c1(ERLEC1) c2(NP_001120869) c3(3651) c4(29765, 42822, 55879, 16708, 68936) c5(f, co); #c1(ERLIN1) c2(XP_005269499) c3(3652) c4(29766, 42823, 55880, 16709, 68937) c5(fN, fl, dL); #c1(ERLIN2) c2(NP_001003791) c3(3653) c4(29767, 42824, 55881, 16710, 68938) c5(f, IK, b, bm, TZ, nU, q, PL, bnY, aye, u, y); #c1(ERMAP) c2(XP_011538872) c3(3654) c4(29768, 42825, 55882, 16711, 68939) c5(boa, bnZ); #c1(ERMARD) c2(NP_001265460) c3(3655) c4(29769, 42826, 55883, 16712, 68940) c5(hS, aeu, aew, bob); #c1(ERMP1) c2(NP_079172) c3(3656) c4(29770, 42827, 55884, 16713, 68941) c5(bj, aXS); #c1(ERN1) c2(NP_001424) c3(3657) c4(29771, 42828, 55885, 16714, 68942) c5(b, sE, hS, iL, O, iy, aX, ip, f, q, y, u, BT, J, fO, ny, bb, gF, jT, dL, BX, fN, fD, aA); #c1(ERN2) c2(NP_150296) c3(3658) c4(29772, 42829, 55886, 16715, 68943) c5(f, cy, DT, bk); #c1(ERO1LB) c2(NP_063944) c3(3659) c4(29773, 42830, 55887, 16716, 68944) c5(cy, bb); #c1(ERI1L) c2(NP_055399) c3(3660) c4(29774, 42831, 55888, 16717, 68945) c5(fl, I, b, cf); #c1(ERP29) c2(NP_001029197) c3(3661) c4(29775, 42832, 55889, 16718, 68946) c5(A, b, f, q, T, ji, u, y); #c1(ERP44) c2(NP_055866) c3(3662) c4(29776, 42833, 55890, 16719, 68947) c5(A); #c1(ERV3-1) c2(NP_001007254) c3(3663) c4(29777, 42834, 55891, 16720, 68948) c5(m, X, B, hoc, cU, fc, od, bkJ, av, aV); #c1(ERVW-1) c2(NP_055405) c3(3664) c4(29778, 42835, 55892, 16721, 68949) c5(en, aw, aiW, Zs, w, ER, O, gO, bof, iy, AX, aDx, yh, gl, g, aC, bK, sH, aea, ME, od, fx, jT, pq, f, fc, bkk, rS, Kt, zu, X, jz, eu, wy, mk, Ku, ZM, aJE, aEe, y, IC, pw, px, pp, ak, B, bv, av, bm, ae, boh, Oa, P, dY, bee, ck, kE, b, z, jD, aDV, q, dQ, as, ar, u, aaQ, sQ, Dg, ht, bod, hv, agl, HE, aeq, wV, rQ, eQ, hT, boi, uH, wP, xX, fl, lv, boj, A, k, Lv, mW, EN, C, iL, gE, al, sb, ajb, m, aX, kn, fq, jQ, oc, cU, aoQ, bog, aV, jZ, pE, apx, cV, an, J, aoN, T, Il, jl, Bb, aoR, Nu, hq, UE, XO, eG); #c1(ESAM) c2(NP_620411) c3(3665) c4(29779, 42836, 55893, 16722, 68950) c5(dx, gd, du, aX, dv); #c1(ESCO1) c2(NP_443143) c3(3666) c4(29780, 42837, 55894, 16723, 68951) c5(jh, ck, b, cV, iP, bok, bu, cU, cT, A, by, aq, o); #c1(ESCO2) c2(XP_011542723) c3(3667) c4(29781, 42838, 55895, 16724, 68952) c5(KC, nU, or, b, aua, aNS, cT, bep, AP);

c1(ESD) c2(XP_011533256) c3(3668) c4(29782, 42839, 55896, 16725, 68953) c5(fy, bol, lz, eA, sG, acp, fK, avl, Nm, cB, baB, at, aE, rn); #c1(ESF1) c2(NP_001263309) c3(3669) c4(29783, 42840, 55897, 16726, 68954) c5(cO); #c1(ESM1) c2(NP_001129076) c3(3670) c4(29784, 42841, 55898, 16727, 68955) c5(V, b, pR, q, bu, jo, C, i, bh, U, by, fx, ff); #c1(ESPL1) c2(NP_036423) c3(3671) c4(29785, 42842, 55899, 16728, 68956) c5(iF, co, b, fr, iR, gm, bp, Le, A, fy, i, ajw, J, ft, u, jG, rb); #c1(ESPN) c2(XP_011540537) c3(3672) c4(29786, 42843, 55900, 16729, 68957) c5(aIH, aX, nQ, b, bom, aRh, bon, ow, Bx); #c1(ESR1) c2(NP_001278159) c3(3673) c4(29787, 42844, 55901, 16730, 68958) c5(dB, Tw, ER, e, cp, gM, dl, aoe, mR, cl, fe, aC, zv, ft, aiL, jE, abv, bm, qN, tO, ag, fD, bq, aA, aAp, aal, age, jj, dV, iG, vl, ho, cM, yX, ak, aFQ, av, fy, acF, is, fi, NW, cd, rV, xd, auK, aY, bow, gR, ji, ap, afE, aGv, jJ, vY, qa, jh, Bc, fr, aUb, bor, aE, il, Mi, gL, ad, wL, atm, wV, nV, bou, py, mA, af, ka, gn, jc, C, iL, gE, jw, boz, m, rG, Ir, bdv, oJ, qB, dj, YR, be, J, ajF, Ap, tg, Ic, fP, Af, tk, dx, aNi, sd, eH, auJ, aDX, PM, bf, O, yg, bQ, DE, gB, jm, PV, ia, IV, og, du, bov, boD, agx, GI, x, FW, su, wh, dS, aex, bT, bP, wa, afY, iP, rd, kY, cA, U, WY, aho, co, pw, f, bu, xb, dZ, me, Bs, bmp, gv, ny, Hh, QG, Eo, tl, am, atU, wn, boy, z, d, bb, Dx, jd, PA, q, X, RF, hb, bos, ar, aM, iR, o, ff, aoG, kF, Xp, bet, qL, dT, Yr, sf, iD, et, jH, ch, azr, xU, fl, fh, Xm, k, qX, aW, jk, cB, aq, ax, hW, T, di, hq, avx, iB, eX, aw, HC, lu, azu, g, agQ, p, Qf, Dt, fO, fx, hR, aTZ, rJ, cT, qP, sa, fE, V, tp, B, avh, pP, iT, yJ, cx, afn, atl, Fr, iA, JY, nc, HZ, aIB, iu, fn, aEg, b, in, au, boo, aiT, aga, re, hV, OC, NT, atr, boC, cz, nd, et, Lt, hU, aJA, hX, yy, agf, atb, aFi, acb, afG, box, mW, bcx, fw, sG, bj, bop, cU, tF, iK, PT, Be, W, ti, asO, bp, jl, nP, qT, arq, agl, ale, acD, zM, gu, at, eG, ja, pV, gG, w, cO, Mn, gO, VC, M, dv, cy, t, sO, PH, gl, R, sH, zU, od, Jj, jT, dH, os, yE, IN, vK, i, dc, id, wy, hS, IW, boA, rH, y, jb, ave, Lo, atv, DP, cs, avg, iF, jB, fz, Ag, Ih, Qj, iY, jR, ape, qO, An, QB, eR, yU, gZ, aO, rl, jE, boq, aRY, qu, jG, u, PJ, aJ, I, by, boB, Ca, tW, Bu, cC, ih, wP, I, vf, bL, A, Lv, ot, D, pu, Xv, oy, MT, aX, h, F, qr, az, sX, UF, aV, jZ, ajt, Lg, HI, cV, BC, aDY, P, j, aGN, bh, ac, sK, to, qp, ck, aHG, Oi); #c1(ESR2) c2(NP_001201831) c3(3674) c4(29788, 42845, 55902, 16731, 68959) c5(dx, by, B, aw, dB, eH, xb, dd, lu, cO, e, ra, O, cp, cU, bQ, cy, b, LN, wL, dl, cl, PH, oJ, gD, mz, og, rV, aC, sH, du, gm, bp, x, boF, fx, jT, wh, wn, Fr, os, rJ, yE, oi, i, dc, bq, aA, FW, iF, X, iP, wy, kY, IW, ot, rH, ho, cM, agn, yy, co, ave, pp, wP, f, bu, Be, DP, cs, av, fy, bm, is, em, V, jh, v, cd, dv, eX, Qj, iA, JY, aY, nc, HZ, qO, ji, iu, ap, lg, am, aF, jJ, boE, au, yU, Og, z, ey, aO, d, Ag, bb, yQ, aiT, Bc, vf, PA, q, boG, NJ, ar, tg, qu, her, xd, u, o, fh, RG, NT, kF, aUb, qL, fz, j, ad, as, Fo, Ca, iD, Lt, Jd, wV, nV, iR, cC, ih, aaf, agf, afq, I, acb, jj, bL, A, iG, PJ, fr, Lv, tO, pD, IY, jc, di, jR, jw, bj, U, oy, m, Oh, aX, Qm, sG, ja, F, qr, vZ, az, tF, y, cB, PT, ag, Qf, ez, an, Hh, be, P, T, Oi, jl, nP, cz, sK, aHG, bbB, fP, Af, iB, bh, at, eG, jU, gl); #c1(ESRP1) c2(NP_001030087) c3(3675) c4(29789, 42846, 55903, 16732, 68960) c5(ag, A, V, b, kJ, OV, dB, ad, W, Km, sf, cs, x, bw, U, yE); #c1(ESRP2) c2(NP_079215) c3(3676) c4(29790, 42847, 55904, 16733, 68961) c5(U, V, b); #c1(ESRRA) c2(NP_001269379) c3(3677) c4(29791, 42848, 55905, 16734, 68962) c5(A, b, X, eH, hC, cO, U, y, aqQ, jk, cU, ar, cs, av, cp, u, aE, em, bm, V, ad, T, iA, jE, nV, ch, bk, aA); #c1(ESRRB) c2(NP_004443) c3(3678) c4(29792, 42849, 55906, 16735, 68963) c5(dx, A, b, X, aNH, boH, U, y, V, qf, dv, ml, f, q, es, cU, Mr, B, av, u, g, be, Kx, I, du, UT, iA, ag, Bx, ji); #c1(ESRRG) c2(NP_001230436) c3(3679) c4(29793, 42850, 55907, 16736, 68964) c5(pk, V, I, f, cU, di, KM, ajZ, ar, ey, u, y); #c1(ESX1) c2(NP_703149) c3(3680) c4(29794, 42851, 55908, 16737, 68965) c5(NT, b, UW, wn, T, Nf); #c1(ESYT1) c2(NP_001171725) c3(3681) c4(29795, 42852, 55909, 16738, 68966) c5(fy, b); #c1(ESYT2) c2(NP_065779) c3(3682) c4(29796, 42853, 55910, 16739, 68967) c5(b); #c1(ESYT3) c2(NP_114119) c3(3683) c4(29797, 42854, 55911, 16740, 68968) c5(at); #c1(ETAA1) c2(NP_061875) c3(3684) c4(29798, 42855, 55912, 16741, 68969) c5(bq, zo, at, cO); #c1(ETF1) c2(NP_001269114) c3(3685) c4(29799, 42856, 55913, 16742, 68970) c5(bP, co, bnR, cU, fD, u, y); #c1(ETFA) c2(NP_000117) c3(3686) c4(29800, 42857, 55914, 16743, 68971) c5(SC, b, cY, iP, dB, ig, bf, al, jx, BO, oF, hV, q, ar, Dd, ZU, o, I, cV, aC, P, T, oD, jT, aol, aM, nV, hT, jR); #c1(ETFB) c2(NP_001014763) c3(3687) c4(29801, 42858, 55915, 16744, 68972) c5(BO, f, b, cV, oF, hV, ig, nV, bf, oD, o, aM); #c1(ETFDH) c2(NP_001268666) c3(3688) c4(29802, 42859, 55916, 16745, 68973) c5(BO, cf, arn, b, em, ni, oF, hV, MW, ep, ig, nV, cV, bf, oD, aA, EW, aNQ, o, aM); #c1(ETHE1) c2(NP_055112) c3(3689) c4(29803, 42860, 55917, 16746, 68974) c5(em, SC, q, bu, acU, vc, by, mh); #c1(ETNK1) c2(NP_001034570) c3(3690) c4(29804, 42861, 55918, 16747, 68975) c5(wP, wV, fl); #c1(ETNK2) c2(NP_001284689) c3(3691) c4(29805, 42862, 55919, 16748, 68976) c5(di); #c1(ETNPPL) c2(NP_001140062) c3(3692) c4(29806, 42863, 55920, 16749, 68977) c5(vu, ak, m); #c1(ETS1) c2(NP_001137292) c3(3693) c4(29807, 42864, 55921, 16750, 68978) c5(B, w, hC, YB, bf, e, O, cy, acL, FN, jM, gl, g, aC, cs, Ce, jT, cq, ie, ag, cT, qP, rn, PM, X, Hk, oa, jz, ig, ma, kY, Iw, U, y, ed, co, pw, f, bu, iv, av, iT, yJ, V, iA, JY, nJ, jd, iu, uy, b, jL, HQ, d, Bc, re, hV, q, es, ra, ar, fv, jG, u, dh, VD, ad, nV, hX, ch, aE, ix, af, A, k, mW, bw, jQ, m, xT, aX, LI, h, F, cU, oJ, LK, Yv, cV, J, W, T, by, fM, aM, cZ, at, eG); #c1(ETS2) c2(NP_001243224) c3(3694) c4(29808, 42865, 55922, 16751, 68979) c5(jK, A, aw, b, X, Hk, cs, jz, w, HS, iL, Fm, U, e, cM, jQ, d, m, co, cy, ag, h, f, q, bu, dQ, ans, iv, ar, av, fy, u, o, iP, V, aC, LR, J, ad, IJ, T, fx, by, AP, gg, jU, ao, iY, aY, aq, B, gd, i, dc, gj, od, at, y); #c1(ETV1) c2(NP_001156619) c3(3695) c4(29809, 42866, 55923, 16752, 68980) c5(A, aX, b, py, X, B, ar, fM, hb, av, u, y, JY); #c1(ETV3) c2(NP_005231) c3(3696) c4(29810, 42867, 55924, 16753, 68981) c5(di, cT, u, oG, y); #c1(ETV4) c2(NP_001073143) c3(3697) c4(29811, 42868, 55925, 16754, 68982) c5(f, aw, b, X, A, bw, U, bu, e, y, d, co, aX, wP, B, es, ar, O, cs, av, fy, u, fs, V, bp, ad, T, bol, Qt, x, by, boJ, JY, wV, py, hq, ag, Oh, qO, Oi); #c1(ETV5) c2(NP_004445) c3(3698) c4(29812, 42869, 55926, 16755, 68983) c5(pM, An, Ir, b, X, EM, kB, A, ate, bf, y, BO, co, aX, LI, f, es, cU, B, Yr, fH, av, u, g, I, dA, gm, bp, J, anD, P, T, cy, iA, fJ, YU, aM, UW, boK, yr, we, ji, aA); #c1(ETV6) c2(NP_001978) c3(3699) c4(29813, 42870, 55927, 16756, 68984) c5(avO, aKO, jK, ml, aw, pF, b, X, QG, eM, eu, pz, AD, vY, A, NH, Iv, aiE, jy, fs, Bz, kV, aeC, y, M, jT, bb, jd, t, h, hV, N, ps, dl, Be, B, iv, oO, Kw, av, cq, hD, GS, n, cj, aHN, bbF, YV, oS, an, bnW, bj, ss, gm, Xr, dt, hi, G, jG, T, jV, avL, aHJ, J, Wh, IV, pc, pq, pH, nV, NG, hX, u, boL, aq, ie, fg, pl, gR, boM, di, pr, pS, ci, as); #c1(ETV7) c2(NP_001193964) c3(3700) c4(29814, 42871, 55928, 16757, 68985) c5(jT, N, J, b, fO); #c1(EVA1A) c2(NP_115557) c3(3701) c4(29815, 42872, 55929, 16758, 68986) c5(bq, yQ, b, dA); #c1(EVA1C) c2(NP_478067) c3(3702) c4(29816, 42873, 55930, 16759, 68987) c5(bq, ar, RD, ah); #c1(EVC2) c2(NP_001159608) c3(3703) c4(29817, 42874, 55931, 16760, 68988) c5(ID, AY, Nq, Ns, boN, bnO); #c1(EVC) c2(NP_714928) c3(3704) c4(29818, 42875, 55932, 16761, 68989) c5(ux, A, aOO, Nq, rU, Ns, rQ, boN, boO, apU, cM); #c1(EVI2A) c2(NP_001003927) c3(3705) c4(29819, 42876, 55933, 16762, 68990) c5(EM, aV, fl, iD); #c1(EVI2B) c2(NP_006486) c3(3706) c4(29820, 42877, 55934, 16763, 68991) c5(fl); #c1(EVI5) c2(XP_011540402) c3(3707) c4(29821, 42878, 55935, 16764, 68992) c5(aV, aX, J, cV); #c1(EVL) c2(NP_057421) c3(3708) c4(29822, 42879, 55936, 16765, 68993) c5(U, u, V); #c1(EVPL) c2(NP_001979) c3(3709) c4(29823, 42880, 55937, 16766, 68994) c5(dx, jK, eu, oX, oR, jy, oZ, baW, dv, bs, t, h, N, M, ik, n, cB, iv, oO, jG, gR, il, du, J, hi, G, oQ, oW, ie, ci, axC, fg, oY, ph, cn, pv); #c1(EVX1) c2(NP_001291449) c3(3710) c4(29824, 42881, 55938, 16767, 68995) c5(A, aw, B, b); #c1(EVX2) c2(XP_011509410) c3(3711) c4(29825, 42882, 55939, 16768, 68996) c5(d, ar, arl, e, aHO); #c1(EWSR1) c2(NP_001156757) c3(3712) c4(29826, 42883, 55940, 16769, 68997) c5(jp, ahU, b, aiQ, Hk, iP, jt, aNH, boP, oH, kB, aVG, aWp, bo, aiR, IO, OJ, yw, jx, Zi, bnS, aX, LI, pp, zJ, aHM, h, es, aGu, fr, Zh, RF, cB, iv, Tk, ff, fe, fs, cV, EL, qY, v, bp, J, T, ft, pb, qW, ao, boR, adu, jR, pa, avl, XH, boQ, QP, cl, iE, QV); #c1(EXD2) c2(NP_001180292) c3(3713) c4(29827, 42884, 55941, 16770, 68998) c5(bj); #c1(EXD3) c2(NP_060290) c3(3714) c4(29828, 42885, 55942, 16771, 68999) c5(wU); #c1(EX01) c2(NP_003677) c3(3715) c4(29829, 42886, 55943, 16772, 69000) c5(b, xc, w, bw, U, ho, co, aX, q, bu, ar, av, aV, bm, g, asd, V, bp, Ce, oM, ac, jE, boS, u, Rd, cT, i, l, pt); #c1(EX0C1) c2(NP_001020095) c3(3716) c4(29830, 42887, 55944, 16773, 69001) c5(boT); #c1(EX0C2) c2(NP_060773) c3(3717) c4(29831, 42888, 55945, 16774, 69002) c5(ag, b, tl); #c1(EX0C3L1) c2(NP_848611) c3(3718) c4(29832, 42889, 55946, 16775, 69003) c5(at); #c1(EX0C3L2) c2(NP_612635) c3(3719) c4(29833, 42890, 55947, 16776, 69004) c5(o, q, l); #c1 (EX0C4) c2(NP_001032203) c3(3720) c4(29834, 42891, 55948, 16777, 69005) c5(oy, d, ao, l, aC, e); #c1(EX0C5) c2(NP_006535) c3(3721) c4(29835, 42892, 55949, 16778, 69006) c5(aC, f); #c1(EX0C7) c2(NP_001013861) c3(3722) c4(29836, 42893, 55950, 16779, 69007) c5(AX, boU, b); #c1(EXOG) c2(NP_001138936) c3(3723) c4(29837, 42894, 55951, 16780, 69008) c5(Eo, l); #c1 (EX0SC1) c2(NP_057130) c3(3724) c4(29838, 42895, 55952, 16781, 69009) c5(fP); #c1(EX0SC2) c2(NP_001269637) c3(3725) c4(29839, 42896, 55953, 16782, 69010) c5(bm); #c1(EX0SC3) c2(NP_001002269) c3(3726) c4(29840, 42897, 55954, 16783, 69011) c5(hU, jd, sE, hS, P, w, Vf, boV, OA, boW, aFZ); #c1(EX0SC4) c2(NP_061910) c3(3727) c4(29841, 42898, 55955, 16784, 69012) c5(mz, dO, V, b, ag, at, eQ, eX, dB, cU, om, l, bf, U, aM, aA, ap); #c1(EX0SC5) c2(NP_064543) c3(3728) c4(29842, 42899, 55956, 16785, 69013) c5(ck, h, J, bu, T, jG); #c1(EX0SC6) c2(NP_478126) c3(3729) c4(29843, 42900, 55957, 16786, 69014) c5(ak, hW, aY, rr, f, v, ih, Ey, cM, dc, cA, u, y); #c1(EX0SC7) c2(NP_055819) c3(3730) c4(29844, 42901, 55958, 16787, 69015) c5(aBx, b, aaz, aHb, f, jz, q, boX, ag, afd, cO, asT, J, eV, aDD, jQ); #c1(EX0SC8) c2(NP_852480) c3(3731) c4(29845, 42902, 55959, 16788, 69016) c5(BO, gC, pp, be, P, aE); #c1 (EXPH5) c2(NP_055880) c3(3732) c4(29846, 42903, 55960, 16789, 69017) c5(boZ, boY); #c1(EXT1) c2(NP_000118) c3(3733) c4(29847, 42904, 55961, 16790, 69018) c5(aw, b, fr, atd, kB, C, iL, z, bj, yw, y, cp, zM, aoR, FA, nU, q, vQ, Um, WF, u, QD, bir, hW, IU, im, aC, aSA, Dw, bpf, fO, J, dt, P, cV, bq, bpa, bd, Pk, bpg, atn, bpc, dY, uH, bpb, cz, bpd, kA, Oi, asY, bpe, hz); #c1(EXT2) c2(NP_000392) c3(3734) c4(29848, 42905, 55962, 16791, 69019) c5(P, zM, qf, I, b, Um, Dw, bpf, dt, kB, aA, kA, bf, WE, bpa, ey, at, IU, yw); #c1(EXTL2) c2(XP_011539298) c3(3735) c4(29849, 42906, 55963, 16792, 69020) c5(bph, kA, LO); #c1(EXTL3) c2(NP_001431) c3(3736) c4(29850, 42907, 55964, 16793, 69021) c5(co, Eu, V, dN, Dw, bph, w, c1(EYA1) c2(NP_000494) c3(3737) c4(29851, 42908, 55965, 16794, 69022) c5(oy, aNF, co, arP, l, bpi, zg, u, bde, bpj, K, bu, bpk, fe, ji, sV, cr, PH, aNa, AP, y); #c1(EYA2) c2(NP_005235) c3(3738) c4(29852, 42909, 55966, 16795, 69023) c5(b, X, u, ag, ar, fv, av, zg, y); #c1(EYA4) c2(NP_004091) c3(3739) c4(29853, 42910, 55967, 16796, 69024) c5(b, aCb, cO, U, mR, oy, jh, co, bpm, bpl, ar, ik, fy, V, il, bp, gY, T, iD, cK, jH, aai, na, Bx, zg); #c1(EYS) c2(NP_001136272) c3(3740) c4(29854, 42911, 55968, 16797, 69025) c5(A, nQ, ayr, mI, bpn, nE, nW); #c1(EZH1) c2(NP_001982) c3(3741) c4(29855, 42912, 55969, 16798, 69026) c5(k, BX, ny, ip); #c1(EZH2) c2(XP_005250019) c3(3742) c4(29856, 42913, 55970, 16799, 69027) c5(aw, gG, dB, w, bf, pz, oU, O, jR, kJ, t, Si, e, dl, cl, gl, n, g, fe, aC, iv, gm, fO, fx, jT, cq, jE, ag, cT, i, ch, fl, X, jz, eu, kY, ajw, bw, U, y, yt, co, rc, B, cs, bu, gX, qY, av, fy, bm, iT, vR, V, v, IR, jC, iA, P, nJ, pj, aEg, OG, b, m, Ne, d, jh, bb, Sl, jF, re, hV, g, es, ra, ar, hb, fv, jG, u, o, Mi, LR, ad, IX, sf, pD, iD, oV, yG, nV, iR, IS, A, k, fr, pR, mW, jc, ds, lv, eM, nT, jx, pA, c, MT, aX, aRw, Qm, qn, F, M, oJ, cB, jQ, aq, fU, aYo, cV, YR, Fs, J, jo, T, jl, nP, by, aM, TY, E, h); #c1(EZR) c2(NP_001104547) c3(3743) c4(29857, 42914, 55971, 16800, 69028) c5(cU, by, f, b, X, tp, EM, dB, O, w, dn, bw, nT, U, A, e, aW, aFR, Ag, IE, cy, LI, bpo, jd, re, hg, B, q, bu, dl, fr, y, cs, iJ, av, fy, u, ajz, cl, d, V, il, BO, ft, gL, ad, P, co, T, bp, ji, x, cl, iA, BV, gg, fM, qW, nk, iT, jh, jR, Sk, ag, fl, Af, i, l, Ez, eG, iE); #c1(F10) c2(NP_000495) c3(3744) c4(29858, 42915, 55972, 16801, 69029) c5(lY, id, b, aaP, qz, bps, bb, O, at, aX, u, o, arQ, ae, aUM, gL, P, bpq, cy, et, US, bpp, bpr, ag, gA, OI, bq, eN, ap); #c1(F11) c2(NP_000119) c3(3745) c4(29859, 42916, 55973, 16802, 69030) c5(qC, Ps, A, bpu, sH, B, bV, xb, L, aR, bpt, di, bc, at, aE, aO, eN); #c1(F11R) c2(NP_058642) c3(3746) c4(29860, 42917, 55974, 16803, 69031) c5(dx, Dr, b, X, vZ, MY, y, ed, dv, aX, f, O, fy, u, dh, atr, l, qL, du, bp, by, Fy, Ce, bb, jU, jH, ch, fP, di, aA, at); #c1(F12) c2(NP_000496) c3(3747) c4(29861, 42918, 55975, 16804, 69032) c5(bpv, fl, dD, bpx, di, aO, dl, bb, eE, fu, l, sH, be, bpw, YT, RY, gt, wi, ql, tO, vP, fD, bq, at, ap); #c1(F13A1) c2(NP_000120) c3(3748) c4(29862, 42919, 55976, 16805, 69033) c5(dx, bL, A, azz, aF, eH, CG, vY, di, sF, wY, GV, bf, aUZ, kV, aW, co, bb, fm, aiT, un, t, B, jV, dl, aaU, aO, Eh, bpy, fP, av, yG, pP, tK, bpz, fh, da, adL, o, aC, sX, sH, du, yO, v, Ej, bpC, dv, bq, eN, at, qt, bpA, Nq, tO, jd, Ns, vP, vK, bpB, gj, ahp, aA, apU, ql, ap); #c1(F13B) c2(NP_001985) c3(3749) c4(29863, 42920, 55977, 16806, 69034) c5(dx, bL, A, bpD, vY, aW, co, bb, aiT, B, jV, aaU, fh, V, sH, du, v, bpC, jR, tO, fP, nE, bq, at); #c1(F2) c2(NP_000497) c3(3750) c4(29864, 42921, 55978, 16807, 69035) c5(dx, eX, aw, dD, dB, eH, aoL, bpO, Dy, Eh, bf, eD, e, O, fm, dv, bqa, t, fP, bpY, dl, aaU, jm, mR, tE, bpP, ia, gl, azZ, RM, bpX, bK, bpN, du, yO, Ej, tz, gY, bpH, ME, L, Gl, vM, qt, hR, gg, aL, bpZ, gs, tl, dS, bm, wi, mE, tO, pv, bpS, fz, Fv, vJ, ahp, aA, wz, eQ, Yx, id, td, vQ, arQ, jB, ve, mk, pX, xK, bpW, IW, GV, bpQ, ho, y, Rb, Ei, RD, wc, na, un, amo, rr, f, N, UV, bpL, bu, aPm, bpV, YT, av, pP, wY, bpK, qC, bpJ, bqb, bpR, gv, aR, bq, tj, qD, pk, wp, qG, jg, aUW, iV, aUZ, gA, JO, aqn, Xe, vj, ap, aSG, aaW, vf, b, fN, sH, aF, qz, bpU, eR, vY, tG, z, pF, pl, aO, d, sZ, bb, aiT, oB, aQ, q, pn, mL, vc, kk, tg, u, dh, o, fh, bpl, kF, l, bpM, bc, gL, by, BZ, G, aZ, et, fu, jh, ao, rQ, Eu, hS, fD, aUN, aFa, hT, aiM, xU, bpF, vP, tK, aBY, vZ, C, bL, lc, MZ, iL, ix, gU, aaP, fw, mW, aBV, bpE, HS, vg, sQ, al, bpr, U, aW, m, V, aXc, LS, or, sG, adl, Gs, cr, sX, rm, wb, jZ, Hl, Ps, ma, sj, xf, gV, ei, dt, j, aX, di, Pk, aM, bpG, eN, agl, Kj, LQ, ql, hq, bpT, tA, Bb, Vp, atR, bh, at, eG, Nn, oT); #c1(F2R) c2(NP_001983) c3(3751) c4(29865, 42922, 55979, 16808, 69036) c5(dx, by, en, aw, gG, dB, vB, w, e, O, dv, cy, b, lZ, kT, gB, cl, QB, oP, Jl, ajc, aC, du, bp, od, x, gg, dS, fN, bdB, mE, ag, cT, vK, dc, bq, pO, anY, cY, JE, bw, U, Co, cM, co, pp, f, bu, B, cs, av, fy, bm, kf, bt, iA, nb, py, aY, cf, fw, add, ap, adJ, uS, aF, Hr, MS, oi, Fm, d, bb, q, vu, ff, aJ, u, dh, o, fh, wp, LR, gL, ad, lX, aZ, gd, rv, HV, l, lb, A, HJ, bqc, cA, di, dn, gE, al, bj, m, aX, sS, h, F, cU, y, fP, QJ, hZ, auU, J, jo, T, Il, Pk, at, Ic, gu, j, bh, eN, eG); #c1(F2RL1) c2(NP_005233) c3(3752) c4(29866, 42923, 55980, 16809, 69037) c5(dx, en, aZ, gG, DT, w, cO, e, O, dv, cy, eE, zR, Hs, aC, du, bp, dB, x, av, ag, bk, bq, aA, Al, X, Kc, IW, bw, U, Co, y, V, fm, rr, B, bu, ky, cs, gg, iT, rN, iA, pi, dP, zT, ji, bX, b, zH, ic, QF, Mr, d, re, q, yp, ar, u, dh, da, LR, ad, lX, Fo, Ny, jU, jH, he, gd, dn, l, aZU, A, sx, vl, aX, fq, h, aV, be, bR, P, ti, T, Il, by, nk, aDd, fW, fP, at, eG); #c1(F2RL2) c2(NP_001243495) c3(3753) c4(29867, 42924, 55981, 16810, 69038) c5(jh, LR, q, dB, W, T, C, gg, u, cl); #c1(F2RL3) c2(NP_003941) c3(3754) c4(29868, 42925, 55982, 16811, 69039) c5(A, b, fr, gG, jR, bw, O, y, gB, co, aX, lZ, rr, f, CR, g, cU, cM, hb, gg, u, o, auU, hW, bqd, cV, sB, v, bp, J, Fo, x, bb, iA, ft, Ut, eN, aY, P, fw, B, add, dc, at); #c1(F5) c2(NP_000121) c3(3755) c4(29869, 42926, 55983, 16812, 69040) c5(dx, gK, aw, Gm, dD, aUW, eG, aoL, bpZ, Eh, aLH, eD, e, Ej, cp, Nn, bQ, b, bqa, t, fP, lW, dl, aaU, jm, mR, tE, ia, U, bk, bqo, azZ, jg, bqn, bK, sH, du, yO, bqq, tz, gY, vc, Gl, aqn, vM, x, qt, hR, bpY, eH, gs, tl, wi, aBY, acs, bpM, bqi, pv, bqf, fz, Fv, ahp, aA, wz, bqg, bP, wa, hT, td, fO, HJ, arQ, LM, ve, mk, pX, xK, bpW, sF, bf, GV, bpQ, Co, bqm, y, Ei, fm, wc, na, un, ps, eX, N, UV, bpL, bu, vP, bpV, YT, av, pP, wY, bpK, wK, V, ok, gv, bqw, dv, aR, bq, tj, bd, pn, qD, dO, wp, qG, aHX, bpl, iV, aUZ, gA, JO, Cw, fD, vj, ap, aSG, aaW, vf, uS, aF, qz, bpU, vY, id, tG, z, pl, aO, d, sZ, bb, aiT, oB, aQ, q, lt, mL, ar, tg, bqv, as, Nf, DY, u, dh, fh, tw, kF, aSG, l, im, bqt, sX, be, gL, pF, lX, aUJ, et, fu, jU, jH, ao, rQ, rm, hS, bqu, aUN, eQ, bqe, bqr, bpS, bpF, bqj, ho, Ck, vZ, bL, hg, MZ, ix, gU, tO, gn, mW, bqk, aBV, bpE, fw, vg, eO, sQ, al, hP, VJ, aW, oy, m, aXc, cr, or, ty, sG, wG, adl, aHW, bn, Gs, Ek, wb, tK, Hl, Ps, qC, an, bql, xf, IF, bqp, gV, ei, dt, bqs, ll, bh, di, Pk, gl, aM, bpG, j, eN, Bb, Kj, ql, lc, US, tA, bqh, Vp, amo, aiM, tk, at, LQ, gf); #c1(F7) c2(NP_000122) c3(3756) c4(29870, 42927, 55984, 16813, 69041) c5(dx, eH, hM, bf, O, it, dv, bqy, dl, jm, tE, aUS, aag, bpX, gH, sH, du, Ej, vc, bpZ, fx, gt, dS, tO, fz, bq, aA, id, X, eu, mk, GV, U, y, bqC, cs, bqz, av, bm, em, V, cx, gv, bpu, bqA, dO, fw, bpr, vH, fD, ap, b, aF, qz, vY, tG, z, pl, aO, bb, bX, q, mL, DZ, u, dh, o, fh, Tl, ahF, l, sX, be, gL, ad, bqx, et, Ha, bqB, ch, SJ, xf, bL, A, MZ, acm, gU, aaP, di, vg, oy, sG, ag, Ng, Ps, qC, J, at, ao, ql, lc, bh, eN); #c1(F8) c2(NP_000123) c3(3757) c4(29871, 42928, 55985, 16814, 69042) c5(aw, bqD, pT, wK, qz, eu, aUO, Ey, aiM, aUQ, di, C, z, xl, bqE, aO, acm, aSD, b, bb, RD, aUK, vj, DW, bqG, sZ, tE, tg, u, wc, Ps, qC, rN, xf, bc, cx, dt, aUP, P, aUJ, bq, tj, YT, eN, qt, aMQ, iP, ql, ih, agd, bk, bqF, bh, at, CA, bpX); #c1(F9) c2(NP_000124) c3(3758) c4(29872, 42929, 55986, 16815, 69043) c5(f, aw, ns, Lw, aJE, xl, aCq, sZ, EN, wY, og, bpX, C, nz, Dt, aow, nV, YT, fx, fp, xO, bk, bq, pJ, Dr, agP, jz, eu, jf, aiM, ix, azq, y, V, pp, amo, ak, bql, iv, bm, Bd, rN, NZ, v, J, aR, bpu, tj, YU, xd, aMQ, jR, tl, yo, aox, hV, b, qz, ic, z, jD, oB, nU, q, ra, HE, u, rX, ri, da, VD, qC, JH, ao, KK, aCp, iq, vP, Iv, Qv, aaP, jc, Vy, jQ, bqH, Bi, aBd, aC, n, cB, aCr, aV, bcj, Ps, bc, bd, dt, P, T, lI, nP, ql, bh, eN); #c1(FA2H) c2(NP_077282) c3(3759) c4(29873, 42930, 55987, 16816, 69044) c5(f, bgJ, jJ, ig, A, cK, cA, PE, y, aAt, aPY, bb, ak, aHz, B, fy, u, o, cJ, v, bN, axi, cz, bqK, VG, MP, jN, bM, aA); #c1(FAAH2) c2(NP_777572) c3(3760) c4(29874, 42931, 55988, 16817, 69045) c5(dB); #c1(FABP1) c2(NP_001434) c3(3761) c4(29875, 42932, 55989, 16818, 69046) c5(fl, aw, I, aFa, fN, pq, eX, q, fw, aG, ep, fD, ey, ap, aA, gO); #c1(FABP2) c2(NP_000125) c3(3762) c4(29876, 42933, 55990, 16819, 69047) c5(dx, mz, dD, eR, eH, MG, di, fw, bf, U, dv, bb, lz, eX, om, cl, ob, aM, aE, jH, fh, em, V, l, dA, sH, du, cx, dK, Fy, HK, gF, et, Ha, tS, rd, dO, fN, lc, mA, tO, sU, fD, bq, aA, at, ap); #c1(FABP4) c2(NP_001433) c3(3763) c4(29877, 42934, 55991, 16820, 69048) c5(dx, A, b, X, ajX, dD, bf, VJ, bah, y, Ag, bQ, cy, iR, rh, f, aO, av, u, kF, I, sH, du, P, dv, T, eX, Hh, fx, aM, dO, ch, jR, B, Af, i, aA, at, LQ, ap); #c1(FABP5) c2(NP_001435) c3(3764) c4(29878, 42935, 55992, 16821, 69049) c5(A, aw, kY, e, y, d, aiT, ak, q, aW, aJ, yW, u, da, Ie, yV, l, aC, T, iA, pi, kJ, gd, I, aA, at); #c1(FABP6) c2(NP_001124430) c3(3765) c4(29879, 42936, 55993, 16822, 69050) c5(az, b, V, I, py, W, au, xa, U, aA); #c1(FABP7) c2(NP_001437) c3(3766) c4(29880, 42937, 55994, 16823, 69051) c5(gK, aw, k, afY, dB, HG, hS, w, y, aX, ak, O, aV, aq, g, cV, bK, cM, cz, auf, jo, iD, aY, u, DO, dc); #c1(FABP9) c2(NP_001073995) c3(3767) c4(29881, 42938, 55995, 16824, 69052) c5(m, aK); #c1(FADD) c2(NP_003815) c3(3768) c4(29882, 42939, 55996, 16825, 69053) c5(bL, A, b, fO, fr, eu, w, bf, hP, O, jh, aDV, kH, ps, h, B, q, bu, QE, ar, cl, cB, av, aM, u, aE, g, fs, m, aC, bj, dB, gL, ft, P, T, bp, bqL, AP, pq, yG, akT, ne, bqM, na, cT, fl); #c1(FADS1) c2(NP_037534) c3(3769) c4(29883, 42940, 55997, 16826, 69054) c5(b, di, aqV, bf, aW, aeQ, cy, or, bu, Zl, aO, Fg, l, cM, Fy, aM, aY, ch, dc, aA, at, ap); #c1(FADS2) c2(NP_001268430) c3(3770) c4(29884, 42941, 55998, 16827, 69055) c5(eX, cy, or, b, aY, ak, ap, ep, P, I, aW, xe, dc, aqV, bf, aA, at, u, bq, cM, aM); #c1(FADS3) c2(NP_068373) c3(3771) c4(29885, 42942, 55999, 16828, 69056) c5(ao, or, I, bqN, bcp, ds, at); #c1(FAF2) c2(NP_055428) c3(3772) c4(29886, 42943, 56000, 16829, 69057) c5(A); #c1(FAHD2A) c2(NP_057128) c3(3773) c4(29887, 42944, 56001, 16830, 69058) c5(aA); #c1(FAH) c2(NP_000128) c3(3774) c4(29888, 42945, 56002, 16831, 69059) c5(bgO, GO, di, z, bf, U, y, oy, f, q, pt, oM, u, em, V, kZ, gv, dt, T, Il, Ri, jE, bm, bh); #c1(FAIM2) c2(NP_036438) c3(3775) c4(29889, 42946, 56003, 16832, 69060) c5(l, dA, di, bq, aA, gF); #c1(FAIM3) c2(NP_001135945) c3(3776) c4(29890, 42947, 56004, 16833, 69061) c5(cT); #c1(FAM102A) c2(NP_001030331) c3(3777) c4(29891, 42948, 56005, 16834, 69062) c5(mb, u, y); #c1(FAM103A1) c2(NP_113640) c3(3778) c4(29892, 42949, 56006, 16835, 69063) c5(aC, ew, J); #c1(FAM105A) c2(NP_061891) c3(3779) c4(29893, 42950, 56007, 16836, 69064) c5(fl); #c1(FAM107A) c2(NP_001269642) c3(3780) c4(29894, 42951, 56008, 16837, 69065) c5(aC, w, O, b, dB); #c1(FAM107B) c2(NP_001269625) c3(3781) c4(29895, 42952, 56009, 16838, 69066) c5(oy, hP, b); #c1(FAM109A) c2(NP_001171467) c3(3782) c4(29896, 42953, 56010, 16839, 69067) c5(aPA, ak, ns, Lm, nm, nt, nq, nr, nn, no, np); #c1(FAM110A) c2(NP_001276075) c3(3783) c4(29897, 42954, 56011, 16840, 69068) c5(aUM, eN, O, bpr); #c1(FAM110B) c2(NP_671722) c3(3784) c4(29898, 42955, 56012, 16841, 69069) c5(A, B, nJ); #c1(FAM110C) c2(NP_001071178) c3(3785) c4(29899, 42956, 56013, 16842, 69070) c5(aal); #c1(FAM111B) c2(NP_001136176) c3(3786) c4(29900, 42957, 56014, 16843, 69071) c5(bqQ, ast, gg, bqP, dB); #c1(FAM114A1) c2(NP_612398) c3(3787) c4(29901, 42958, 56015, 16844, 69072) c5(cV); #c1(FAM120B) c2(NP_001273308) c3(3788) c4(29902, 42959, 56016, 16845, 69073) c5(adK); #c1(FAM120C) c2(NP_060318) c3(3789) c4(29903, 42960, 56017, 16846, 69074) c5(bqR, nz, cz); #c1(FAM124B) c2(NP_001116251) c3(3790) c4(29904, 42961, 56018, 16847, 69075) c5(bq, u); #c1(FAM126A) c2(NP_115970) c3(3791) c4(29905, 42962, 56019, 16848, 69076) c5(by, nU, aw, Kt, b, C, gE, ak, iL, z, bw, al, U, y, yK, vr, bi, rY, bqT, f, g, vQ, bu, an, cB, cs, as, IV, bqS, jZ, R, jB, bm, V, IP, aAI, Dt, yO, J, gv, dt, ad, T, bol, Ze, x, aX, aEP, dL, ac, W, jE, Lc, aYM, u, bV, ag, fN, bh, ll); #c1(FAM129A) c2(NP_443198) c3(3792) c4(29906, 42963, 56020, 16849, 69077) c5(ra, T, ff, Nk); #c1(FAM129B) c2(NP_001030611) c3(3793) c4(29907, 42964, 56021, 16850, 69078) c5(aX); #c1(FAM134B) c2(NP_001030022) c3(3794) c4(29908, 42965, 56022, 16851, 69079) c5(d, W, ar, V, b, Dt, e, ad, bqU, bqV, aFh, dV, cs, T, U, RS, dZ, alc); #c1(FAM135A) c2(NP_001099001) c3(3795) c4(29909, 42966, 56023, 16852, 69080) c5(aC, at, di, aE, l); #c1(FAM135B) c2(NP_056996) c3(3796) c4(29910, 42967, 56024, 16853, 69081) c5(d, cp, e, b, cO); #c1(FAM136A) c2(NP_116211) c3(3797) c4(29911, 42968, 56025, 16854, 69082) c5(Fx); #c1(FAM13A) c2(NP_001015045) c3(3798) c4(29912, 42969, 56026, 16855, 69083) c5(oy, bb, anC, LR, lj, aZ, I, et); #c1(FAM13C) c2(NP_001001971) c3(3799) c4(29913, 42970, 56027, 16856, 69084) c5(bb, ap); #c1(FAM149A) c2(NP_056213) c3(3800) c4(29914, 42971, 56028, 16857, 69085) c5(bw); #c1(FAM150B) c2(NP_001002919) c3(3801) c4(29915, 42972, 56029, 16858, 69086) c5(dA); #c1(FAM155A) c2(NP_001073865) c3(3802) c4(29916, 42973, 56030, 16859, 69087) c5(oy, qf, bb, jJ, alF, cO, bq); #c1(FAM160B1) c2(NP_001128523) c3(3803) c4(29917, 42974, 56031, 16860, 69088) c5(aX); #c1(FAM161A) c2(NP_001188472) c3(3804) c4(29918, 42975, 56032, 16861, 69089) c5(nE, oB, nW); #c1(FAM163A) c2(NP_775780) c3(3805) c4(29919, 42976, 56033, 16862, 69090) c5(b, cV); #c1(FAM163B) c2(NP_001073984) c3(3806) c4(29920, 42977, 56034, 16863, 69091) c5(bf, bb); #c1(FAM167A) c2(NP_444509) c3(3807) c4(29921, 42978, 56035, 16864, 69092) c5(PJ, BL, m, aC, gn, mW, aE, j, lo, aV, gl); #c1(FAM168A) c2(NP_001272979) c3(3808) c4(29922, 42979, 56036, 16865, 69093) c5(d, nT, e, bu); #c1(FAM168B) c2(NP_001009993) c3(3809) c4(29923, 42980, 56037, 16866, 69094) c5(xl); #c1(FAM169B) c2(NP_872368) c3(3810) c4(29924, 42981, 56038, 16867, 69095) c5(bqW, dA); #c1(FAM170A) c2(NP_001157463) c3(3811) c4(29925, 42982, 56039, 16868, 69096) c5(cO); #c1(FAM172A) c2(NP_001156889) c3(3812) c4(29926, 42983, 56040, 16869, 69097) c5(dA); #c1(FAM173B) c2(NP_954584) c3(3813) c4(29927, 42984, 56041, 16870, 69098) c5(yp, dV); #c1(FAM174A) c2(NP_940909) c3(3814) c4(29928, 42985, 56042, 16871, 69099) c5(wX, dA); #c1(FAM175A) c2(NP_620775) c3(3815) c4(29929, 42986, 56043, 16872, 69100) c5(X, av, u, y); #c1(FAM175B) c2(NP_115558) c3(3816) c4(29930, 42987, 56044, 16873, 69101) c5(bq, at, f); #c1(FAM177A1) c2(NP_001072987) c3(3817) c4(29931, 42988, 56045, 16874, 69102) c5(dH); #c1(FAM177B) c2(NP_997351) c3(3818) c4(29932, 42989, 56046, 16875, 69103) c5(aW); #c1(FAM178A) c2(NP_001129595) c3(3819) c4(29933, 42990, 56047, 16876, 69104) c5(Eo); #c1(FAM178B) c2(NP_001116118) c3(3820) c4(29934, 42991, 56048, 16877, 69105) c5(dA); #c1(FAM179B) c2(NP_055906) c3(3821) c4(29935, 42992, 56049, 16878, 69106) c5(fP, b); #c1(FAM180A) c2(NP_995327) c3(3822) c4(29936, 42993, 56050, 16879, 69107) c5(eG); #c1(FAM184A) c2(NP_001093881) c3(3823) c4(29937, 42994, 56051, 16880, 69108) c5(IV); #c1(FAM184B) c2(NP_056503) c3(3824) c4(29938, 42995, 56052, 16881, 69109) c5(IV); #c1(FAM187B) c2(NP_689694) c3(3825) c4(29939, 42996, 56053, 16882, 69110) c5(at); #c1(FAM188A) c2(NP_079224) c3(3826) c4(29940, 42997, 56054, 16883, 69111) c5(co, b, ja, nU, mR, cI, cK, fP, aA, fy, sx);

c1(FAM188B) c2(NP_115598) c3(3827) c4(29941, 42998, 56055, 16884, 69112) c5(bq); #c1(FAM189B) c2(NP_001254537) c3(3828) c4(29942, 42999, 56056, 16885, 69113) c5(q); #c1(FAM193B) c2(NP_001177875) c3(3829) c4(29943, 43000, 56057, 16886, 69114) c5(XH, cl); #c1(FAM196A) c2(NP_001034851) c3(3830) c4(29944, 43001, 56058, 16887, 69115) c5(ao, auz); #c1(FAM196B) c2(NP_001123363) c3(3831) c4(29945, 43002, 56059, 16888, 69116) c5(cy, bb, bq); #c1(FAM198B) c2(NP_001026870) c3(3832) c4(29946, 43003, 56060, 16889, 69117) c5(fl); #c1(FAM19A1) c2(NP_998774) c3(3833) c4(29947, 43004, 56061, 16890, 69118) c5(Bu, l); #c1(FAM19A2) c2(NP_848634) c3(3834) c4(29948, 43005, 56062, 16891, 69119) c5(dA); #c1(FAM19A4) c2(NP_001005527) c3(3835) c4(29949, 43006, 56063, 16892, 69120) c5(T, u, bb); #c1(FAM19A5) c2(NP_001076436) c3(3836) c4(29950, 43007, 56064, 16893, 69121) c5(bw, qf, ao, bq); #c1(FAM204A) c2(NP_071346) c3(3837) c4(29951, 43008, 56065, 16894, 69122) c5(bw); #c1(FAM205A) c2(NP_001135389) c3(3838) c4(29952, 43009, 56066, 16895, 69123) c5(aC); #c1(FAM20A) c2(NP_001230675) c3(3839) c4(29953, 43010, 56067, 16896, 69124) c5(Ur, at, atc, bqX); #c1(FAM20B) c2(NP_055679) c3(3840) c4(29954, 43011, 56068, 16897, 69125) c5(dA, LO); #c1(FAM20C) c2(NP_064608) c3(3841) c4(29955, 43012, 56069, 16898, 69126) c5(bqZ, Al, Kt, bqY, aDD, f, dB, PY, tz, AR, aeR, arA, HP, AO); #c1(FAM210B) c2(NP_543011) c3(3842) c4(29956, 43013, 56070, 16899, 69127) c5(av); #c1(FAM213A) c2(NP_001230707) c3(3843) c4(29957, 43014, 56071, 16900, 69128) c5(bra); #c1(FAM214A) c2(NP_001273424) c3(3844) c4(29958, 43015, 56072, 16901, 69129) c5(bb); #c1(FAM216A) c2(NP_037432) c3(3845) c4(29959, 43016, 56073, 16902, 69130) c5(fl); #c1(FAM220A) c2(NP_001032240) c3(3846) c4(29960, 43017, 56074, 16903, 69131) c5(aX); #c1(FAM227B) c2(NP_689860) c3(3847) c4(29961, 43018, 56075, 16904, 69132) c5(VD); #c1(FAM32A) c2(NP_054796) c3(3848) c4(29962, 43019, 56076, 16905, 69133) c5(X, av, u); #c1(FAM3A) c2(NP_001164604) c3(3849) c4(29963, 43020, 56077, 16906, 69134) c5(em, co, fs, V, b, fi, ady, eu, ad, gX, fl, T, pu, cs, x, et, U, fy, baL); #c1(FAM3B) c2(NP_478066) c3(3850) c4(29964, 43021, 56078, 16907, 69135) c5(co, cr, b, fN, Pv, eu, bu, ar, xX, cs, U, ad, ey); #c1(FAM3C) c2(NP_055703) c3(3851) c4(29965, 43022, 56079, 16908, 69136) c5(co, agv, q, ag, iZ, aA); #c1(FAM3D) c2(NP_620160) c3(3852) c4(29966, 43023, 56080, 16909, 69137) c5(do); #c1(FAM46A) c2(NP_060103) c3(3853) c4(29967, 43024, 56081, 16910, 69138) c5(V, dA, ml, U, at, u, nW, y); #c1(FAM46D) c2(NP_689843) c3(3854) c4(29968, 43025, 56082, 16911, 69139) c5(ck, b); #c1(FAM49A) c2(NP_110424) c3(3855) c4(29969, 43026, 56083, 16912, 69140) c5(fl, bj, o, cO); #c1(FAM49B) c2(NP_001243692) c3(3856) c4(29970, 43027, 56084, 16913, 69141) c5(fl); #c1(FAM50B) c2(NP_036267) c3(3857) c4(29971, 43028, 56085, 16914, 69142) c5(wy); #c1(FAM53B) c2(NP_055476) c3(3858) c4(29972, 43029, 56086, 16915, 69143) c5(GN, dA); #c1(FAM57A) c2(NP_079068) c3(3859) c4(29973, 43030, 56087, 16916, 69144) c5(bp, b); #c1(FAM58A) c2(NP_001124469) c3(3860) c4(29974, 43031, 56088, 16917, 69145) c5(bbc, bQ, aw, b, brb, aY, iz, ak, P, aqx, di, avP, hb, dc, cA, bD, RB, eG, cM, qT); #c1(FAM60A) c2(NP_001129284) c3(3861) c4(29975, 43032, 56089, 16918, 69146) c5(Lv, ck); #c1(FAM63B) c2(NP_001035540) c3(3862) c4(29976, 43033, 56090, 16919, 69147) c5(bf, bb); #c1(FAM64A) c2(NP_001182157) c3(3863) c4(29977, 43034, 56091, 16920, 69148) c5(fl, u, y, kY, J); #c1(FAM65B) c2(NP_001273374) c3(3864) c4(29978, 43035, 56092, 16921, 69149) c5(oD, kG, b); #c1(FAM69C) c2(NP_001037834) c3(3865) c4(29979, 43036, 56093, 16922, 69150) c5(dA); #c1(FAM71F1) c2(NP_115988) c3(3866) c4(29980, 43037, 56094, 16923, 69151) c5(aA, bb); #c1(FAM71F2) c2(NP_001012457) c3(3867) c4(29981, 43038, 56095, 16924, 69152) c5(wP, wV, ck); #c1(FAM72B) c2(NP_001307078) c3(3868) c4(29982, 43039, 56096, 16925, 69153) c5(Oa, bu, P, aoQ, Ku, gg); #c1(FAM78B) c2(NP_001017961) c3(3869) c4(29983, 43040, 56097, 16926, 69154) c5(cV, di, l, cp); #c1(FAM81B) c2(NP_689761) c3(3870) c4(29984, 43041, 56098, 16927, 69155) c5(di); #c1(FAM83A) c2(NP_001275516) c3(3871) c4(29985, 43042, 56099, 16928, 69156) c5(co, aw, b, bp, ji, u, y); #c1(FAM83B) c2(NP_001010872) c3(3872) c4(29986, 43043, 56100, 16929, 69157) c5(at, u, y, b, cV); #c1(FAM83D) c2(NP_112181) c3(3873) c4(29987, 43044, 56101, 16930, 69158) c5(u, y); #c1(FAM83H) c2(XP_006725151) c3(3874) c4(29988, 43045, 56102, 16931, 69159) c5(U, Ur, AP, V, brc); #c1(FAM84A) c2(NP_660158) c3(3875) c4(29989, 43046, 56103, 16932, 69160) c5(x, Ks, cs, kF, ad); #c1(FAM84B) c2(NP_777571) c3(3876) c4(29990, 43047, 56104, 16933, 69161) c5(X, bq, A, b, cO); #c1(FAM89A) c2(NP_940954) c3(3877) c4(29991, 43048, 56105, 16934, 69162) c5(Bm); #c1(FAM92A1) c2(NP_001269963) c3(3878) c4(29992, 43049, 56106, 16935, 69163) c5(oy, jo, ff, dB); #c1(FAM92B) c2(NP_940893) c3(3879) c4(29993, 43050, 56107, 16936, 69164) c5(jH, fP, yd); #c1(FAM9B) c2(NP_995321) c3(3880) c4(29994, 43051, 56108, 16937, 69165) c5(ao); #c1(FAN1) c2(NP_001139568) c3(3881) c4(29995, 43052, 56109, 16938, 69166) c5(aX, b, bre, brd, pt, oM, Hs, u, y); #c1(FANCA) c2(NP_000126) c3(3882) c4(29996, 43053, 56110, 16939, 69167) c5(b, X, GO, kY, z, bw, U, ps, e, y, d, h, f, M, ar, av, oM, u, iT, em, V, gv, pt, fx, Ri, Rd, i, l, bh, re, rb); #c1(FANCB) c2(NP_001018123) c3(3883) c4(29997, 43054, 56111, 16940, 69168) c5(jK, b, jL, NH, brh, oU, y, kT, t, h, N, jV, brg, M, n, iv, jG, u, cj, fe, lb, J, pt, G, Q, oM, jT, pJ, pq, WZ, if, oQ, NG, aq, ie, cT, pH, pI, oR, brf, ci); #c1(FANCC) c2(NP_001230672) c3(3884) c4(29998, 43055, 56112, 16941, 69169) c5(b, gG, bw, y, M, h, f, F, q, azu, Gs, iv, ar, av, u, ajt, J, tz, pr, P, oM, G, aff, ag, iT, i, pt, bri, fj, re); #c1(FANCD2) c2(NP_001018125) c3(3885) c4(29999, 43056, 56113, 16942, 69170) c5(aEg, A, aw, b, X, sE, Dm, bg, avn, ic, bw, U, y, d, avH, ip, ajx, avN, h, f, q, M, ar, O, av, u, dh, tQ, n, em, iP, V, I, aXd, brj, J, fO, dt, qO, ny, pt, jC, jG, cq, wU, Lc, BX, aaz, ag, aaS, i, oM, fj); #c1(FANCE) c2(NP_068741) c3(3886) c4(30000, 43057, 56114, 16943, 69171) c5(by, bqW, ar, pt, bw, oM, aA, bu, u, av); #c1(FANCF) c2(NP_073562) c3(3887) c4(30001, 43058, 56115, 16944, 69172) c5(F, ar, b, X, u, h, er, Zl, J, cK, M, T, iT, pt, bw, oM, av, aK, re, y, mR); #c1(FANCG) c2(NP_004620) c3(3888) c4(30002, 43059, 56116, 16945, 69173) c5(GK, A, b, avv, brk, bw, ip, q, M, ar, ik, av, fy, u, V, GB, oM, bdW, GM, ag, i, pt); #c1(FANCI) c2(NP_001106849) c3(3889) c4(30003, 43060, 56117, 16946, 69174) c5(fl, f, brl, oM, pt, u, ac); #c1(FANCL) c2(NP_001108108) c3(3890) c4(30004, 43061, 56118, 16947, 69175) c5(fe, ar, asU, h, ak, J, bp, G, pt, i, iv, bw, oM, fx, u, re, iT); #c1(FANCM) c2(NP_065988) c3(3891) c4(30005, 43062, 56119, 16948, 69176) c5(awl, V, b, fr, f, ft, ar, pt, bw, oM, u, pq); #c1(FANK1) c2(NP_660278) c3(3892) c4(30006, 43063, 56120, 16949, 69177) c5(at, cy, ak, nk); #c1(FAP) c2(NP_001278736) c3(3893) c4(30007, 43064, 56121, 16950, 69178) c5(aKI, A, aw, b, X, eu, ar, fl, gE, U, aK, aKE, aHA, aX, jd, Bi, hV, q, bu, YP, y, cB, cs, ik, av, fy, u, ov, IG, Bd, V, gL, gv, W, Ce, T, agm, Kv, bh, JJ, et, ad, Yy, nd, nV, asJ, aKB, Y, amj, kM, B, cT, Oi, aKG, aT); #c1(FAR1) c2(NP_115604) c3(3894) c4(30008, 43065, 56122, 16951, 69179) c5(WW); #c1(FARP1) c2(NP_001001715) c3(3895) c4(30009, 43066, 56123, 16952, 69180) c5(Eo, IV, hT, bj, o); #c1(FARP2) c2(NP_001269912) c3(3896) c4(30010, 43067, 56124, 16953, 69181) c5(aYR, brm, J, cz, cT, CL); #c1(FARS2) c2(NP_001305801) c3(3897) c4(30011, 43068, 56125, 16954, 69182) c5(hT, FJ, brn, ex, hS, FH, cO); #c1(FARSA) c2(NP_004452) c3(3898) c4(30012, 43069, 56126, 16955, 69183) c5(M, sL); #c1(FAS) c2(NP_000034) c3(3899) c4(30013, 43070, 56127, 16956, 69184) c5(gK, by, B, pV, brp, gG, dB, aE, eH, sJ, W, CO, aw, fR, ps, e, O, BO, gC, LL, am, iR, bru, t, SI, apw, fp, mR, Dc, fH, jM, gl, n, g, og, aeM, lb, bK, sH, pF, fO, gm, bp, ft, vc, aEy, x, fx, jT, dL, gg, dH, pb, wh, xO, gs, BX, bjF, Qk, DO, bY, ag, cT, bk, i, fN, bg, aA, bT, rn, ic, il, Kt, X, xg, jz, wy, ul, mk, pX, ma, Ku, bf, bw, U, xw, io, cM, V, tp, co, BL, ip, adr, DM, f, aDD, bu, Em, cs, jD, av, brt, bm, SI, iT, is, jB, yV, ae, Bs, IT, gv, brv, bt, Qt, Hh, iA, anf, JY, pk, eF, py, vZ, er, To, jR, ne, fG, tl, ji, aGZ, jP, iu, aVK, aG, WH, ck, ny, b, aF, aGv, Fc, wn, bro, tG, z, re, eV, cy, d, jh, bb, lz, kW, aiT, MX, oB, hV, q, fy, fr, dQ, Dq, ar, jG, HL, u, dh, o, fh, PJ, NT, jE, l, im, cl, LR, wV, gL, brq, BZ, vS, mW, et, jU, aen, jH, ao, nV, hU, ig, hX, ch, eQ, kM, ex, wP, ix, CL, dn, fl, I, di, yA, aOB, cK, C, brw, A, iL, k, GW, Lv, gE, gn, gN, jc, bry, ds, Iv, vg, eM, brx, Pl, al, bj, yw, brs, jQ, m, aX, or, h, F, qr, M, aC, ik, y, qB, Jk, aV, brr, NO, ax, cV, aZd, fJ, Oq, GS, J, W, P, Ei, T, Il, jl, Bb, ad, yh, aM, Y, Pn, G, j, Lr, iB, bh, eG, gf); #c1(FASLG) c2(NP_000630) c3(3900) c4(30014, 43071, 56128, 16957, 69185) c5(dx, pV, brz, brp, dB, w, aw, yi, e, O, gM, M, cy, am, iR, DB, mR, IV, gl, g, fe, aeM, lb, bK, sH, du, gm, bp, vc, x, fx, jT, aEY, pq, pb, xO, BX, Qk, DO, ag, cT, i, bT, id, gE, Kt, X, mk, UW, bf, bw, U, cM, tp, co, ip, aoM, B, aDD, bu, cs, av, brt, bm, iT, is, jB, V, Ov, dA, Fy, Qt, cK, anf, JY, py, jR, ne, tl, UT, iu, re, aG, vf, b, aF, wn, vY, fl, ic, tG, jO, d, bb, Sl, aiT, aVK, hV, PA, q, jV, fy, ar, Dq, jG, u, dh, o, fh, da, PJ, NT, il, Ou, gL, ad, BZ, mW, wV, nV, ig, ch, kM, iq, aE, wP, CL, dn, I, Mp, A, iL, eO, gn, gN, jc, ds, C, vg, eM, Pl, al, bj, brA, m, aX, I, h, F, qr, cU, aC, ik, y, qB, Jk, aV, jZ, NO, cV, aZd, Oq, J, W, P, Ei, T, fO, Bb, by, eG, gf, gl); #c1(FASN) c2(NP_004095) c3(3901) c4(30015, 43072, 56129, 16958, 69186) c5(by, B, pV, brp, dD, sE, dB, w, aw, fR, e, O, cy, kJ, qc, t, yh, apw, fH, gl, n, og, aC, fO, gm, bp, ft, x, fx, jT, dL, dH, wh, xO, gC, bjF, Qk, DO, bY, bk, i, fN, bq, aA, bT, X, jz, wy, ul, ig, bf, U, xw, y, yV, co, pp, f, bu, Em, cs, av, fy, bm, iT, is, jB, V, ae, gv, bt, cl, iA, fJ, JY, qW, eF, py, To, ne, fG, aVx, tl, ji, aGZ, iu, re, gG, hV, b, wn, z, gZ, gF, d, jh, bb, jd, oB, nU, q, QX, ar, u, dh, o, PJ, NT, il, Fr, LR, gL, ad, G, jU, jH, nV, hU, fD, iR, mA, ex, dn, fl, A, k, fr, Lv, gE, mW, jc, bry, Iv, iL, eM, Pl, al, jh, brs, jQ, m, aX, l, h, F, cU, ik, aE, pN, qB, fP, aV, brr, ax, bo, cV, GS, J, W, dU, P, T, Il, jl, Bb, brq, fM, aM, ck, j, bh); #c1 (FASTKD2) c2(NP_055744) c3(3902) c4(30016, 43073, 56130, 16959, 69187) c5(acU, fl, b, pQ, u, y); #c1(FASTK) c2(NP_001245390) c3(3903) c4(30017, 43074, 56131, 16960, 69188) c5(qw, k, aMr, Bx, Fh, fy); #c1(FAT1) c2(XP_006714202) c3(3904) c4(30018, 43075, 56132, 16961, 69189) c5(B, b, w, bf, U, A, e, y, d, jh, co, aX, pp, t, h, ak, q, O, u, Fg, kF, V, I, J, Fy, eX, x, dL, aM, ip, fN, G, ag, cT, o, aA, rb, ap); #c1(FAT2) c2(XP_011535905) c3(3905) c4(30019, 43076, 56133, 16962, 69190) c5(jh, ji); #c1(FAT3) c2(NP_001008781) c3(3906) c4(30020, 43077, 56134, 16963, 69191) c5(jd, jh); #c1(FAT4) c2(NP_078858) c3(3907) c4(30021, 43078, 56135, 16964, 69192) c5(oy, jh, Hl, co, aX, il, b, dA, ak, q, brB, bu, bdN, aet, ar, bb, ik, at, u, y); #c1(FATE1) c2(NP_149076) c3(3908) c4(30022, 43079, 56136, 16965, 69193) c5(eZ, ck, am, b, rr, q, os, aV, u, y); #c1(FAU) c2(NP_001988) c3(3909) c4(30023, 43080, 56137, 16966, 69194) c5(fr); #c1(FBF1) c2(NP_001074011) c3(3910) c4(30024, 43081, 56138, 16967, 69195) c5(RH, q, jZ); #c1(FBL) c2(NP_001427) c3(3911) c4(30025, 43082, 56139, 16968, 69196) c5(A, b, qL, bm, Jh, f, q, j, P, DP, z, u, y); #c1(FBLIM1) c2(XP_011539920) c3(3912) c4(30026, 43083, 56140, 16969, 69197) c5(b, fr, EM, Ty, Fh, aHd, iK, f, O, as, u, afY, an, aow, fO, ft, aFs, lo, hS, arS, agb, cT, y); #c1(FBLN1) c2(NP_001987) c3(3913) c4(30027, 43084, 56141, 16970, 69198) c5(A, brE, b, X, cr, dB, Ak, aHO, brD, brC, y, Ne, atj, aX, Qm, jd, ak, g, bu, B, tg, av, u, oJ, fi, fs, Jf, Bs, by, T, cy, L, DO, eG, ap); #c1(FBLN2) c2(NP_001158507) c3(3914) c4(30028, 43085, 56142, 16971, 69199) c5(brF, brG, beH, b, ag, vS, T, o, ar, di, ji, u, y); #c1(FBLN5) c2(NP_006320) c3(3915) c4(30029, 43086, 56143, 16972, 69200) c5(dx, bL, A, bkh, b, cG, brH, lW, dB, lu, cO, Ux, aW, blM, co, cy, blQ, blP, aLC, tv, Jf, iR, du, bp, brG, T, cd, fx, ac, Y, aei, i, bIL, brl, ap); #c1(FBN1) c2(NP_000129) c3(3916) c4(30030, 43087, 56144, 16973, 69201) c5(f, EH, DS, bV, cO, bW, aTl, Vx, mR, brJ, nl, wo, ft, vc, BW, FW, jT, aw, AL, wh, brP, bk, fD, sW, Nn, Al, sm, X, EF, vl, azq, y, BL, ak, brO, Us, oD, av, nl, dA, brQ, brN, AF, Hh, er, wl, lz, ap, wj, b, cl, ey, vC, hV, ra, mL, u, I, LR, j, MJ, Mw, jU, Al, VH, hU, ch, DR, Bu, th, uE, brL, brR, bL, sO, fr, gw, asE, di, bj, Ld, qs, qr, Ex, oJ, dt, My, T, gF, ED, brM, KR, Jh, bgV, brK, tT, at, eG); #c1(FBN2) c2(NP_001990) c3(3917) c4(30031, 43088, 56145, 16974, 69202) c5(bP, Dr, b, X, pR, dB, Ak, W, sF, bf, U, aW, wo, co, gC, ag, h, y, brJ, cs, av, fy, u, fU, V, l, nl, LR, j, ad, dt, vc, T, aM, aL, at, pP, Jh, bV, P, jR, brP, fD, bq, aA, lz, ap); #c1(FBN3) c2(NP_115823) c3(3918) c4(30032, 43089, 56146, 16975, 69203) c5(bQ, kF, X, cC, di, Hu, av); #c1(FBP1) c2(NP_000498) c3(3919) c4(30033, 43090, 56147, 16976, 69204) c5(by, bm, jE, bj, pR, q, bu, brS, T, fy, cs, x, ad, u, Qx, y); #c1(FBP2) c2(NP_003828) c3(3920) c4(30034, 43091, 56148, 16977, 69205) c5(by, Qx, bu); #c1(FBRS) c2(NP_001098549) c3(3921) c4(30035, 43092, 56149, 16978, 69206) c5(d, wh, A, cy, jE, cV, B, q, oJ, cB, bm, e); #c1(FBXL15) c2(NP_077302) c3(3922) c4(30036, 43093, 56150, 16979, 69207) c5(jH, rQ, hW, cz, cA, KE); #c1(FBXL17) c2(NP_001156787) c3(3923) c4(30037, 43094, 56151, 16980, 69208) c5(u); #c1(FBXL19) c2(NP_001093254) c3(3924) c4(30038, 43095, 56152, 16981, 69209) c5(da, ik, il, xe); #c1(FBXL20) c2(NP_001171835) c3(3925) c4(30039, 43096, 56153, 16982, 69210) c5(bT); #c1 (FBXL2) c2(NP_001165184) c3(3926) c4(30040, 43097, 56154, 16983, 69211) c5(b, t, h, G, ix, jT, o); #c1(FBXL3) c2(NP_036290) c3(3927) c4(30041, 43098, 56155, 16984, 69212) c5(jT); #c1(FBXL4) c2(NP_001265645) c3(3928) c4(30042, 43099, 56156, 16985, 69213) c5(pQ, fl, brT); #c1(FBXL5) c2(NP_001180464) c3(3929) c4(30043, 43100, 56157, 16986, 69214) c5(by, bu); #c1(FBXL7) c2(NP_036436) c3(3930) c4(30044, 43101, 56158, 16987, 69215) c5(oy, bf, u, y, cO); #c1(FBXO10) c2(XP_005251496) c3(3931) c4(30045, 43102, 56159, 16988, 69216) c5(f, u, Af, y); #c1(FBXO11) c2(NP_001177203) c3(3932) c4(30046, 43103, 56160, 16989, 69217) c5(aCb, pV, gm, zE, qB); #c1(FBXO15) c2(NP_001136430) c3(3933) c4(30047, 43104, 56161, 16990, 69218) c5(gd, aW); #c1(FBXO17) c2(NP_079183) c3(3934) c4(30048, 43105, 56162, 16991, 69219) c5(dA); #c1(FBXO18) c2(NP_001245381) c3(3935) c4(30049, 43106, 56163, 16992, 69220) c5(aX, f, u, aKV, y); #c1

(FBX028) c2(NP_001129587) c3(3936) c4(30050, 43107, 56164, 16993, 69221) c5(u, y, b); #c1(FBX030) c2(XP_005267216) c3(3937) c4(30051, 43108, 56165, 16994, 69222) c5(T); #c1(FBX031) c2(NP_001269612) c3(3938) c4(30052, 43109, 56166, 16995, 69223) c5(jh, A, f, nU, rQ, u, y); #c1(FBX032) c2(NP_001229392) c3(3939) c4(30053, 43110, 56167, 16996, 69224) c5(bP, bL, lr, X, aF, bf, jh, f, ik, cc, oD, av, dh, il, nl, IR, IX, T, aM, ao, IS, l, brU, BK); #c1(FBX033) c2(NP_976046) c3(3940) c4(30054, 43111, 56168, 16997, 69225) c5(oy, cy, cV, aHX, eO, aHW, cO, Fg); #c1(FBX038) c2(NP_001258652) c3(3941) c4(30055, 43112, 56169, 16998, 69226) c5(l, aC, nl, aE, di, OF, at, brV); #c1(FBX03) c2(NP_036307) c3(3942) c4(30056, 43113, 56170, 16999, 69227) c5(bdY, bj); #c1 (FBX040) c2(NP_057382) c3(3943) c4(30057, 43114, 56171, 17000, 69228) c5(cz); #c1(FBX047) c2(XP_011523166) c3(3944) c4(30058, 43115, 56172, 17001, 69229) c5(sg); #c1(FBX04) c2(NP_036308) c3(3945) c4(30059, 43116, 56173, 17002, 69230) c5(aX, b); #c1(FBX05) c2(NP_001135994) c3(3946) c4(30060, 43117, 56174, 17003, 69231) c5(jh, f, b, X, nU, q, A, rQ, u, y, cp); #c1(FBX07) c2(NP_001028196) c3(3947) c4(30061, 43118, 56175, 17004, 69232) c5(brW, brX, b, GS, v, T, lv, bj); #c1(FBX08) c2(NP_036312) c3(3948) c4(30062, 43119, 56176, 17005, 69233) c5(d, ao, A, cy, jE, cV, B, q, oJ, cB, wh, bm, e); #c1(FBX09) c2(NP_036479) c3(3949) c4(30063, 43120, 56177, 17006, 69234) c5(f0); #c1 (FBXW11) c2(NP_036432) c3(3950) c4(30064, 43121, 56178, 17007, 69235) c5(ats, bkK, fU, fs, aai, b, cV, fr, q, ct, ft, ag, P, T, qY, HE, fx, by, aeC, zW); #c1(FBXW4) c2(NP_071322) c3(3951) c4(30065, 43122, 56179, 17008, 69236) c5(cj, atj, arl, X, arJ, h, w, ck, n, av, u, ci, y, cl); #c1(FBXW7) c2(NP_060785) c3(3952) c4(30066, 43123, 56180, 17009, 69237) c5(fr, A, aw, b, ag, cY, aiW, i, O, w, lv, iL, bw, CT, U, G, gG, y, ez, d, jh, fe, aX, ae, lZ, fv, t, f, LI, q, bu, cU, X, ik, B, p, wj, ar, av, fy, u, e, awq, pA, gw, V, il, m, brY, J, ct, by, dt, P, sf, T, ff, Qt, bi, iA, jT, dL, jG, W, wu, ji, pP, ie, Ck, abf, cT, gR, I, ew, gh, ln, rb, brZ); #c1(FBXW8) c2(NP_036306) c3(3953) c4(30067, 43124, 56181, 17010, 69238) c5(ag, od); #c1(FCAR) c2(NP_001991) c3(3954) c4(30068, 43125, 56182, 17011, 69239) c5(aFl, fl, aF, vl, al, m, bb, bsa, gl, fh, aC, fO, gL, jH, at, hU, j, aFi, fD, bq, TP, ap); #c1(FCER1A) c2(NP_001992) c3(3955) c4(30069, 43126, 56183, 17012, 69240) c5(gM, Kc, at, cy, dP, fq, DM, J, cd, O, Dl, fP, Vy, vM, vl, JN, u, y, ap); #c1(FCER1G) c2(NP_004097) c3(3956) c4(30070, 43127, 56184, 17013, 69241) c5(gM, m, cy, jd, fq, bd, jG, aaw, ap); #c1(FCER2) c2(NP_001193948) c3(3957) c4(30071, 43128, 56185, 17014, 69242) c5(zr, Zq, pD, al, bj, JK, Xy, kT, fq, DM, zh, cy, aD, fH, aE, sQ, bsb, aC, hZ, jD, be, gm, fO, J, aoN, ti, BW, cl, jT, fJ, qe, dP, ie, P, asM, Ot, cT, Dl, CL, aA, jl, iu, zD); #c1(FCGBP) c2(NP_003881) c3(3958) c4(30072, 43129, 56186, 17015, 69243) c5(A, Bi, hV, bu, ra, Bd, B); #c1(FCGR2A) c2(NP_001129691) c3(3959) c4(30073, 43130, 56187, 17016, 69244) c5(dx, bsd, sE, iU, vp, ajf, OH, bQ, cy, iR, t, AX, aDx, Pn, dl, kz, gl, TP, g, UQ, aC, du, bpw, fO, vM, jT, pq, qt, aei, nG, cT, bk, i, asL, fl, td, bY, Kc, mk, aFm, vl, y, Ei, eK, fm, B, bu, gX, Em, Us, brt, pW, bse, V, ae, Dp, bcL, Jc, ny, pi, wu, dP, xe, aDw, iu, ap, aFl, WH, aF, aZw, aYA, aO, bb, bX, bsf, u, aE, fh, PJ, sQ, Zz, kt, LR, gL, bsc, lo, Aj, et, jH, eV, ig, gv, bsg, gd, ix, aFi, aU, bL, A, gn, mW, eO, U, m, jl, h, hN, aV, Yb, cV, be, bd, gm, iB, P, j, aFt, pw, by, zE, apT, tA, bqh, fP, atR, at, MU, azF); #c1(FCGR2B) c2(NP_001002273) c3(3960) c4(30074, 43131, 56188, 17017, 69245) c5(WH, A, dN, mW, mk, fl, aZw, vl, OH, eV, cy, m, bQ, aX, iR, t, h, B, VS, aDx, zm, hN, Em, et, u, gl, pW, PJ, ae, UQ, aC, kt, anZ, be, gm, fO, bd, BZ, im, lo, eK, jT, pi, pc, pq, P, G, at, dP, aei, bsf, bY, Yb, aDw, aU, bsh, MU, oT); #c1 (FCGR3A) c2(NP_000560) c3(3961) c4(30075, 43132, 56189, 17018, 69246) c5(dx, bx, iU, sJ, vp, fR, ajf, aHp, e, dv, cy, b, aDw, Pn, dl, Dc, fH, gl, TP, g, Fx, jH, aC, du, gm, fO, dB, vM, jT, aEY, fy, aZg, dS, aei, ie, fc, cT, fY, fD, bq, aA, bP, id, anY, Zx, eu, ig, ix, Ku, Ou, vl, y, Ei, Ov, ip, B, vQ, bu, gX, Em, cs, FG, brt, pW, V, ae, Dp, bcL, Jc, bt, bsi, anf, hp, dY, xe, hr, lm, ap, aFl, WH, uS, aF, fl, jD, d, aDV, bX, fJ, ar, jG, u, ov, PJ, aGY, Zz, gL, ad, lO, Aj, et, yG, aFC, iw, hU, aE, gd, CL, aFi, xX, fl, alg, bsk, A, lk, mW, lv, pu, gE, al, U, m, xT, aX, h, F, gT, hN, bsj, fP, aV, Yb, Ac, cV, hZ, be, bd, asM, dt, bR, P, T, Il, jl, aeq, j, iB, at, MU); #c1(FCGR3B) c2(NP_000561) c3(3962) c4(30076, 43133, 56190, 17019, 69247) c5(dx, bx, dB, vp, fR, ajf, aHp, e, dv, cy, b, Pn, kz, gl, TP, jH, aC, du, asM, fO, vM, jT, aEY, pq, fy, qt, aZg, fc, aei, cT, fY, fD, bq, aA, id, anY, eu, ix, Ku, vl, y, Ei, vQ, Em, FG, brt, pW, ae, Dp, bt, pi, anf, wu, dY, lm, ap, aFl, WH, uS, aF, fl, d, aDV, bX, ar, jG, u, PJ, im, LR, j, lo, Aj, aFC, iw, hU, gd, CL, aFi, xX, fl, bL, eM, mW, lv, pu, gE, al, m, aX, h, gT, hN, bsj, aV, Ac, cV, hZ, be, bd, gj, P, T, Il, aFt, aeq, fP, iB, at, MU); #c1(FCGRT) c2(NP_001129491) c3(3963) c4(30077, 43134, 56191, 17020, 69248) c5(WH, fl, jz, mW, ig, w, lv, Fh, bW, U, Bz, eD, jQ, m, awU, aem, cy, t, h, Em, aV, gl, aLS, V, be, gm, J, G, vx, jT, et, Jl, cq, xO, aE, fq, aT, go, bV); #c1(FCH01) c2(NP_001154829) c3(3964) c4(30078, 43135, 56192, 17021, 69249) c5(oy); #c1(FCH02) c2(NP_001139504) c3(3965) c4(30079, 43136, 56193, 17022, 69250) c5(A); #c1(FCHSD2) c2(NP_055639) c3(3966) c4(30080, 43137, 56194, 17023, 69251) c5(h, J); #c1(FCN1) c2(NP_001994) c3(3967) c4(30081, 43138, 56195, 17024, 69252) c5(aC, aYA, aZ, xa); #c1(FCN2) c2(NP_004099) c3(3968) c4(30082, 43139, 56196, 17025, 69253) c5(hT, b, gU, X, Pv, iU, ix, iL, gE, xw, OH, iy, eZ, aX, aej, bsl, Xd, aDD, cy, acO, fr, k, av, aE, o, ae, cV, bsm, bK, v, aEP, CM, Il, bb, ft, pi, pb, wu, aei, lc, m, Bm, Kp, aC, Xe, fW); #c1(FCRL1) c2(NP_001152869) c3(3969) c4(30083, 43140, 56197, 17026, 69254) c5(t, cT, aX, G); #c1(FCRL2) c2(NP_001152960) c3(3970) c4(30084, 43141, 56198, 17027, 69255) c5(cT); #c1(FCRL3) c2(XP_006711208) c3(3971) c4(30085, 43142, 56199, 17028, 69256) c5(iq, ix, nl, Pl, HQ, Ag, cy, Pn, aV, u, aE, ax, yV, m, aC, be, dH, pk, Lz, OR, iu, bY, fG, cT, fP, eG); #c1(FCRL4) c2(NP_112572) c3(3972) c4(30086, 43143, 56200, 17029, 69257) c5(bsn, cT, bb, b, aoR); #c1(FCRL5) c2(NP_112571) c3(3973) c4(30087, 43144, 56201, 17030, 69258) c5(b, nl, cT, jT, iu, zD); #c1(FCRL6) c2(NP_001271146) c3(3974) c4(30088, 43145, 56202, 17031, 69259) c5(dx, m, dv, du, cz, sE, P); #c1(FCRLA) c2(NP_001171795) c3(3975) c4(30089, 43146, 56203, 17032, 69260) c5(fl, aX, b, cV, aC, gm, cT, iu); #c1(FCRLB) c2(NP_001275758) c3(3976) c4(30090, 43147, 56204, 17033, 69261) c5(fl, bb, cV, ap, cT, bq, at, fh); #c1(FDFT1) c2(NP_001274672) c3(3977) c4(30091, 43148, 56205, 17034, 69262) c5(eH, co, jl, bso, b, ni, dD, B, aZa, q, eE, acT, A, dd, eX, ar, aA, jN, bj, ap); #c1(FDPS) c2(NP_001129293) c3(3978) c4(30092, 43149, 56206, 17035, 69263) c5(GI, V, b, vd, fr, f, v, ad, ag, cs, cO, x, U, aA, o, cp); #c1(FDX1) c2(NP_004100) c3(3979) c4(30093, 43150, 56207, 17036, 69264) c5(bn, p, q, gv, od, iL, bh, aA); #c1(FDX1L) c2(NP_001026904) c3(3980) c4(30094, 43151, 56208, 17037, 69265) c5(aNN, oD); #c1(FDXR) c2(NP_001244941) c3(3981) c4(30095, 43152, 56209, 17038, 69266) c5(x, gX, cs, fy, ad); #c1(FECH) c2(NP_000131) c3(3982) c4(30096, 43153, 56210, 17039, 69267) c5(bsp, aw, b, nF, Ln, RI, w, z, U, bmo, y, N, M, nY, bsq, O, cs, nB, u, n, cj, em, ae, ad, dt, Rk, T, aMJ, pq, OR, aBy, fg, yM, ci, CU); #c1(FEM1A) c2(NP_061178) c3(3983) c4(30097, 43154, 56211, 17040, 69268) c5(dx, bQ, du, kF, cI); #c1(FEMIB) c2(NP_056137) c3(3984) c4(30098, 43155, 56212, 17041, 69269) c5(dx, bQ, kF, b, I, du, ad, cs); #c1(FEM1C) c2(NP_064562) c3(3985) c4(30099, 43156, 56213, 17042, 69270) c5(bQ, kF, cI); #c1(FEN1) c2(NP_004102) c3(3986) c4(30100, 43157, 56214, 17043, 69271) c5(A, b, Lq, U, hP, O, m, co, cr, ip, B, q, cU, y, aV, u, si, V, eI, bp, ny, et, wU, BX, at); #c1(FERD3L) c2(NP_690862) c3(3987) c4(30101, 43158, 56215, 17044, 69272) c5(bq, cO, bb, dA); #c1(FER) c2(NP_005237) c3(3988) c4(30102, 43159, 56216, 17045, 69273) c5(A, b, t, h, B, q, et, G, fP, eX, Bx, adF, fy); #c1(FERMT1) c2(NP_060141) c3(3989) c4(30103, 43160, 56217, 17046, 69274) c5(Ir, b, nF, mk, e, y, d, co, f, bsr, cs, nB, u, arS, arR, an, nI, UG, ad, dt, fx, jU, jH, ag, fP, i, ji, yA); #c1(FERMT2) c2(NP_001128471) c3(3990) c4(30104, 43161, 56218, 17047, 69275) c5(A, b, iK, arR, BO, kJ, f, bu, B, cs, Hs, u, arS, oJ, jh, by, ad, et, wh, i, aA, y); #c1(FERMT3) c2(NP_113659) c3(3991) c4(30105, 43162, 56219, 17048, 69276) c5(arR, bfS, wh, pp, zI, ad, dt, xK, oJ, cs, arS, iK); #c1(FES) c2(NP_001137257) c3(3992) c4(30106, 43163, 56220, 17049, 69277) c5(oy, co, aX, V, hX, fj, h, f, F, J, he, M, T, n, di, U, Bn, aA, o); #c1(FEV) c2(NP_059991) c3(3993) c4(30107, 43164, 56221, 17050, 69278) c5(bi, TQ, DT, cc, NH, aZv, eh, Fp, co, cy, aCU, f, akf, es, CO, dQ, cM, bI, u, cI, mz, dj, aeI, aD, ti, aZ, aDe, cI, bjQ, qe, dP, NG, aY, ih, dc, I, Xz, at, aDF); #c1(FEZ1) c2(NP_005094) c3(3994) c4(30108, 43165, 56222, 17051, 69279) c5(d, co, hW, b, iR, ak, J, he, TD, A, T, Bg, i, fx, by, u, e, y); #c1(FEZ2) c2(NP_001036013) c3(3995) c4(30109, 43166, 56223, 17052, 69280) c5(at); #c1(FEZF1) c2(NP_001019784) c3(3996) c4(30110, 43167, 56224, 17053, 69281) c5(by, yD, cz, b, bu); #c1(FEZF2) c2(NP_060478) c3(3997) c4(30111, 43168, 56225, 17054, 69282) c5(QZ); #c1(FFAR1) c2(NP_005294) c3(3998) c4(30112, 43169, 56226, 17055, 69283) c5(mz, I, b, cV, bII, dL, fN, Bh, mD, bf, aA, u, y, aM); #c1(FFAR2) c2(NP_005297) c3(3999) c4(30113, 43170, 56227, 17056, 69284) c5(em, aA, pi, b, ap); #c1(FFAR3) c2(NP_005295) c3(4000) c4(30114, 43171, 56228, 17057, 69285) c5(aA); #c1(FFAR4) c2(NP_001182684) c3(4001) c4(30115, 43172, 56229, 17058, 69286) c5(bss, b, I, fN, do, bf, U, aA, aM); #c1(FGA) c2(NP_000499) c3(4002) c4(30116, 43173, 56230, 17059, 69287) c5(dx, KG, bn, bL, aF, IW, vY, di, eO, aW, cp, dv, bb, gB, bst, aYd, gP, dh, o, fh, aLS, aO, be, I, cV, aUM, du, bd, bpY, amX, aR, bp, bq, et, aA, bsu, aH, qt, ch, fw, bsv, ahp, aT, at, go, ap); #c1(FGB) c2(NP_005132) c3(4003) c4(30117, 43174, 56231, 17060, 69288) c5(aFI, bL, id, td, dN, aSG, aF, IW, mW, sA, vY, bn, di, dx, eO, vI, aUZ, bj, pI, aO, cp, oy, fh, wY, dv, bb, ty, un, eX, fP, dI, vP, aW, tg, sj, vK, pP, gI, o, TP, aLS, TI, be, I, m, aC, tK, sH, du, j, Io, et, sX, an, qt, wi, fc, Ic, fw, tO, bP, dh, aFi, fD, I, bq, aA, at, go, ap); #c1(FGD1) c2(NP_004454) c3(4004) c4(30118, 43175, 56232, 17061, 69289) c5(aPc, aeT, fr, u, nz, f, ft, dt, xr, bD, AP, y, iz); #c1(FGD2) c2(NP_775829) c3(4005) c4(30119, 43176, 56233, 17062, 69290) c5(fP); #c1(FGD3) c2(NP_001077005) c3(4006) c4(30120, 43177, 56234, 17063, 69291) c5(hV, aeT); #c1(FGD4) c2(NP_001291409) c3(4007) c4(30121, 43178, 56235, 17064, 69292) c5(bsw, RO, PL, td, cG, Y, dA, bb, ahe); #c1(FGD5) c2(NP_689749) c3(4008) c4(30122, 43179, 56236, 17065, 69293) c5(u); #c1(FGD6) c2(NP_060821) c3(4009) c4(30123, 43180, 56237, 17066, 69294) c5(at); #c1(FGF10) c2(XP_005248321) c3(4010) c4(30124, 43181, 56238, 17067, 69295) c5(A, b, bsC, bsy, Ip, bw, adr, y, co, cr, bsD, cU, IY, zb, PH, u, bsz, vR, T, bsA, bnd, bsx, Bu, Nq, ag, Ns, bhN, Af, bsB, bsE); #c1(FGF11) c2(NP_004103) c3(4011) c4(30125, 43182, 56239, 17068, 69296) c5(ajW); #c1(FGF12) c2(NP_004104) c3(4012) c4(30126, 43183, 56240, 17069, 69297) c5(d, e, bj, aPe, ajW); #c1(FGF13) c2(NP_001132970) c3(4013) c4(30127, 43184, 56241, 17070, 69298) c5(dx, B, aw, dN, w, baB, bf, O, dv, cy, fH, VB, aC, yL, du, gm, ft, fx, jT, wh, ag, dc, mD, aA, AI, X, iP, py, kY, IW, cA, bw, U, Co, cM, mI, f, bu, av, fy, bm, iT, iF, V, jC, fJ, iY, aY, amL, bsF, hV, b, Be, re, nU, q, jV, ND, ar, wM, jG, u, dh, o, fs, iI, by, IX, bsG, et, nV, Bu, fI, Xm, y, A, MZ, fr, auV, aW, LS, VD, h, F, Ir, ik, oJ, nz, fU, si, nQ, cV, W, P, T, II, aX, aM, AR, eG, amK); #c1(FGF14) c2(NP_004106) c3(4014) c4(30128, 43185, 56242, 17071, 69299) c5(kV, hT, ajW, Eo, zp, bsH, cO, n/v, aRv, xw, kS, bsI); #c1(FGF16) c2(NP_003859) c3(4015) c4(30129, 43186, 56243, 17072, 69300) c5(yJ, b, X, bsJ, av, rb); #c1(FGF17) c2(NP_001291407) c3(4016) c4(30130, 43187, 56244, 17073, 69301) c5(A, XE, B, q, bsK, aJ, u, y); #c1(FGF18) c2(NP_003853) c3(4017) c4(30131, 43188, 56245, 17074, 69302) c5(oy, aX, V, nQ, dA, nW, f, wN, q, v, Ns, cs, x, kF, U, ad, jx); #c1(FGF19) c2(NP_005108) c3(4018) c4(30132, 43189, 56246, 17075, 69303) c5(A, b, fi, bf, bsL, jh, bQ, kJ, B, q, cs, bm, em, kF, dA, gv, P, x, Hh, ad, jU, aM, jE, mA, gu, bh, aA); #c1(FGF1) c2(NP_001244139) c3(4019) c4(30133, 43190, 56247, 17076, 69304) c5(dx, fh, A, b, X, fQ, iP, sv, O, ig, fU, di, sF, bb, JE, aI, ft, fx, y, dv, LS, vR, h, f, jD, fr, ar, RF, cB, n, fv, av, u, dh, o, oJ, JI, ma, rN, B, aC, Gd, du, v, bp, J, Q, fO, xe, aX, Vv, hR, gg, DP, py, Nq, tO, Ns, sH, i, T, aA, at, eG, Xm); #c1(FGF20) c2(NP_062825) c3(4020) c4(30134, 43191, 56248, 17077, 69305) c5(b, W, fP, GR, bsM, bj); #c1(FGF21) c2(XP_005258788) c3(4021) c4(30135, 43192, 56249, 17078, 69306) c5(eX, b, jJ, AA, di, bf, kV, kW, f, oD, bm, dh, em, I, awV, P, Hh, gF, dL, aM, eH, KR, ch, hT, mA, aE, fN, bsN, aA, at, ap); #c1(FGF23) c2(NP_065689) c3(4022) c4(30136, 43193, 56250, 17079, 69307) c5(bP, KG, A, mi, bsS, bL, adq, mk, AQ, amK, bf, bsU, fD, AD, gO, zM, bqZ, pw, b, bsQ, bfO, bmI, B, akI, azy, Pm, bsO, bsP, mm, aOE, HP, o, amL, fi, azo, vR, arA, adh, bsV, gj, arx, dt, aOE, iD, Nh, bsR, hR, amT, fp, aM, bsW, zK, bfN, et, bsX, HC, zG, pq, AR, bsT, yM, D, arz, at, Qu, ap); #c1(FGF2) c2(NP_001997) c3(4023) c4(30137, 43194, 56251, 17080, 69308) c5(dx, gK, B, pV, dN, Gm, F, dB, w, dd, cO, Ux, aw, pz, ra, O, cp, cU, dv, cy, b, iR, aDw, DB, yh, adI, dI, btc, fH, wh, oJ, VB, og, cB, aC, yL, du, gm, fO, ft, vo, od, Jj, fx, jT, acG, gg, pq, ata, fy, BX, dS, CB, Dz, I, bte, tO, we, ag, cT, qP, pv, iT, i, dc, bq, aA, jI, bsZ, xN, iI, wK, cY, DO, Ev, iP, eu, jf, kB, fU, sF, kY, vp, GV, Iw, U, Co, cM, rN, co, ip, yE, mI, f, N, bsY, bu, Em, cs, bta, av, nR, bm, fY, zn, iF, aNY, V, bx, Fs, qq, Qz, bd, pr, ny, jC, iA, pi, anf, be, JY, iY, aY, jo, fw, xe, jd, tI, ji, btb, aG, bsF, btd, xm, Mz, AI, ey, jD, d, jh, eA, Bc, re, hV, q, es, ND, X, ar, ff, aJ, EB, wM, bf, jG, u, dh, o, jj, fs, VD, LR, j, ad, IX, aHG, sf, et, yG, P, jH, ao, nV, hX, ch, Bu, mA, aE, Ns, Cv, fI, g, Mp, Xm, bL, A, MZ, iG, k, fr, IW, Nq, rU, ea, di, HS, JC, bw, wf, aI, jR, auV, aW, LS, I, h, wN, Ir, ik, y, pN, qB, Jk, sH, fp, amL, py, ma, si, e, nQ, cV, fJ, sB, Dw, J, W, cA, T, II, baB, cC, aX, by, aM, to, Jh, G, AR, amS, fP, jN, bh, at, eG, amK, rb); #c1(FGF3) c2(NP_005238) c3(4024) c4(30138, 43195, 56252, 17081, 69309) c5(by, e, aw, b, X, amR, eu, wy, Ip, aRe, ow, wf, AI, U, aNa, fx, y, d, jh, co, aX, btg, CO, Bc, h, aRg, F, q, btf, gT, cU, bth, ar, n, cs, HE, av, u, Nq, fe, i, iI, qq, gm, J, P, T, bqL, iO, iA, Pk, AP, bu, fM, yG, kH, YQ, hX, avB, na, Ns, Yv); #c1(FGF4) c2(XP_006718538) c3(4025) c4(30139, 43196, 56253, 17082, 69310) c5(aw, b, X, wy, AI, U, e, y, d, jh, aX, wP, h, f, q, bu, ik, aE, HE, av, u, dh, V, iI, sH, J, fO, by, W, T, Jj, fx, fp, wV, tO, yE, cT, i, od, at); #c1(FGF5)

c2(NP_004455) c3(4026) c4(30140, 43197, 56254, 17083, 69311) c5(g, aX, b, nQ, nW, dB, v, ip, w, di, ny, ar, jD, BX); #c1(FGF6) c2(NP_066276) c3(4027) c4(30141, 43198, 56255, 17084, 69312) c5(YY, A, V, b, cV, B, PY, jR, J, U, bu); #c1(FGF7) c2(NP_002000) c3(4028) c4(30142, 43199, 56256, 17085, 69313) c5(aEg, B, b, ag, X, QB, gw, xc, vB, od, mk, A, bw, U, re, btj, iA, y, Ne, d, cU, LN, kJ, Bc, amK, f, wN, bu, tv, vu, ik, O, aJ, cs, ar, av, u, e, da, asd, ma, V, VD, LR, by, aHG, T, HE, HK, qy, gg, jU, JY, jH, ata, azy, bti, hX, Nq, gd, Ns, fP, bk, I, bh, gf, bsE); #c1(FGF8) c2(NP_006110) c3(4029) c4(30143, 43200, 56257, 17086, 69314) c5(A, avX, b, X, od, yD, hA, btm, jx, ahi, Dx, B, q, fp, Sn, y, hh, HE, av, su, u, amO, atp, cV, Mi, anK, T, Mw, AP, btn, btI, Tv, aai, Nq, K, Ns, kq, PH, btk, UT, gI); #c1(FGF9) c2(NP_002001) c3(4030) c4(30144, 43201, 56258, 17087, 69315) c5(An, AI, b, bto, vR, UW, eO, U, A, e, O, d, xm, ip, jd, anC, B, Ns, bu, cU, ar, cs, aNK, fy, UR, Fg, g, ali, wp, Ij, bp, ad, ny, by, fp, btp, BX, xN, Nq, he, akm, w, ji, eG); #c1(FGFBP1) c2(NP_005121) c3(4031) c4(30145, 43202, 56259, 17088, 69316) c5(d, bn, MI, V, u, do, P, di, cs, fv, U, et, e, y); #c1(FGFBP2) c2(NP_114156) c3(4032) c4(30146, 43203, 56260, 17089, 69317) c5(av, T); #c1(FGFBP3) c2(NP_689642) c3(4033) c4(30147, 43204, 56261, 17090, 69318) c5(ih); #c1(FGFR1) c2(NP_001167535) c3(4034) c4(30148, 43205, 56262, 17091, 69319) c5(btx, aw, HG, bts, w, ER, ps, e, O, gO, jT, arI, kJ, t, bty, cI, btG, aD, jC, bjD, oJ, btD, aC, fO, gm, tz, ft, od, cV, fx, Kb, fp, btq, fy, Qk, ag, btt, pH, i, dc, btv, aA, mZ, AI, X, Ev, Ak, mk, yD, NH, kY, IW, bkc, U, btm, jb, co, btG, B, N, bu, btF, btJ, iv, WE, av, cp, bm, vR, V, btI, btr, cy, aol, aMW, anG, iY, btu, btw, btH, UT, b, aKO, Fr, avX, d, btB, eA, jd, avN, hV, q, jV, ar, btn, u, o, btz, kF, VD, by, da, G, baG, aTx, jG, US, nV, aVX, iR, yy, na, Ns, fg, g, A, aiF, pK, k, fr, btE, cA, di, jw, aX, I, wG, h, F, y, cB, QJ, Lg, fU, nQ, oS, YR, J, Cb, ti, T, bp, ji, S, AP, to, wU, js, QN, NG, btA, Nq, amS, XH, jN, agc, fq, at, iE); #c1(FGFR10P2) c2(NP_001165358) c3(4035) c4(30149, 43206, 56263, 17092, 69320) c5(fg, btK, N); #c1(FGFR10P) c2(NP_001265619) c3(4036) c4(30150, 43207, 56264, 17093, 69321) c5(jH, co, hX, aB, h, N, bp, T, qB, fg, fy, pz, HQ); #c1(FGFR2) c2(NP_000132) c3(4037) c4(30151, 43208, 56265, 17094, 69322) c5(btx, IJ, B, aw, btT, gG, bts, w, Ir, adr, ca, O, tv, b, kJ, t, e, iT, btQ, QB, btN, fH, PH, zW, btD, aeM, fO, bp, ft, bnQ, od, cV, x, fx, Kb, btM, btq, bnd, f, ag, mx, qP, tQ, i, nU, Dr, AI, arB, X, fE, iP, wy, Ak, mk, btR, bo, cA, si, U, y, atj, btS, yE, bsD, ak, bu, btF, cs, WE, av, fy, kq, if, V, jh, afn, gv, iA, fJ, Cd, aLv, iY, btU, zJ, btw, tI, ji, II, bsF, afE, btL, xm, agt, q, btj, ic, Mr, d, Ag, eA, Be, avN, re, aua, arm, jF, vu, ar, aJ, hV, btn, u, o, btz, aGu, iI, btP, Mi, avo, dT, ad, aHG, HE, aeC, acJ, yG, nV, kB, acw, iR, xN, yD, Ns, aOY, rv, yA, agu, A, aiF, k, fr, gw, VY, Rd, rU, di, bw, jx, Px, aX, bsB, h, F, cU, fo, Gs, cB, PT, QJ, bsx, ajt, bsz, hW, gO, btG, btI, P, ti, T, bkj, cr, by, AP, YQ, ck, btA, hq, Nq, btO, amS, wG, bh, eG); #c1(FGFR3) c2(NP_000133) c3(4038) c4(30152, 43209, 56266, 17095, 69323) c5(B, aw, Zy, dB, Ip, Mh, w, btX, adr, e, O, bue, iy, b, NR, axK, ji, bud, btY, agu, fO, gm, tz, bug, fx, Kb, btq, aq, cT, iT, i, ry, Dr, kM, AI, arB, mk, adp, Ou, bw, U, y, buf, co, wP, f, bu, cs, WE, fy, bjx, yJ, V, Ov, J, ny, bq, tI, T, re, afE, xm, agt, anb, ic, apF, d, bsQ, jd, bjy, nU, ND, ar, ff, jG, u, o, btz, by, bub, aoT, Lt, hue, rU, wV, kB, iR, xN, na, Ns, D, yA, Ni, KC, A, zF, gw, bqc, xQ, BY, btZ, btW, yw, aX, F, aOd, oJ, cB, QJ, bsx, bua, E, btG, btI, dt, QI, btV, II, YQ, di, rM, VF, jT, ID, ck, Nq, zM, btO, wq, Nj, iB); #c1(FGFR4) c2(NP_001278909) c3(4039) c4(30153, 43210, 56267, 17096, 69324) c5(DP, aw, dB, w, bf, e, O, bQ, kJ, dI, cI, aeM, gm, bp, x, fx, jT, fp, aHi, buh, DO, ag, cT, qP, i, dc, aA, X, eu, OV, U, cM, co, MI, ip, yE, rr, f, N, bu, B, cs, av, fy, bm, if, V, v, aIM, aDY, iY, aY, P, jR, tI, ji, Xt, aDX, dt, b, ic, d, jd, hV, q, ar, fM, aJ, jG, u, I, be, j, ad, G, buc, aoO, nV, py, aof, di, yA, OS, A, k, fr, D, iL, hP, aX, bbT, h, F, cU, y, cV, J, asM, W, jo, ti, T, fO, by, asn, ac, aM, zI, OW, XH, bh, at, rb); #c1(FGFRL1) c2(NP_001004358) c3(4040) c4(30154, 43211, 56268, 17097, 69325) c5(jh, cy, b, X, axK, i, av, u, fx, y); #c1(FGG) c2(NP_000500) c3(4041) c4(30155, 43212, 56269, 17098, 69326) c5(dx, gK, A, bL, vY, bn, di, wY, eO, aW, dv, bh, bu, aO, dh, o, fh, aLS, aUM, du, bq, jI, et, gd, vZ, at, go, ap); #c1(FGGY) c2(XP_011540039) c3(4042) c4(30156, 43213, 56270, 17099, 69327) c5(Vr, ao, I); #c1(FGL1) c2(NP_004458) c3(4043) c4(30157, 43214, 56271, 17100, 69328) c5(Lc, q, b, vQ); #c1(FGL2) c2(NP_006673) c3(4044) c4(30158, 43215, 56272, 17101, 69329) c5(b, q, II, iL, gj, vI, jZ); #c1(FGR) c2(XP_011539313) c3(4045) c4(30159, 43216, 56273, 17102, 69330) c5(aEX, h, hq, q, mA, P, T, Fg, PS, u, aE, y); #c1(FHDC1) c2(NP_203751) c3(4046) c4(30160, 43217, 56274, 17103, 69331) c5(ao); #c1(FH) c2(NP_000134) c3(4047) c4(30161, 43218, 56275, 17104, 69332) c5(A, b, apC, pR, dB, adJ, ck, wh, aI, bui, G, iK, m, Hq, jI, t, h, B, zh, ZB, do, aHz, oJ, buj, jG, aV, jZ, ff, fe, Ji, vN, aNJ, gm, J, dU, jo, T, jT, amq, if, qt, anG, anD, hT, bY, in, cT, i, bT, zD); #c1(FHIT) c2(NP_002003) c3(4048) c4(30162, 43219, 56276, 17105, 69333) c5(fA, jp, by, B, aw, dD, gG, iU, Ip, Ty, w, cO, Ir, aNa, e, O, hO, buq, ahq, t, FN, ajV, IV, Zv, EM, Fg, R, g, fe, Ib, cs, gm, bp, azo, KK, aiL, cV, x, fx, jT, ava, avY, jE, fy, akn, bm, qN, ag, cT, iT, i, pt, fi, X, oa, wy, GM, iG, bw, U, y, tp, co, pw, pp, f, agm, fh, bu, aEu, iv, av, CX, avg, kq, QD, d, V, dA, qq, pr, bg, VP, iy, iA, LI, GB, bun, iY, P, jR, tI, azb, oM, ci, b, Ns, Fr, jy, js, hh, jh, bb, jd, re, hV, PA, q, jV, ra, pn, ar, ff, pB, jG, u, iP, iI, qL, LR, gL, ad, qO, G, xq, Ca, et, aYw, M, Lt, yG, cW, jH, nV, hX, iR, py, jc, Bg, ih, agf, GK, A, bum, fr, pR, gw, BY, hi, gE, zK, buI, hP, buk, kH, oy, RX, aX, I, h, F, gT, cU, ik, n, cB, bup, QJ, fU, E, IP, Be, YR, Xk, dB, J, po, W, jo, T, ft, qT, ip, QN, Ic, sf, fP, cZ, buo, bh, at); #c1(FHL1) c2(NP_001153171) c3(4049) c4(30163, 43220, 56277, 17106, 69334) c5(azt, kM, b, Pv, EM, w, di, IW, but, Co, adr, aW, c, zi, B, bu, buv, DV, xI, oD, cc, Yj, qb, aC, dB, aLD, W, bur, jo, T, cK, by, sK, aLE, hU, IX, aLz, bus, At, buu, dX, Au, y); #c1(FHL2) c2(XP_005263959) c3(4050) c4(30164, 43221, 56278, 17107, 69335) c5(bL, A, b, fr, hS, w, di, U, hP, yw, y, aX, Dx, h, B, q, mR, cI, cs, u, dh, V, dA, ft, J, gv, W, T, cV, ad, jH, jE, Lc, pS, bm, bh, at); #c1(FHL5) c2(XP_006715676) c3(4051) c4(30165, 43222, 56279, 17108, 69336) c5(b, jj, wn, bj, eV, y, cy, am, tF, BI, ak, gX, O, qY, u, aE, o, NT, ae, kZ, W, sG, I, Bm, dc, I, bq, at); #c1(FH0D1) c2(NP_037373) c3(4052) c4(30166, 43223, 56280, 17109, 69337) c5(BO, b); #c1(FH0D3) c2(NP_001268668) c3(4053) c4(30167, 43224, 56281, 17110, 69338) c5(eH, cK, IV, mR, sK); #c1(FIBP) c2(NP_004205) c3(4054) c4(30168, 43225, 56282, 17111, 69339) c5(bh); #c1(FIG4) c2(NP_055660) c3(4055) c4(30169, 43226, 56283, 17112, 69340) c5(buy, buw, cG, ao, mZ, Ue, buz, qZ, LG, cO, hS, Y, O, bux, aye, OA, ahe, ac); #c1(FIGF) c2(NP_004460) c3(4056) c4(30170, 43227, 56284, 17113, 69341) c5(dx, A, jT, b, X, pR, dB, jc, w, rj, O, bw, VJ, Xv, U, aW, d, tp, co, Qc, Tq, hV, e, bu, ar, y, pN, fy, u, is, ma, V, cV, aC, sH, LR, gm, J, W, jo, dv, T, Io, fx, by, fU, JY, du, nV, BN, kJ, Rd, tO, ag, og, i, ji, nI, ap); #c1(FIGLA) c2(NP_001004311) c3(4057) c4(30171, 43228, 56285, 17114, 69342) c5(jw, Ap, buA); #c1(FIGN) c2(NP_060556) c3(4058) c4(30172, 43229, 56286, 17115, 69343) c5(oy, bq, gf); #c1(FILIP1) c2(NP_001276916) c3(4059) c4(30173, 43230, 56287, 17116, 69344) c5(bu); #c1(FILIP1L) c2(NP_001035924) c3(4060) c4(30174, 43231, 56288, 17117, 69345) c5(A, V, b, X, B, U, av, Fg); #c1(FIPIL1) c2(NP_001128409) c3(4061) c4(30175, 43232, 56289, 17118, 69346) c5(aKO, Tp, FK, b, oS, qv, h, NG, N, J, NH, oJ, pK, aiE, Tr, pH, aqg, jG, fM, PY); #c1(FIS1) c2(NP_057152) c3(4062) c4(30176, 43233, 56290, 17119, 69347) c5(ao, h, buB); #c1(FITM1) c2(NP_981947) c3(4063) c4(30177, 43234, 56291, 17120, 69348) c5(M, U, V); #c1(FITM2) c2(NP_001073941) c3(4064) c4(30178, 43235, 56292, 17121, 69349) c5(I); #c1(FJX1) c2(NP_055159) c3(4065) c4(30179, 43236, 56293, 17122, 69350) c5(U, cs, V, ad); #c1(FKBP10) c2(NP_068758) c3(4066) c4(30180, 43237, 56294, 17123, 69351) c5(buC, b, X, zF, aLA, wn, D, U, am, buD, buE, f, gg, aLt, buF, V, aSc, T, aIM, av, agQ, PY); #c1(FKBP11) c2(NP_001137253) c3(4067) c4(30181, 43238, 56295, 17124, 69352) c5(PY); #c1(FKBP14) c2(NP_060416) c3(4068) c4(30182, 43239, 56296, 17125, 69353) c5(buG, Ex, PY); #c1(FKBP15) c2(NP_056073) c3(4069) c4(30183, 43240, 56297, 17126, 69354) c5(IV, xq); #c1(FKBP1A) c2(NP_000792) c3(4070) c4(30184, 43241, 56298, 17127, 69355) c5(jh, px, m, bj, ak, PY, mk, akL, cg, cO, OA, ajf, u, y, apz); #c1(FKBP1B) c2(NP_004107) c3(4071) c4(30185, 43242, 56299, 17128, 69356) c5(qs, cK, PY, di, cO, bf, hR, aM); #c1(FKBP2) c2(NP_004461) c3(4072) c4(30186, 43243, 56300, 17129, 69357) c5(by, gE, PY, b, bu); #c1 (FKBP3) c2(NP_002004) c3(4073) c4(30187, 43244, 56301, 17130, 69358) c5(PY); #c1(FKBP4) c2(NP_002005) c3(4074) c4(30188, 43245, 56302, 17131, 69359) c5(B, b, Lu, Ey, A, NH, gE, cA, bw, bj, y, aX, sT, wP, pz, f, F, q, qr, cy, NJ, ar, cM, cs, PH, u, o, dj, hW, ae, cV, Xz, P, T, II, Qj, axk, G, wV, NG, aY, py, HN, PY, ih, ag, dc, PS, eG); #c1(FKBP5) c2(NP_001139247) c3(4075) c4(30189, 43246, 56303, 17132, 69360) c5(ux, ak, aw, b, O, Ey, A, NH, aWt, gE, cA, U, gZ, pz, cM, cy, aX, sT, qc, buH, wr, f, qr, bu, dI, NJ, ar, B, fv, Gj, u, o, oE, Ew, dj, hW, jH, aC, by, P, T, II, iN, Qj, IV, iz, to, G, acd, NG, aY, HN, PY, he, ih, ag, aaI, pH, jN, dc, eG, hd, Gn); #c1(FKBPG) c2(NP_001128683) c3(4076) c4(30190, 43247, 56304, 17133, 69361) c5(aLt, NT, am, PY, afB, wn, D, aIM, o); #c1(FKBP7) c2(NP_001128684) c3(4077) c4(30191, 43248, 56305, 17134, 69362) c5(PY); #c1(FKBP8) c2(NP_036313) c3(4078) c4(30192, 43249, 56306, 17135, 69363) c5(Yj, PY); #c1(FKBP9) c2(NP_001271270) c3(4079) c4(30193, 43250, 56307, 17136, 69364) c5(PY); #c1(FKBPL) c2(NP_071393) c3(4080) c4(30194, 43251, 56308, 17137, 69365) c5(m, am, b, aW, u, y); #c1(FKRP) c2(XP_011525609) c3(4081) c4(30195, 43252, 56309, 17138, 69366) c5(WE, nU, bdg, Iv, cO, xI, cr, buI, f, buK, mR, arh, oD, kG, FR, rO, AA, VQ, cT, Au, buJ, azS); #c1(FKTN) c2(NP_001073270) c3(4082) c4(3D196, 43253, 56310, 17139, 69367) c5(WE, b, bdg, AA, jc, xI, c, nU, mR, arh, buN, is, kG, ayh, ME, cK, buL, sK, Iv, VQ, aLz, hT, Au, buM); #c1(FLAD1) c2(NP_001171820) c3(4083) c4(30197, 43254, 56311, 17140, 69368) c5(cy, I, ap, sE, aN, bf, at, aK, oG, aO, aM); #c1(FLCN) c2(NP_653207) c3(4084) c4(30198, 43255, 56312, 17141, 69369) c5(Dr, hV, IO, b, pR, dB, mk, ic, U, Uq, buk, WO, buQ, or, nC, f, bu, cU, ff, cs, bm, Ji, V, by, jo, buO, VP, ca, buS, buR, sh, buP, T); #c1(FLG2) c2(NP_001014364) c3(4085) c4(30199, 43256, 56313, 17142, 69370) c5(fg); #c1(FLG) c2(NP_002007) c3(4086) c4(30200, 43257, 56314, 17143, 69371) c5(KC, buW, JH, b, bf, bve, aTp, mk, NU, aWb, pu, bvd, bkc, PI, bat, bty, e, d, aTx, Xy, bIY, aFd, fq, buV, buX, eE, CO, aCM, Xx, buT, bvb, NB, buU, u, nk, da, bvg, dA, aC, Kc, wE, J, xe, dt, gj, ti, Pt, cy, JN, bvf, Kd, qe, aM, SB, btE, aoc, dP, bvc, buZ, bva, aD, akm, dw, fP, dn, btH, Vy, yf, buY, iE, oT); #c1(FLI1) c2(NP_001257939)

c3(4087) c4(30201, 43258, 56315, 17144, 69372) c5(bP, aGP, A, b, X, aF, jt, eu, mW, bvh, zK, vp, hP, y, jx, m, bnS, jT, aX, pp, zJ, Wn, h, B, aDD, es, fr, aIf, cI, brU, iv, Tk, av, u, gI, n, fe, cB, dA, adJ, ft, cs, aDi, j, J, G, T, cV, bb, ad, et, jG, fM, pb, qW, qp, hU, Jh, adu, jR, OJ, avI, XH, cZ, yq); #c1(FLII) c2(NP_001243194) c3(4088) c4(30202, 43259, 56316, 17145, 69373) c5(bP, aGP, A, b, X, jt, eu, mW, QV, bvh, zK, vp, aTF, hP, y, jx, m, bnS, jT, pp, zJ, h, B, aDD, es, fr, aIf, cI, cB, iv, Tk, av, u, gI, n, fe, cV, adJ, aDi, j, J, G, T, ft, et, jG, fM, pb, qW, qp, hU, XZ, Jh, adu, jR, OJ, avI, XH, cZ, yq); #c1(FLNA) c2(NP_001104026) c3(4089) c4(30203, 43260, 56317, 17146, 69374) c5(dx, KC, LB, r, aw, aZ, b, Xd, aGk, dD, z, FM, aFd, hS, A, di, iL, bb, bf, bvr, amG, Ct, cM, iy, bL, M, co, vd, aAI, dI, bvk, f, q, ak1, bu, Jy, atg, vu, Ex, bvm, oD, jM, u, aE, aew, bvo, du, fs, ae, bvi, brv, gL, by, P, dv, Jj, bvs, Jm, QZ, aX, fx, bvq, aeu, aM, rM, bvp, qG, aY, acK, LA, bvj, B, ag, mx, fR, TQ, ab, i, dc, bvI, at, iu, bvn, y, ap); #c1(FLNB) c2(NP_001157789) c3(4090) c4(30204, 43261, 56318, 17147, 69375) c5(aw, aiW, iU, sJ, pz, bvv, cp, bvA, t, Li, bvt, bvy, fH, agu, CS, aC, gJ, bp, dB, Lz, oQ, jT, dH, qt, cT, pt, hP, aNk, jz, ig, bvB, co, f, bu, iv, oD, iT, Ie, yV, nI, J, bq, pi, fJ, oM, iu, ci, bhI, b, jy, jh, aem, re, q, jG, aE, ri, aAf, iL, im, Fw, be, gn, G, rw, aZ, bvw, bbI, jH, aNI, eQ, Ck, Ns, ix, ah, xX, fl, aff, da, iL, ka, bvu, VY, FM, vg, gE, aI, jQ, m, aX, fq, h, F, M, n, bhi, aV, ax, ez, cV, bvC, P, T, II, bvz, by, rM, ii, bvx, Nq); #c1(FLNC) c2(NP_001120959) c3(4091) c4(30205, 43262, 56319, 17148, 69376) c5(WG, jI, px, kG, b, sO, nI, me, FM, bu, bvE, mR, bvD, oD, by, xI, cy); #c1(FL0T1) c2(NP_005794) c3(4092) c4(30206, 43263, 56320, 17149, 69377) c5(m, fy, b, cV, aK, aN, o, aV, u, y); #c1(FL0T2) c2(NP_004466) c3(4093) c4(30207, 43264, 56321, 17150, 69378) c5(fy, aX, b, cY, pq, f, F, eu, T, ah, gO, u, y, bmF); #c1(FLRT2) c2(NP_037363) c3(4094) c4(30208, 43265, 56322, 17151, 69379) c5(aC, m); #c1(FLRT3) c2(NP_938205) c3(4095) c4(30209, 43266, 56323, 17152, 69380) c5(bvF, UT); #c1 (FLT1) c2(NP_001153392) c3(4096) c4(30210, 43267, 56324, 17153, 69381) c5(dx, jp, B, aw, EM, gG, dB, HG, bvH, eW, sJ, w, tH, Vx, pz, fx, O, gO, dv, iy, aAo, t, e, nv, cI, aJQ, g, UV, og, aC, sH, du, gm, bp, ft, od, x, bvG, aFy, fy, Ty, sN, ag, cT, pv, i, bq, aA, hP, wa, X, iP, eu, wy, dV, iG, bw, U, Oh, aeC, y, V, pp, f, cs, bu, gX, dZ, iv, av, JD, rN, bd, VP, Fr, gv, JY, py, HB, ci, ap, ck, b, acA, jq, ic, Og, Bb, d, bb, eA, q, jV, ra, Nf, ar, VM, as, HE, u, dh, wR, da, UA, fs, iI, qL, LR, tO, j, ad, G, Io, Be, et, jH, nV, Eu, eQ, dn, QP, A, pF, k, fr, gw, di, JC, gE, wf, hP, aW, m, aX, LI, h, M, ik, n, cB, HI, cV, an, be, Fs, J, dU, ti, T, fO, Oi, jI, fT, by, rM, YX, VD, bh, at, ja); #c1(FLT3) c2(NP_004110) c3(4097) c4(30211, 43268, 56325, 17154, 69382) c5(g, hV, aw, bvL, b, ag, acp, jt, mk, zh, w, NH, jL, aiE, jy, axq, U, pH, ps, O, cp, pA, M, bw, pp, aBP, kT, t, h, f, N, jV, es, dI, hf, n, iv, oO, bf, jG, TI, hD, bvL, oP, cj, fe, V, FK, cV, Ib, bvM, be, J, pF, G, QI, Q, pJ, aq, bvN, jT, aA, aM, pb, iw, NG, hX, u, bvI, ie, jR, OJ, bvK, cT, fg, gR, fl, ej, yq, zD, ci, gI); #c1 (FLT3LG) c2(NP_001450) c3(4098) c4(30212, 43269, 56326, 17155, 69383) c5(A, axq, b, X, jz, w, U, y, jQ, cy, h, B, N, QE, O, u, n, g, V, cV, aC, kt, be, J, gL, pr, fO, aYz, jI, pi, pJ, Lz, OJ, cT, fl, yq, bv0); #c1(FLT4) c2(NP_002011) c3(4099) c4(30213, 43270, 56327, 17156, 69384) c5(dx, Qd, B, gG, dB, w, azO, dv, t, yh, aC, sH, du, gm, bp, jT, jE, U, tO, ag, cT, WR, Dr, aDf, cY, iP, bw, VJ, Cr, y, tp, co, Qc, f, bIN, bu, cs, av, fy, bm, iT, V, MW, JY, aoy, OI, b, boE, hh, re, q, X, ar, VM, u, o, da, kF, ad, yG, nV, yC, aoA, uH, dn, A, iL, fr, bvQ, EN, C, JC, wf, Ct, aW, xT, aX, Tq, aGt, fq, h, cU, pN, bvP, cV, J, W, T, fO, nP, by, vv, Rd); #c1 (FLVCR1) c2(NP_054772) c3(4100) c4(30214, 43271, 56328, 17157, 69385) c5(bL, A, bvU, b, bvW, BH, O, oy, bvR, B, arm, da, CZ, nW, v, gL, bvV, PL, bvS, zE, xM, ag, bvT); #c1(FLVCR2) c2(NP_001182212) c3(4101) c4(30215, 43272, 56329, 17158, 69386) c5(bL, eY, FT, Eh, Wj, cy, az, Dd, aD, ZU, Ps, qw, W, et, aMJ, Wp, TD, ape, au, bvX, bvT, bh); #c1(FMN1) c2(NP_001096654) c3(4102) c4(30216, 43273, 56330, 17159, 69387) c5(A, V, cV, bvY, arJ, ju, eO, U, bvZ); #c1(FMN2) c2(NP_064450) c3(4103) c4(30217, 43274, 56331, 17160, 69388) c5(ao, aV, bh, dA, ie, dB, oO, at, aE, ap); #c1(FMNL1) c2(NP_005883) c3(4104) c4(30218, 43275, 56332, 17161, 69389) c5(jI, b, hX, J, cT, jT); #c1(FMNL2) c2(NP_443137) c3(4105) c4(30219, 43276, 56333, 17162, 69390) c5(oy, V, b, q, cz, U); #c1(FMNL3) c2(NP_783863) c3(4106) c4(30220, 43277, 56334, 17163, 69391) c5(eH, cK, mR, aE); #c1 (FMO1) c2(NP_001269621) c3(4107) c4(30221, 43278, 56335, 17164, 69392) c5(gK, ao, ak, Vr); #c1(FM02) c2(NP_001451) c3(4108) c4(30222, 43279, 56336, 17165, 69393) c5(qL, M, eG, ac); #c1(FM03) c2(NP_008825) c3(4109) c4(30223, 43280, 56337, 17166, 69394) c5(dx, em, ao, co, V, b, f, Fp, dt, dv, W, et, di, U, du, M, ac); #c1(FM04) c2(NP_002013) c3(4110) c4(30224, 43281, 56338, 17167, 69395) c5(gL); #c1(FM0D) c2(NP_002014) c3(4111) c4(30225, 43282, 56339, 17168, 69396) c5(dx, Bu, du, gv, cT, dv, di, pZ, bh, Iz, et, aW); #c1(FMR1) c2(NP_001172004) c3(4112) c4(30226, 43283, 56340, 17169, 69397) c5(ak, hM, KF, bfJ, bQ, cy, ahj, Ky, sL, KB, aLt, KH, bK, nz, bp, bwc, KK, cq, atn, ro, aaz, UR, aTZ, amu, dc, aKG, GJ, EO, agP, oH, hS, kY, cA, si, xw, kV, cM, TC, f, bwb, aIY, em, JB, Nw, v, bwe, aY, qc, abt, b, KN, z, Gi, yQ, nU, bwf, as, u, kF, Kx, wp, UK, eI, sC, cz, xk, kS, ao, rQ, ih, KR, bpd, rv, asT, ahm, aeu, FY, aiF, qi, jw, bj, sG, KA, xJ, bdv, zp, y, nx, aV, aq, Jt, amd, dj, hW, afx, an, GS, KL, dt, P, bwa, UT, Ap, AP, KG, xM, bwd, agc, Rj); #c1(FN1) c2(NP_002017) c3(4113) c4(30227, 43284, 56341, 17170, 69398) c5(dx, by, mI, aw, iD, jE, Vz, aE, HG, eC, Je, w, bV, cO, vp, O, OH, e, xI, za, dv, cy, Vx, iR, kS, ban, wv, dI, FN, mR, wY, Pv, Hs, rR, g, fe, aC, bkx, du, gm, bp, ft, GI, XT, x, Eu, fx, jT, gg, su, cq, aFy, mC, ata, fy, qt, nG, tO, we, ag, cT, xb, pH, iT, i, pt, aA, aaA, dB, Dr, sa, fI, fi, cY, afY, oa, jz, LM, Kc, hS, yD, LK, NH, dV, bf, Iw, U, arW, aTF, y, bji, tp, co, G, sT, aoR, yE, Mn, mI, f, N, cs, vQ, bu, Be, dZ, k, B, Us, av, qJ, bm, ye, fY, d, V, BO, zI, bwm, gv, eE, Fy, Jc, bq, VP, Xr, aec, W, aH, rK, er, P, bwn, bT, vH, kJ, VE, bwo, tI, oM, apD, Xe, bwi, b, zH, aE, Hr, m, z, HJ, ey, re, bwI, hh, Ag, bwh, eA, wd, bX, hV, q, zx, X, vu, ar, sP, as, jG, u, dh, amO, ff, da, Jn, sQ, Zz, I, im, qL, LR, j, eu, IJ, aZ, aYw, et, M, jU, apG, nV, hU, hX, ch, aiJ, agb, gd, Ns, o, cV, fI, I, bwg, Jh, sF, azt, bL, mv, A, sO, fr, zF, gw, sv, pz, Nq, og, di, wh, gE, wf, fs, vI, pp, aHA, aX, ajn, aSQ, fq, h, F, aBd, aSm, Ex, oJ, Ek, jQ, rb, sH, bcV, fU, bwj, bwk, an, be, wE, J, dt, bR, jo, T, fO, ji, ad, bsu, aM, wU, ii, QN, NG, atJ, vU, vS, Af, jh, gj, bh, at, eG, iE); #c1(FN3K) c2(NP_071441) c3(4114) c4(30228, 43285, 56342, 17171, 69399) c5(b, V, I, bf, U, u, ey, aM); #c1(FN3KRP) c2(NP_078895) c3(4115) c4(30229, 43286, 56343, 17172, 69400) c5(ap); #c1(FNBP1) c2(NP_055848) c3(4116) c4(30230, 43287, 56344, 17173, 69401) c5(h, J); #c1 (FNDC1) c2(NP_15921) c3(4117) c4(30231, 43288, 56345, 17174, 69402) c5(Eo, at); #c1(FNDC3A) c2(NP_001073141) c3(4118) c4(30232, 43289, 56346, 17175, 69403) c5(bL, ao, co, wh, aC, h, ak, bgA, MS, nk, B, aj, ai, rQ); #c1(FNDC3B) c2(NP_001128567) c3(4119) c4(30233, 43290, 56347, 17176, 69404) c5(ba, at, q, b, ez); #c1(FNDC4) c2(NP_073734) c3(4120) c4(30234, 43291, 56348, 17177, 69405) c5(ep, ho); #c1(FNTA) c2(NP_002018) c3(4121) c4(30235, 43292, 56349, 17178, 69406) c5(oG, b); #c1(FNTB) c2(NP_002019) c3(4122)

c4(30236, 43293, 56350, 17179, 69407) c5(oG); #c1 (F0CAD) c2(NP_060264) c3(4123) c4(30237, 43294, 56351, 17180, 69408) c5(cO, w, O, o, ap); #c1(FDLH1) c2(NP_001014986) c3(4124) c4(30238, 43295, 56352, 17181, 69409) c5(fh, IJ, A, aw, kE, b, adf, TM, Nq, di, hA, U, gZ, cM, co, bh, t, f, bu, ar, tE, cB, Dg, nA, u, ff, ha, V, B, Mi, xf, fO, cd, jo, T, II, Fr, at, aY, G, aZQ, ih, Ns, fD, dc, I, bq, bwp, y, ap); #c1(F0LR1) c2(NP_000793) c3(4125) c4(30239, 43296, 56353, 17182, 69410) c5(bm, IJ, b, X, iP, bwq, hS, xf, iG, e, y, d, yg, co, aX, dg, h, nU, q, btf, bu, bwt, fr, ar, nA, av, fy, u, Qx, iF, vR, V, aC, v, J, T, bwr, x, cr, ft, AP, btU, bws, hT, Nq, in, Ns, yH, xM, ji, Nn); #c1(F0LR2) c2(NP_001107008) c3(4126) c4(30240, 43297, 56354, 17183, 69411) c5(bL, IJ, vR, cr, aC, h, LR, eQ, Nq, Ns, gg, mo, Qx); #c1(F0LR3) c2(NP_000795) c3(4127) c4(30241, 43298, 56355, 17184, 69412) c5(IJ, mo, iP, Nq, Ns, iG, av, u, y); #c1(FOPNL) c2(NP_653201) c3(4128) c4(30242, 43299, 56356, 17185, 69413) c5(dx, A, aw, b, jq, kB, jR, iL, gE, bf, aI, adr, U, y, jx, m, dv, pp, B, q, bu, cU, ar, u, dh, xy, adf, Uv, V, I, cV, du, J, cd, cz, dt, P, Ce, T, fO, bq, qt, fN, iV, aE, fR, mD, aA, wT); #c1(FOSB) c2(NP_001107643) c3(4129) c4(30243, 43300, 56357, 17186, 69414) c5(B, iq, bx, w, dd, bW, e, O, cy, t, xc, aC, fx, su, qt, ag, bk, i, dc, aA, aUr, anY, X, Hk, jz, hS, Ku, IW, U, cM, co, uj, f, bu, cs, av, fy, bm, iT, V, Dp, bt, aY, fw, cz, ji, ap, b, bL, aF, Of, ey, d, re, hV, q, ra, u, o, da, fs, j, by, G, rw, aZ, nV, hU, Dj, gd, yA, hd, de, A, sO, di, jQ, m, QV, aX, fq, h, F, oE, M, y, ui, be, P, T, II, nP, ad, xM, Ic, Yv); #c1(FOS) c2(NP_005243) c3(4130) c4(30244, 43301, 56358, 17187, 69415) c5(dx, IJ, B, iq, bx, sJ, w, dd, cO, bW, e, O, bQ, cy, t, n, xc, ng, Ib, bK, du, bp, ft, Jj, fx, jT, gg, su, wh, qt, ag, cT, bk, i, aA, anY, X, Hk, jz, eu, hS, Ku, IW, cA, U, y, co, bww, uj, DM, f, bu, cs, av, fy, bm, iT, V, ae, Dp, dv, bt, rT, iA, anf, PY, fw, ji, ci, ap, hV, b, aF, Of, Dm, dk, ic, ey, d, Fp, jd, re, nU, je, q, jV, ND, ar, sR, jG, u, aE, o, da, kF, gL, ad, G, xq, rw, aGn, aZ, et, jH, nV, hU, he, xU, ih, gd, I, yA, hd, adq, bL, A, sO, fr, di, zK, fs, aI, Ic, m, aX, LI, fq, h, F, M, aC, aHz, oJ, jQ, ma, cV, ui, be, J, vF, W, P, T, II, nP, by, bwu, adu, DI, j, bwv, Yv, at, eG); #c1(FOSL1) c2(NP_001287784) c3(4131) c4(30245, 43302, 56359, 17188, 69416) c5(hV, iq, b, k, X, dB, O, w, kY, cO, et, U, KK, A, qG, y, d, jh, co, aX, re, nU, e, FN, ar, B, cs, av, fy, u, iT, R, ma, V, VD, bp, ad, W, jo, zU, T, ff, x, cy, fx, gg, VF, nV, fl, i, bT); #c1(FOSL2) c2(NP_005244) c3(4I32) c4(30246, 43303, 56360, 17189, 69417) c5(bL, A, b, X, jz, Co, bj, y, jQ, aX, h, B, cU, ff, av, u, aE, fi, ma, LR, j, IX, T, gg, ag); #c1(FOXA1) c2(NP_004487) c3(4133) c4(30247, 43304, 56361, 17190, 69418) c5(f, aw, b, A, e, y, cp, d, co, kJ, hV, q, cU, ar, B, ik, bm, iI, Be, bp, T, iA, nV, afP, u, YA, ag, fN); #c1(FOXA2) c2(NP_068556) c3(4134) c4(30248, 43305, 56362, 17191, 69419) c5(EO, A, JH, b, oa, z, bf, co, kJ, B, wN, q, ar, fy, bm, og, I, LR, bp, aZ, aM, nV, aai, afP, ch, cf, Bg, ag, gE, gf); #c1(FOXA3) c2(NP_004488) c3(4135) c4(30249, 43306, 56363, 17192, 69420) c5(ch, A, bm, q, aZ); #c1(FOXB1) c2(NP_036314) c3(4136) c4(30250, 43307, 56364, 17193, 69421) c5(td, e0); #c1(FOXC1) c2(NP_001444) c3(4137) c4(30251, 43308, 56365, 17194, 69422) c5(er, aw, b, X, cO, fy, qi, A, bwz, bf, VJ, kV, y, cU, bbO, XE, anI, h, f, q, JZ, bwy, bkn, atg, B, Yr, av, Hs, u, jZ, atp, anJ, I, m, aC, bwx, J, aSS, iA, Mw, bbM, kI, aM, kJ, rQ, gW, i, I, nU, vt, bbN); #c1(FOXC2) c2(NP_005242) c3(4138) c4(30252, 43309, 56366, 17195, 69423) c5(Qd, aw, b, bwA, VJ, U, y, d, jh, bbO, co, Qc, iI, aiT, re, eX, e, ik, alx, fy, u, bwC, iT, HI, kF, V, I, yO, cx, bbw, dt, Mw, AP, acL, er, Nq, mA, bwB, dn, zS, aA, ap); #c1(FOXD1) c2(NP_004463) c3(4139) c4(30253, 43310, 56367, 17196, 69424) c5(aOT); #c1(FOXE1) c2(NP_004464) c3(4140) c4(30254, 43311, 56368, 17197, 69425) c5(Dr, b, Sc, og, hM, U, adr, jw, d, or, hV, e, bfB, aoj, bwE, V, bK, nV, aPe, bwF, Ap, jU, bwD, Nq, ag, Ns, tI, aA, apU, aNd); #c1(FOXF1) c2(NP_001442) c3(4141) c4(30255, 43312, 56369, 17198, 69426) c5(b, VJ, U, y, aDW, tp, co, bb, ajn, nU, gL, gh, cI, bI, ar, gg, u, V, iI, Be, LR, Tr, aZ, acL, rQ, py); #c1(FOXF2) c2(NP_001443) c3(4142) c4(30256, 43313, 56370, 17199, 69427) c5(ao, A, b, cV, B, di, kY, u, y); #c1(FOXG1) c2(NP_005240) c3(4143) c4(30257, 43314, 56371, 17200, 69428) c5(aJd, bwH, bwG, hT, aai, WW, bK, nU, jB, jR, cz, hS, X, dI, QZ, av, u, Qx, y); #c1(FOXH1) c2(NP_003914) c3(4144) c4(30258, 43315, 56372, 17201, 69429) c5(A, cr, bwI, aai, acw, B, sL); #c1(FOX11) c2(NP_036320) c3(4145) c4(30259, 43316, 56373, 17202, 69430) c5(alo, bwJ, AP, bwK); #c1(FOXJ1) c2(NP_001445) c3(4146) c4(30260, 43317, 56374, 17203, 69431) c5(m, ag, aei, kN, f, mW, Kc, X, dQ, II, Dc, aC, av, u, gI, y); #c1(FOXJ2) c2(NP_060886) c3(4147) c4(30261, 43318, 56375, 17204, 69432) c5(VJ, u, y); #c1(FOXK1) c2(NP_001032242) c3(4148) c4(30262, 43319, 56376, 17205, 69433) c5(bwL); #c1(FOXK2) c2(NP_004505) c3(4149) c4(30263, 43320, 56377, 17206, 69434) c5(bwL); #c1(FOXL1) c2(NP_005241) c3(4150) c4(30264, 43321, 56378, 17207, 69435) c5(kJ, X, ag, Ca, bw, VJ, o); #c1(FOXL2) c2(NP_075555) c3(4151) c4(30265, 43322, 56379, 17208, 69436) c5(avV, aw, b, X, bwN, jy, bwO, jw, aOx, bbg, aOy, or, f, ar, bwS, PX, aNF, Am, arP, aIL, wp, aAH, bwQ, dt, bwM, bwR, uQ, QZ, Ap, bfD, W, xL, aTZ, bwP, aKv, yE, Ca, asT, nU, aXx, arJ, anK); #c1(FOXM1) c2(NP_068772) c3(4152) c4(30266, 43323, 56380, 17209, 69437) c5(by, hV, aw, iD, b, ag, X, F, pR, gG, eu, py, Ip, w, e, jR, kY, bw, iG, U, bu, A, aI, y, d, co, cI, i, h, f, LI, q, es, fr, aoe, ar, B, cs, yA, av, fy, u, aE, asM, R, g, og, V, cV, bwU, ft, be, gm, bp, J, W, T, bt, bwT, et, fx, ad, gg, po, cW, nV, gt, iL, ji, bm, kJ, nJ, mD, gd, qP, fI, iT, tI, Ez, aA, re, O); #c1(FOXN1) c2(XP_005258103) c3(4153) c4(30267, 43324, 56381, 17210, 69438) c5(d, fi, IJ, aX, b, bwW, afW, Zy, B, eu, K, pw, T, bwV, bwX, yA, YQ, e); #c1(FOXN2) c2(NP_002149) c3(4154) c4(30268, 43325, 56382, 17211, 69439) c5(jz, jQ); #c1(FOXN3) c2(NP_001078940) c3(4155) c4(30269, 43326, 56383, 17212, 69440) c5(dA, jL, q, M, cO, bg); #c1(FOX01) c2(NP_002006) c3(4156) c4(30270, 43327, 56384, 17213, 69441) c5(dx, jK, B, dN, gG, w, bf, O, cU, bQ, kz, cI, fH, gI, mz, aC, du, gm, dL, fp, wh, BX, OR, fN, ag, aA, X, eu, IW, bw, y, co, pp, f, bu, cc, cs, av, fy, bm, iT, fi, cx, eX, ny, iA, fJ, QG, ji, b, apC, ey, ha, Ap, Be, re, q, es, jG, u, bnW, kF, I, by, et, bwZ, nV, I, A, pR, mW, gE, jw, m, jI, h, gT, M, oJ, cB, si, cV, bwY, gF, ad, aM, ip, XH, at, eG); #c1(FOX03) c2(NP_963853) c3(4157) c4(30271, 43328, 56385, 17214, 69442) c5(dx, jK, f, ER, w, O, gC, t, do, Fg, cc, aC, du, fx, jT, wh, QJ, fN, ie, cT, i, bq, aA, bT, QF, X, U, xU, y, co, pw, ak, bu, B, cs, av, fy, bm, V, ae, cx, pi, P, aoD, ji, b, Ap, Dx, hV, q, jV, ra, ff, hb, jG, u, dh, qL, LR, by, G, sf, jU, aAF, nV, hX, ch, ex, gd, I, A, pR, gE, jw, m, aX, kn, h, F, oJ, cB, aV, dj, si, cV, Be, J, jo, T, II, ad, bxa, agc, at, rb); #c1(FOX04) c2(NP_001164402) c3(4158) c4(30272, 43329, 56386, 17215, 69443) c5(m, cB, b, aiQ, t, h, f, cx, bu, aC, KL, iv, Tk, bf, aA, by, jw, aM); #c1(FOX06) c2(NP_001278210) c3(4159) c4(30273, 43330, 56387, 17216, 69444) c5(I, ak, bu, avn, bf, ey, by, aA, aM); #c1(FOXP1) c2(NP_001012523) c3(4160) c4(30274, 43331, 56388, 17217, 69445) c5(A, b, X, bo, iX, bxc, QR, w, ako, si, y, tp, Nm, jT, cr, acL, tq, Wk, nU, q, bu, fr, B, qB, bw, av, fy, u, dh, aUu, yJ, hW, yY, ft, gm, Wh, G, Ce, T, Lk, x, KE, rQ, py, cz, bxb, QV, cT, ix, aod, Aa, at, LQ); #c1(FOXP2) c2(NP_001166237) c3(4161) c4(30275, 43332, 56389, 17218, 69446) c5(KC, f, aw, b, jz, hS, A, acr, ako, aux, ahk, ai, jQ, jv, yQ, bxf, cA, ak, Me, B, aUu, hW, I, bK, bxe, fO, Wh, Lk, aj, QZ, aQX, cz, AP, jT, rQ, aQT, bxd, xM, acg, HZ, bxg, fP, aod, aA, rb); #c1(FOXP3) c2(NP_001107849) c3(4162) c4(30276, 43333, 56390, 17219, 69447) c5(en, aw, bx, gG, iU, Ka, Ip, sJ, w, hM, cO, pV, e, O, jT, cy, kJ, yh, eE, mR, jU, Pv, aD, fH, jG, gI, aoh, g, aeM, aC, qB, fO, bp, BW, YY, zQ, dH, Lz, f, OR, fc, mB, DD, bY, rS, cT, iT, aA, jI, bT, rn, rN, gE, Kt, cY, jz, eu, ag, mk, iG, bf, VG, U, y, yV, yt, co, BL, pp, yX, DM, ak, akf, bu, gX, Em, B, cs, av, fy, rr, fY, V, ae, beW, alf, YS, bxn, bxI, bt, gC, fJ, bxm, nb, dP, nc, ne, fG, bH, abs, iu, re, DG, WH, bxj, bW, b, LX, aF, qz, bhr, oi, aMH, eV, d, aem, QE, bxk, gz, q, aeA, X, Pc, ar, aJ, u, aE, da, adK, kF, Dc, gL, ad, Io, JH, jH, hU, ig, eQ, kM, iq, xU, Bm, dn, gI, I, aU, bxi, qX, KG, A, Pb, k, Ik, gn, mW, pw, di, Iv, iL, eM, PI, aI, xe, hP, vI, jQ, m, bxh, aX, kn, fq, h, ayi, aEU, n, gg, fP, aV, aq, jZ, Yb, ax, bwY, be, J, P, T, II, aFt, aur, by, aVu, aM, ii, eG, mb, bxb, akm, DI, j, iB, Oi, at, Nu, Dq, oT); #c1(FOXP4) c2(NP_001012426) c3(4163) c4(30277, 43334, 56391, 17220, 69448) c5(A, B, b); #c1(FOXQ1) c2(NP_150285) c3(4164) c4(30278, 43335, 56392, 17221, 69449) c5(d, fx, fy, aw, V, b, E, e, q, bu, ar, y, i, O, bw, av, by, u, U, aec); #c1(FOXR1) c2(NP_859072) c3(4165) c4(30279, 43336, 56393, 17222, 69450) c5(fr, cV, ft); #c1(FOXR2) c2(NP_940853) c3(4166) c4(30280, 43337, 56394, 17223, 69451) c5(jR, afY, u, iD, y); #c1(FOXRED1) c2(NP_060017) c3(4167) c4(30281, 43338, 56395, 17224, 69452) c5(ake, kW, bxp, pQ, bxo, bF); #c1(FPGS) c2(NP_001275732) c3(4168) c4(30282, 43339, 56396, 17225, 69453) c5(da, IJ, jI, V, b, fr, t, re, ie, gm, J, aC, G, ft, cs, nA, U, ad); #c1(FPR1) c2(NP_001180235) c3(4169) c4(30283, 43340, 56397, 17226, 69454) c5(aFI, m, cr, k, dL, aq, acp, vB, fN, P, w, di, aFi, Dv, Im, vI, u, aA, O, TP); #c1(FPR2) c2(XP_006723183) c3(4170) c4(30284, 43341, 56398, 17227, 69455) c5(dx, gz, b, k, X, aN, og, aeC, O, bkK, dv, aX, f, sB, fr, cs, av, u, afh, aC, du, ad, P, cy, fx, ft, afj, be, ag, fP, i, eG); #c1(FPR3) c2(NP_002021) c3(4171) c4(30285, 43342, 56399, 17228, 69456) c5(oy, fI); #c1(FRAS1) c2(NP_001159605) c3(4172) c4(30286, 43343, 56400, 17229, 69457) c5(Yj, qf, bxr, bxq, QI, aMp, bxs); #c1(FRAT1) c2(NP_005470) c3(4173) c4(30287, 43344, 56401, 17230, 69458) c5(co, iI, b, X, re, bu, ag, w, ik, iT, O, fy, ar, av, by, u, jG, y); #c1(FRAT2) c2(NP_036215) c3(4174) c4(30288, 43345, 56402, 17231, 69459) c5(by, aW, b, bu); #c1(FREM1) c2(XP_006716792) c3(4175) c4(30289, 43346, 56403, 17232, 69460) c5(oy, bxr, bxu, wN, bxv, uz, aMp, bxw, bq, bxt, bxx); #c1(FREM2) c2(NP_997244) c3(4176) c4(30290, 43347, 56404, 17233, 69461) c5(bxr, Qu, OC, aMp, cO, O); #c1(FREM3) c2(NP_001161707) c3(4177) c4(30291, 43348, 56405, 17234, 69462) c5(cA); #c1(FRG1) c2(NP_004468) c3(4178) c4(30292, 43349, 56406, 17235, 69463) c5(asx, Au, rO, oD, bxy, xI); #c1(FRG2) c2(NP_001005217) c3(4179) c4(30293, 43350, 56407, 17236, 69464) c5(aY, rO, cM, dc); #c1(FRK) c2(XP_011533957) c3(4180) c4(30294, 43351, 56408, 17237, 69465) c5(mz, o, A, jE, b, bm, h, B, q, P, aW, u, y); #c1(FRMD3) c2(NP_001231888) c3(4181) c4(30295, 43352, 56409, 17238, 69466) c5(bP, co, I, bp, fD, wf, bf, NB, et, aE, aM); #c1(FRMD4A) c2(NP_060497) c3(4182) c4(30296, 43353, 56410, 17239, 69467) c5(Yk, IV); #c1(FRMD4B) c2(NP_055938) c3(4183) c4(30297, 43354, 56411, 17240, 69468) c5(ig, cK, cO, ac, dA); #c1(FRMD5) c2(NP_001273419) c3(4184) c4(30298, 43355, 56412, 17241, 69469) c5(co); #c1(FRMD6) c2(NP_001253976) c3(4185) c4(30299, 43356, 56413, 17242, 69470) c5(cO, hT, cy, dA); #c1(FRMD7) c2(NP_919253) c3(4186) c4(30300, 43357, 56414, 17243, 69471) c5(aAk, pk, KU, NV, bxB, amJ, aiW, aQB, bxA, bnf, aTd, bxz); #c1(FRMPD1) c2(NP_055722) c3(4187) c4(30301, 43358, 56415, 17244, 69472) c5(oy, bb, Af); #c1(FRMPD2) c2(NP_001018081) c3(4188) c4(30302, 43359, 56416, 17245, 69473) c5(gn, jx); #c1(FRMPD4) c2(NP_055543) c3(4189) c4(30303, 43360, 56417, 17246, 69474) c5(oy, bj); #c1(FRRS1L) c2(NP_055149) c3(4190) c4(30304, 43361, 56418, 17247, 69475) c5(at); #c1(FRS2) c2(NP_001265286) c3(4191) c4(30305, 43362, 56419, 17248, 69476) c5(A, aX, iY, bxC, YR, hV, ag, di, B, bo, iJ, u, y); #c1(FRS3) c2(XP_011512557) c3(4192) c4(30306, 43363, 56420, 17249, 69477) c5(fy, A, B, o); #c1(FRY) c2(NP_075463) c3(4193) c4(30307, 43364, 56421, 17250, 69478) c5(b, nU, ED, y, u, ac); #c1(FRYL) c2(NP_055845) c3(4194) c4(30308, 43365, 56422, 17251, 69479) c5(n, cV, ci, J); #c1(FRZB) c2(NP_001454) c3(4195) c4(30309, 43366, 56423, 17252, 69480) c5(aDX, b, iP, dB, A, jR, cO, U, y, cp, aX, re, bu, ff, hb, u, iT, atW, V, nQ, aC, be, Zg, fO, by, W, jo, pt, uJ, ck, py, baC, AR, zM, eM, at); #c1(FSBP) c2(NP_001243070) c3(4196) c4(30310, 43367, 56424, 17253, 69481) c5(bQ, kF, b, ad, cs, vF); #c1(FSCB) c2(NP_115511) c3(4197) c4(30311, 43368, 56425, 17254, 69482) c5(A, cy); #c1(FSCN1) c2(NP_003079) c3(4198) c4(30312, 43369, 56426, 17255, 69483) c5(jz, A, aw, b, cG, auj, gG, awh, dB, sJ, BL, cO, aI, aeC, U, y, jQ, d, BO, Ez, MI, ae, Qm, h, B, e, q, bu, dI, Mr, ar, O, hb, nI, Hs, u, aE, xy, fi, V, iI, qZ, aC, Mi, cs, fO, by, W, bxD, PL, T, brd, pt, x, aX, fx, anf, fM, P, nV, auK, ag, kJ, jh, xU, ag, i, oM); #c1(FSCN2) c2(XP_011522894) c3(4199) c4(30313, 43370, 56427, 17256, 69484) c5(alM, nQ, nW, eu, nv, bxE, bxF, yn, VT, aW); #c1(FSD1) c2(NP_077309) c3(4200) c4(30314, 43371, 56428, 17257, 69485) c5(by, f, aw, b, fr, w, id, iG, cO, U, ft, A, aeC, xI, co, cy, cK, B, F, q, bu, ar, ff, cs, n, fy, bm, dh, rR, og, V, el, LR, J, ad, bq, cr, fx, hR, jE, iY, QG, Fr, nJ, Ry, bxG, oi, i, bh, at, cI); #c1(FSD1L) c2(NP_001138785) c3(4201) c4(30315, 43372, 56429, 17258, 69486) c5(by, f, aw, b, fr, w, id, iG, cO, U, ft, A, xI, co, cy, cK, B, F, q, bu, ar, ff, cs, n, fy, bm, dh, rR, og, V, el, J, ad, bq, cr, fx, hR, jE, iY, QG, Fr, nJ, Ry, bxG, oi, i, bh, at, cI); #c1(FSD2) c2(NP_001007123) c3(4202) c4(30316, 43373, 56430, 17259, 69487) c5(e0); #c1(FSHB) c2(NP_001018090) c3(4203) c4(30317, 43374, 56431, 17260, 69488) c5(fe, US, A, kF, am, yE, nU, bxH, cz, wn, NT, agc, av, u, jw); #c1(FSHR) c2(NP_000136) c3(4204) c4(30318, 43375, 56432, 17261, 69489) c5(aMC, A, iq, am, X, Lv, wn, ck, hM, wP, Lr, jw, cM, cp, bbg, m, qs, bQ, b, ZR, yE, BI, vf, UV, avT, asU, avR, tg, av, bxK, u, o, afF, em, NT, kF, zv, sH, bxJ, Dp, vF, wV, bxM, T, Lp, Ap, bfD, bxL, UH, agI, auJ, aY, UJ, aTZ, UW, bxI, sG, agc, dc, UU, di, aA, eG, Hq, Ca); #c1(FSIP1) c2(XP_011519608) c3(4205) c4(30319, 43376, 56433, 17262, 69490) c5(xJ, cy, aK, nU, agc, aN, ck, o, i, fx, at, u, y); #c1(FST) c2(NP_006341) c3(4206) c4(30320, 43377, 56434, 17263, 69491) c5(dx, A, b, X, aF, lW, i, dv, qi, ck, PM, cO, bxN, ps, fx, y, rN, d, aHA, bQ, aX, wP, Bc, Dq, B, e, q, bu, cU, ajJ, xl, av, aV, u, cc, iF, fU, kF, Zz, c, qL, sj, du, W, zU, T, Ca, cV, iA, jU, DP, wV, aFN, VG, bm, eQ, er, yE, tl, zS, aA, dR, eG); #c1(FSTL1) c2(NP_009016) c3(4207) c4(30321, 43378, 56435, 17264, 69492) c5(A, b, X, cO, co, sT, B, q, cU, av, oM, dh, aC, bxO, be, P, pt, iA, aH, fy, xU, ag, bq, ji); #c1(FSTL3) c2(NP_005851) c3(4208) c4(30322, 43379, 56436, 17265, 69493) c5(bm, b, u, aC, sx, eQ, fN, qi, cO, dL, y); #c1(FSTL4) c2(NP_055897) c3(4209) c4(30323, 43380, 56437, 17266, 69494) c5(fh, bb, alF, di, bq, cy, at, aE, ap); #c1(FSTL5) c2(NP_001121899) c3(4210) c4(30324, 43381, 56438, 17267, 69495) c5(oy, A, jR); #c1(FTCD) c2(NP_996848) c3(4211) c4(30325, 43382, 56439, 17268, 69496) c5(IJ, IP, Nq, bY, pD, q, Ns, bxP, o); #c1(FTHI) c2(NP_002023) c3(4212) c4(30326, 43383, 56440, 17269, 69497) c5(yJ, eR, afE, V, py, cO, yO, q, gL, v, jT, II, nl, dc, bxQ, Im, U, JN, bj, O); #c1(FTL) c2(NP_000137) c3(4213) c4(30327, 43384, 56441, 17270, 69498) c5(iL, cY, aVb, PE, bxR, bj, y, aAt, aX, f, wN, fr, afl, Dd, ZU, u, yJ, aC, yO, v, gL, ft, dt, axi, pq, aWN, xM, aVg, he, bcK, fP, dc, bM, aA, aVh, gf); #c1(FTMT) c2(NP_803431) c3(4214) c4(30328, 43385, 56442, 17271, 69499) c5(kU, cV, kT, f, sL, n, gF, bj, ci, aW, pq); #c1(FTO) c2(NP_001073901) c3(4215) c4(30329, 43386, 56443, 17272, 69500) c5(dx, dM, bf, b, aeB, jJ, rd, dv, A, di, iL, bxT, cA, kF, iA, cM, gO, qs, co, aX, ip, rh, B, q, cU, aQd, y, mm, cp, u, fQ, o, ff, em, dj, hW, aqQ, I, dA, bK, du, bp, P, bQ, eX, cV, cy, qg, k, aM, aOO, mz, aY, bm, MP, mA, ag, gA, aoz, bxS, dc, I, bq, aA, at, fD, ap); #c1(FTSJ1) c2(NP_001269086) c3(4216) c4(30330, 43387, 56444, 17273, 69501) c5(X, bxU, nz, nU, or); #c1(FTSJ2) c2(NP_037525) c3(4217) c4(30331, 43388, 56445, 17274, 69502) c5(ji, fy, cl, b); #c1(FTSJ3) c2(NP_060117) c3(4218) c4(30332, 43389, 56446, 17275, 69503) c5(X); #c1(FUBP1) c2(NP_001290362) c3(4219) c4(30333, 43390, 56447, 17276, 69504) c5(g, jE, k, bj, Fs, q, bm, Qx, O); #c1(FUBP3) c2(NP_003925) c3(4220) c4(30334, 43391, 56448, 17277, 69505) c5(g); #c1(FUCA1) c2(XP_011539469) c3(4221) c4(30335, 43392, 56449, 17278, 69506) c5(wf, av, P, LG, bxV); #c1(FUCA2) c2(NP_114409) c3(4222) c4(30336, 43393, 56450, 17279, 69507) c5(bfg); #c1(FUNDC1) c2(NP_776155) c3(4223) c4(30337, 43394, 56451, 17280, 69508) c5(nu); #c1 (FUNDC2) c2(NP_076423) c3(4224) c4(30338, 43395, 56452, 17281, 69509) c5(qz, g); #c1(FURIN) c2(NP_001276752) c3(4225) c4(30339, 43396, 56453, 17282, 69510) c5(dx, bL, di, iL, U, e, O, oy, Ag, dv, ip, jG, fy, u, jZ, bk, d, V, ol, du, P, T, ch, Af, oR, bh); #c1(FUS) c2(NP_001164408) c3(4226) c4(30340, 43397, 56454, 17283, 69511) c5(A, il, bS, am, bxZ, aGu, wn, NT, bo, fs, ai, y, M, QV, co, b, t, adc, f, N, jA, es, bxW, Vr, kz, mg, B, KL, iJ, Zh, OA, QJ, u, aHK, fU, si, bxY, I, cV, bK, Ua, v, bp, J, dt, ee, aj, bxX, ad, bya, ao, fy, PY, Dj, Sk, eB, QP, aA, GJ, h); #c1(FUT10) c2(NP_116053) c3(4227) c4(30341, 43398, 56455, 17284, 69512) c5(dA); #c1(FUT11) c2(NP_001271123) c3(4228) c4(30342, 43399, 56456, 17285, 69513) c5(pR); #c1(FUT1) c2(NP_000139) c3(4229) c4(30343, 43400, 56457, 17286, 69514) c5(jS, f, aw, b, X, qz, eu, CE, A, ic, z, e, fR, ps, fx, d, co, bb, btS, bj, h, CN, F, q, jV, bu, pn, B, pt, av, n, IU, bK, jD, cs, LG, gv, dt, P, T, BW, bh, x, J, by, pb, jT, Lc, pS, De, bV, adr, ag, i, oM, aEN); #c1(FUT2) c2(NP_001091107) c3(4230) c4(30344, 43401, 56458, 17287, 69515) c5(A, b, bx, X, Mj, gG, Mn, cM, byc, byd, cy, bj, f, byb, q, bu, cs, av, u, aE, bk, aC, yO, Dp, gL, ad, P, II, bt, HK, gC, by, pq, nh, aY, pY, kh, ag, byc, i, dc, I, Fp, iu); #c1(FUT3) c2(XP_011526169) c3(4231) c4(30345, 43402, 56459, 17288, 69516) c5(aZ, b, gG, w, bw, U, co, aX, bu, gX, cs, bv, u, V, J, gL, by, T, bt, cy, dO, pY, ag, bk, aA, fW, ap); #c1(FUT4) c2(NP_002024) c3(4232) c4(30346, 43403, 56460, 17289, 69517) c5(g, A, aw, jT, b, jz, w, oR, Iv, jy, U, hP, e, y, jQ, d, jh, co, aX, Ob, Bc, t, h, B, yh, q, bu, ar, O, cs, iJ, HE, jG, fy, u, n, cj, fi, V, J, bp, ad, W, CM, G, T, bt, et, by, huh, pP, Qk, jR, ag, fl, byf, Nx, ci); #c1(FUT5) c2(NP_002025) c3(4233) c4(30347, 43404, 56461, 17290, 69518) c5(by, co, aX, q, bu, A, T, cs, ji, ad); #c1(FUT6) c2(NP_001035791) c3(4234) c4(30348, 43405, 56462, 17291, 69519) c5(by, co, V, b, byg, B, g, bu, gX, A, T, cs, ji, U, ad, bm, ac); #c1(FUT7) c2(NP_004470) c3(4235) c4(30349, 43406, 56463, 17292, 69520) c5(co, bb, cB, b, q, ad, ax, i, cs, kF, dH); #c1(FUT8) c2(NP_004471) c3(4236) c4(30350, 43407, 56464, 17293, 69521) c5(Dr, A, aw, hy, b, f, asE, q, T, B, Hs, bm); #c1(FUT9)

c2(XP_011533687) c3(4237) c4(30351, 43408, 56465, 17294, 69522) c5(oy, at); #c1(FUZ) c2(NP_001165408) c3(4238) c4(30352, 43409, 56466, 17295, 69523) c5(IJ, aw, BE, me, f, Ck, mA, bO, Gs, HV, nA, iy, aA, byh, pP, Ib, iz); #c1(FXN) c2(NP_000135) c3(4239) c4(30353, 43410, 56467, 17296, 69524) c5(g, A, IK, b, mz, aoJ, AA, KN, fi, ahg, bf, kV, bG, Kx, yK, fl, kW, zo, bj, byi, f, sL, afl, KL, bK, mR, sK, bm, o, DU, em, si, alA, I, cV, nl, el, cs, v, bN, dt, ad, PL, IG, Lk, KX, bM, cK, cq, hR, kS, ac, aM, KK, aaz, cC, bk, bq, aff, fj, oB); #c1(FXR1) c2(NP_001013456) c3(4240) c4(30354, 43411, 56468, 17297, 69525) c5(d, A, b, nU, P, KK, ar, B, rO, Wp, e); #c1(FXR2) c2(NP_004851) c3(4241) c4(30355, 43412, 56469, 17298, 69526) c5(P, KK); #c1(FXYD1) c2(NP_001265647) c3(4242) c4(30356, 43413, 56470, 17299, 69527) c5(U, at, V, Qx); #c1(FXYD2) c2(NP_001671) c3(4243) c4(30357, 43414, 56471, 17300, 69528) c5(bf, byj, di, aM); #c1(FXYD3) c2(NP_001129479) c3(4244) c4(30358, 43415, 56472, 17301, 69529) c5(co, V, b, kJ, B, ag, A, T, bw, U, u); #c1(FXYD5) c2(NP_659003) c3(4245) c4(30359, 43416, 56473, 17302, 69530) c5(OG, ck, b, ix, bw, byl, pz, e, y, jx, d, aX, SI, ag, h, f, q, bu, bm, byk, jE, T, fp, aec, wV, u, wP, bk); #c1(FXYD6) c2(NP_001158303) c3(4246) c4(30360, 43417, 56474, 17303, 69531) c5(h); #c1(FYB) c2(NP_001230022) c3(4247) c4(30361, 43418, 56475, 17304, 69532) c5(gj, iL, aog, ae, dh); #c1(FYCO1) c2(NP_078789) c3(4248) c4(30362, 43419, 56476, 17305, 69533) c5(ix, bym); #c1(FYN) c2(NP_002028) c3(4249) c4(30363, 43420, 56477, 17306, 69534) c5(f, b, aF, iP, bg, w, zM, PE, O, A, e, y, cp, d, m, cy, t, ak, bu, iZ, ar, B, u, aE, o, afx, bj, GS, v, W, P, GI, cV, Fr, kS, aAF, G, ih, yE, zS, at); #c1(FZDI0) c2(NP_009128) c3(4250) c4(30364, 43421, 56478, 17307, 69535) c5(bhZ, hW, V, b, re, ad, cs, iT, jx); #c1(FZD1) c2(NP_003496) c3(4251) c4(30365, 43422, 56479, 17308, 69536) c5(b, fr, ik, HC, kY, y, ra, X, byn, cM, cs, HE, u, jF, il, cV, LR, ad, alM, ft, nV, aY, jR, dc, byo); #c1(FZD2) c2(NP_001457) c3(4252) c4(30366, 43423, 56480, 17309, 69537) c5(jR, wh, ak, il, b, LR, et, fe, T, oJ, bq, x, ik, u); #c1(FZD3) c2(NP_665873) c3(4253) c4(30367, 43424, 56481, 17310, 69538) c5(dj, BX, ip, aY, he, W, cT, alM, ny, ct, vt, eF); #c1(FZD4) c2(NP_036325) c3(4254) c4(30368, 43425, 56482, 17311, 69539) c5(wa, A, aw, b, HJ, Nq, Ak, w, nv, e, aW, d, aX, ip, mI, B, Jq, byn, O, hW, dn, I, Fw, ajG, vS, Ca, ny, cy, fx, AP, pk, qp, BX, byp, P, ag, oi, i, aA, eN, h); #c1(FZD5) c2(NP_003468) c3(4255) c4(30369, 43426, 56483, 17312, 69540) c5(by, Bu, b, fr, aN, HC, kY, aK, cM, byn, bu, jF, ik, ff, cs, HE, da, il, cV, ad, T, alM, ft, aY, Bt, dc, byn); #c1(FZD6) c2(NP_001158088) c3(4256) c4(30370, 43427, 56484, 17313, 69541) c5(iF, og, byq, cV, aY, byr, W, mk, cT, dc, byo, cM); #c1(FZD7) c2(NP_003498) c3(4257) c4(30371, 43428, 56485, 17314, 69542) c5(by, fe, il, V, b, i, q, et, bu, I, T, iL, kY, cs, x, ik, U, ad, jZ); #c1(FZD8) c2(NP_114072) c3(4258) c4(30372, 43429, 56486, 17315, 69543) c5(fx, i, kY); #c1(FZD9) c2(NP_003499) c3(4259) c4(30373, 43430, 56487, 17316, 69544) c5(by, PL, hW, V, atJ, n, bp, bu, W, cT, alM, fy, et, U, cz, vt, h, eF); #c1(FZR1) c2(NP_001129669) c3(4260) c4(30374, 43431, 56488, 17317, 69545) c5(ml, aw, bx, gG, dB, e, O, cy, ajF, kJ, fe, gm, fO, ft, Ce, fx, YY, yE, i, X, jf, iG, U, y, jb, tp, co, pw, rr, B, bu, Up, cs, av, fy, iT, is, V, qe, bt, iA, py, jR, alB, ji, apU, b, jq, alD, Mr, d, jh, re, hV, q, ar, ff, jG, u, qL, avo, by, ct, jH, iR, A, k, fr, pR, BY, og, hi, iK, jl, F, Uq, cU, avj, W, T, bp, aX, fT, ad, fM, Rd, E); #c1(GOS2) c2(NP_056529) c3(4261) c4(30375, 43432, 56489, 17318, 69546) c5(Ag, co, I, b, em, aC, B, jV, A, T, Af, aA); #c1(G2E3) c2(NP_060239) c3(4262) c4(30376, 43433, 56490, 17319, 69547) c5(cy); #c1(G3BPI) c2(XP_006714813) c3(4263) c4(30377, 43434, 56491, 17320, 69548) c5(d, BO, co, b, aC, mb, f, e, ag, fl, gE, u, DM, y); #c1(G6PC2) c2(NP_001075155) c3(4264) c4(30378, 43435, 56492, 17321, 69549) c5(dx, mz, BM, I, du, gF, mA, Hf, eX, aE, aA, bf, yW, ey, aM); #c1(G6PC3) c2(NP_612396) c3(4265) c4(30379, 43436, 56493, 17322, 69550) c5(fk, iw, ci, cr, vz, hN, aF, h, f, fP, byu, aoP, AU, byt, n, Dc, Gs, ael, bys, XR); #c1(G6PC) c2(NP_000142) c3(4266) c4(30380, 43437, 56494, 17323, 69551) c5(bP, is, SS, mz, dB, jc, w, ob, bf, bD, ey, O, Fp, BM, b, dL, gz, N, q, hN, bm, aE, adj, g, em, kF, I, iw, byv, ZS, dt, T, mD, gF, byw, et, aM, W, fk, ch, YA, cf, fN, byx, ael, wD); #c1(G6PD) c2(NP_000393) c3(4267) c4(30381, 43438, 56495, 17324, 69552) c5(avO, jK, f, adn, Ob, aDD, EM, yz, byH, cO, bf, VX, xl, aDi, t, zP, qU, Lm, cq, byA, n, mz, nz, FC, fO, BW, aHv, x, qx, pq, jE, nh, qt, bm, cT, pv, aA, adL, byF, byl, agJ, Ku, xZ, IW, Fh, qG, y, pp, ak, N, awd, oD, pP, byG, em, qw, ae, it, hi, eX, byJ, byK, qK, aH, Fz, pr, fw, Le, fK, ci, ap, fn, gB, b, byD, aF, qz, byE, au, Kk, byz, cK, eV, bb, jF, nU, q, byM, pn, as, jG, byC, u, aE, il, zd, gL, pF, G, aFj, iD, Nh, aWN, KK, ch, Ck, bpd, ah, aU, KC, agH, byy, aFq, iL, iC, Ld, bmO, aX, or, ni, h, ik, iM, aCr, fk, Ps, ma, c, an, hZ, J, dt, P, II, jl, ya, aM, CY, byL, I, rw, at, byB); #c1(GAA) c2(XP_005257251) c3(4268) c4(30382, 43439, 56496, 17325, 69553) c5(Dr, by, am, bkb, sE, Ck, eC, wn, ahg, bW, bf, kV, aW, byO, BM, aX, RD, pp, adD, pz, f, nv, bu, sL, mR, y, oD, sK, u, EX, da, mz, o, I, aC, el, byN, LG, v, PL, T, aZ, cK, ca, hR, aM, KK, azW, UX, tJ, nG, ch, hr, aff, wD, bV); #c1(GAB1) c2(NP_002030) c3(4269) c4(30383, 43440, 56497, 17326, 69554) c5(A, b, gN, w, y, jx, biX, co, aX, B, F, q, do, kN, u, kF, ze, fO, bQ, T, Ic, cT); #c1(GAB2) c2(NP_036428) c3(4270) c4(30384, 43441, 56498, 17327, 69555) c5(DB, b, X, eu, aN, O, co, aX, h, f, y, av, u, o, n, yJ, aC, fO, iU, P, T, jG, dP, hD, zl, I, aA); #c1(GAB3) c2(NP_001075042) c3(4271) c4(30385, 43442, 56499, 17328, 69556) c5(aE, gL); #c1(GABARAP) c2(NP_009209) c3(4272) c4(30386, 43443, 56500, 17329, 69557) c5(hS, iP, u, Yk, jb); #c1(GABARAPL1) c2(NP_113600) c3(4273) c4(30387, 43444, 56501, 17330, 69558) c5(aw, b, X, ja, v, ag, u, y); #c1(GABARAPL2) c2(NP_009216) c3(4274) c4(30388, 43445, 56502, 17331, 69559) c5(ag); #c1(GABBR1) c2(NP_001461) c3(4275) c4(30389, 43446, 56503, 17332, 69560) c5(b, GL, Id, hS, dd, cA, bw, m, yQ, do, iZ, qu, aV, CG, o, fU, hW, aqQ, cz, xk, aaB, T, jr, rV, hw, GT, ch, ag, di, GJ); #c1(GABBR2) c2(NP_005449) c3(4276) c4(30390, 43447, 56504, 17333, 69561) c5(Yk, vR, cy, bj, ak, Nq, cz, Ns, iZ, yk, cA, agp); #c1(GABPA) c2(NP_002031) c3(4277) c4(30391, 43448, 56505, 17334, 69562) c5(dx, B, pV, dN, w, aw, e, O, gO, dv, cy, cl, Hs, gl, fe, lb, bK, byP, du, ao, bp, cV, x, fx, dL, NB, pq, buh, qt, sg, os, ag, cT, dX, i, fN, aA, bT, bP, QF, X, iP, Ko, mk, LK, bf, bw, U, io, y, Wl, ed, co, pp, f, cs, av, fy, bm, iT, bk, is, V, ae, v, Fy, uu, cK, iA, pi, PY, fw, ji, fW, ap, aEg, b, aF, dk, z, fO, d, re, hV, g, jV, yp, dQ, Yr, ar, u, dh, o, jE, I, ad, aZ, et, jU, aWN, nV, hS, HN, gd, I, yA, bL, A, jc, og, byQ, iL, bZ, wf, aW, asN, LS, kV, h, cU, qB, aV, te, fU, si, uD, J, W, P, II, aX, by, aM, Lc, bh, at, gf, oT); #c1(GABPB1) c2(NP_002032) c3(4278) c4(30392, 43449, 56506, 17335, 69563) c5(fh, Fy, dA, fl, Ko); #c1(GABRA1) c2(NP_001121120) c3(4279) c4(30393, 43450, 56507, 17336, 69564) c5(ak, aPm, byT, Id, hS, w, U, Iz, aqB, aqs, byS, oE, cs, CG, amd, dj, V, cz, GI, jr, ad, byR, akA, PY, he, bM, GJ, byU); #c1(GABRA2) c2(NP_000798) c3(4280) c4(30394, 43451, 56508, 17337, 69565) c5(ak, Gt, Ow, hS, dd, If, bhU, Wj, qc, il, f, dW, Gj, DY, Yk, hv, cz, byW, Js, Sw, GI, byV, ih, jN, GF, jP); #c1(GABRA3) c2(NP_000799) c3(4281) c4(30395, 43452, 56509, 17338, 69566) c5(de, dj, IZ, ii, sG, ak, dW, cz, byX, hS, xP, cA, aV, cM); #c1 (GABRA4) c2(NP_000800) c3(4282) c4(30396, 43453, 56510, 17339, 69567) c5(de, Yk, hS, ak, cz, dk, zb); #c1(GABRA5) c2(XP_005268315) c3(4283) c4(30397, 43454, 56511, 17340, 69568) c5(jR, vf, rv, agw, ak, Nq, Id, cz, ns, hS, nm, nt, nq, nr, nn, cA, no, np, oN); #c1(GABRA6) c2(NP_000802) c3(4284) c4(30398, 43455, 56512, 17341, 69569) c5(ak, aiV, hS, qa, cM, oy, Iz, qc, aqs, dW, tU, vO, vN, bdz, cz, GI, to, f, aY, ih, jN, dc, aA); #c1(GABRB1) c2(NP_000803) c3(4285) c4(30399, 43456, 56513, 17342, 69570) c5(aPm, ak, aeY, cz, ns, hS, iZ, GI, wX, If, DY); #c1(GABRB2) c2(NP_000804) c3(4286) c4(30400, 43457, 56514, 17343, 69571) c5(de, bhG, ak, Iz, ahj, tW, aqs, iZ, dj, he, cz, hS, vu, GI, cO); #c1(GABRB3) c2(NP_000805) c3(4287) c4(30401, 43458, 56515, 17344, 69572) c5(KC, hY, byY, Id, Nq, hS, bw, cM, Wk, ak, q, agw, Wy, Qx, CH, nu, cz, jr, AP, rQ, Ey, IC, iZ, CG, ih, aY, Ns, amS, rv, dc, bM, apU); #c1(GABRE) c2(NP_004952) c3(4288) c4(30402, 43459, 56516, 17345, 69573) c5(Yk, A, aw, b, vf, B, vW, ak, GJ); #c1(GABRG1) c2(NP_775807) c3(4289) c4(30403, 43460, 56517, 17346, 69574) c5(oy, Gt, ak, cz, vu, pt, eO, oM, bri); #c1(GABRG2) c2(NP_000807) c3(4290) c4(30404, 43461, 56518, 17347, 69575) c5(aqs, aPm, hY, jr, bzb, Id, hS, dd, Iz, byZ, bza, ak, dW, oE, Wy, CG, dj, bzc, yH, xq, GI, bM, he, ih, bh, bki, Qi); #c1(GABRG3) c2(NP_001257802) c3(4291) c4(30405, 43462, 56519, 17348, 69576) c5(de, bhG, hW, ak, US, he, cz, agw, rv, bj, cM); #c1(GABRP) c2(XP_011532807) c3(4292) c4(30406, 43463, 56520, 17349, 69577) c5(b, qL, ak, Ip, cM, qO, cO, u, y); #c1(GABRQ) c2(NP_061028) c3(4293) c4(30407, 43464, 56521, 17350, 69578) c5(ak, cy, sG, byU, vf, q, vW, co, i, fx, GJ, bm); #c1(GABRR1) c2(NP_001243632) c3(4294) c4(30408, 43465, 56522, 17351, 69579) c5(jv, GJ, ak); #c1(GABRR2) c2(NP_002034) c3(4295) c4(30409, 43466, 56523, 17352, 69580) c5(or, ak, je, hS, z, GJ, byU); #c1(GAD1) c2(NP_000808) c3(4296) c4(30410, 43467, 56524, 17353, 69581) c5(de, ak, aw, kE, b, ey, Ns, bhr, bzd, Nq, ns, hS, qa, nt, nq, nr, nn, cA, bf, al, np, A, no, cM, m, wX, xw, HZ, SQ, f, avW, sp, dZ, B, qu, mA, yW, aV, IV, bze, Mn, jN, dV, mz, dj, hW, I, rV, bK, bj, sB, dB, v, cz, fl, aFj, tR, mD, Fr, zf, kS, ac, aM, to, rQ, Lz, hy, Y, aY, vu, tW, MP, he, aE, ih, ag, zT, nm, iu, dc, dd, aA, at, T, Gn); #c1(GAD2) c2(NP_001127838) c3(4297) c4(30411, 43468, 56525, 17354, 69582) c5(dx, iq, hY, aiW, bhr, tR, MP, rd, cA, qa, dd, dV, wX, wf, bf, aEe, ih, aqB, rh, Mn, mI, do, dZ, yW, IV, bzf, o, em, dj, I, dA, bj, du, vF, W, vH, aFj, zf, cz, kS, zR, aM, aY, vu, tW, cf, hn, mA, aE, Eo, ag, sp, mD, aA, at, iu); #c1(GADD45B) c2(NP_056490) c3(4298) c4(30412, 43469, 56526, 17355, 69583) c5(b, zH, mk, gE, U, iK, aiT, f, g, ik, cs, av, bm, PJ, Pz, il, aC, be, Dw, ad, cK, jE, hq, Dz, he, ex, qd, cZ); #c1(GADD45G) c2(NP_006696) c3(4299) c4(30413, 43470, 56527, 17356, 69584) c5(A, aw, apS, b, iF, vp, y, jh, qf, co, bb, f, q, bu, ik, B, av, u, PJ, il, Xc, bp, W, sf, aZ, pt, et, Le, yE, bq, oM, gh); #c1(GADD45GIP1) c2(NP_443082) c3(4300) c4(30414, 43471, 56528, 17357, 69585) c5(h, A, B, J); #c1(GADL1) c2(NP_997242) c3(4301) c4(30415, 43472, 56529, 17358, 69586) c5(d, HI, oC, co, aX, QN, dA, X, Tu, k, bp, amV, w, ar, amW, av, fy, bm, e); #c1(GAGE10) c2(NP_001091883) c3(4302) c4(30416, 43473, 56530, 17359, 69587) c5(b); #c1 (GAGE1) c2(NP_001035753) c3(4303) c4(30417, 43474, 56531, 17360, 69588) c5(bw, ck, aX, q, ar); #c1(GAK) c2(NP_005246) c3(4304) c4(30418, 43475, 56532, 17361, 69589) c5(Mi, bj); #c1(GALC) c2(NP_000144) c3(4305) c4(30419, 43476, 56533, 17362, 69590) c5(d, em, bzg, ez, mZ, cJ, bK, v, LG, bzh, aAA, aYY, e); #c1(GAL) c2(NP_057057) c3(4306) c4(30420, 43477, 56534, 17363, 69591) c5(bzi, ak, b, fi, HJ, aE, vD, dB, tR, Hr, eH, hS, w, di, dV, iG, iC, cA, bf, U, oE, jw, cM, d, Tq, sG, wG, PK, f, F, q, bzk, Ut, tF, dZ, dQ, y, cs, e, av, u, fp, o, fh, g, iF, dj, fU, fs, V, cV, fl, LG, bzj, ad, T, II, bq, iN, GI, Gj, aM, GL, aY, ch, iZ, aE, ih, yE, acF, bka, dc, O, aA, jP, wX, ap); #c1(GALK1) c2(NP_000145) c3(4307) c4(30421, 43478, 56535, 17364, 69592) c5(aWN, V, bzn, ni, bzm, bzl, Ri); #c1(GALK2) c2(NP_001001556) c3(4308) c4(30422, 43479, 56536, 17365, 69593) c5(fl); #c1(GALM) c2(NP_620156) c3(4309) c4(30423, 43480, 56537, 17366, 69594) c5(baR, jH, V, dt, fP, U); #c1(GALNS) c2(NP_000503) c3(4310) c4(30424, 43481, 56538, 17367, 69595) c5(aF, BY, adp, y, cp, bjV, qf, adk, bu, aW, bzq, auC, u, azG, em, Zz, qJ, LG, by, ady, P, cv, aeo, wu, bzo, bzp, cT, kA); #c1(GALNT12) c2(NP_078918) c3(4311) c4(30425, 43482, 56539, 17368, 69596) c5(bb, V, b, x, bzr, U); #c1(GALNT13) c2(NP_001288556) c3(4312) c4(30426, 43483, 56540, 17369, 69597) c5(d, ho, qt, ik, at, e); #c1 (GALNT14) c2(NP_001240755) c3(4313) c4(30427, 43484, 56541, 17370, 69598) c5(zE, aX, q, b); #c1 (GALNT15) c2(NP_473451) c3(4314) c4(30428, 43485, 56542, 17371, 69599) c5(U, re, qt, V, iT); #c1(GALNT18) c2(NP_940918) c3(4315) c4(30429, 43486, 56543, 17372, 69600) c5(aC, A, dA); #c1(GALNT1) c2(XP_005258296) c3(4316) c4(30430, 43487, 56544, 17373, 69601) c5(X, av, fl, ao); #c1(GALNT2) c2(NP_001278795) c3(4317) c4(30431, 43488, 56545, 17374, 69602) c5(d, aw, I, eX, e, q, dK, ZG, T, aA, bb, di, at, ey, fh); #c1(GALNT3) c2(NP_004473) c3(4318) c4(30432, 43489, 56546, 17375, 69603) c5(A, aw, X, dB, jc, bf, e, cp, d, co, B, akl, bzs, dl, ar, bsO, mm, aM, aE, is, em, bp, pr, aOF, ji, av, aOE, ag, bsX, T); #c1(GALNT4) c2(NP_003765) c3(4319) c4(30433, 43490, 56547, 17376, 69604) c5(at); #c1(GALNT5) c2(NP_055383) c3(4320) c4(30434, 43481, 56548, 17377, 69605) c5(by, bu); #c1(GALNT6) c2(XP 006719277) c3(4321) c4(30435, 43492, 56549, 17378, 69606) c5(y, u, aw, T, b); #c1(GALNT7) c2(NP_059119) c3(4322) c4(30436, 43493, 56550, 17379, 69607) c5(re, fl, iT); #c1 (GALNT8) c2(NP_059113) c3(4323) c4(30437, 43494, 56551, 17380, 69608) c5(aI); #c1(GALNT9) c2(NP_001116108) c3(4324) c4(30438, 43495, 56552, 17381, 69609) c5(cV); #c1(GALNTL6) c2(NP_001030017) c3(4325) c4(30439, 43496, 56553, 17382, 69610) c5(oy, ED, fP, dA); #c1(GALP) c2(NP_001139018) c3(4326) c4(30440, 43497, 56554, 17383, 69611) c5(ch, aA, Tv, o, Tq); #c1(GALR1) c2(NP_001471) c3(4327) c4(30441, 43498, 56555, 17384, 69612) c5(d, iF, hW, V, GL, F, e, w, aA, U, Fg); #c1(GALR2) c2(NP_003848) c3(4328) c4(30442, 43499, 56556, 17385, 69613) c5(fU, b, cV, aY, wG, f, F, ih, w, dc, cM); #c1(GALR3) c2(XP_011528770) c3(4329) c4(30443, 43500, 56557, 17386, 69614) c5(iF, do, hW, wG); #c1(GALT) c2(NP_000146) c3(4330) c4(30444, 43501, 56558, 17387, 69615) c5(em, bfV, an, aTZ, Dp, dt, ni, P, X, bIF, aod, Xf, as, bf, av, Ap, eG, PK, jw); #c1 (GAMT) c2(NP_000147) c3(4331) c4(30445, 43502, 56559, 17388, 69616) c5(bzt, IJ, nU, nw, sc, aO); #c1 (GANAB) c2(NP_001265123) c3(4332) c4(30446, 43503, 56560, 17389, 69617) c5(b); #c1(GANC) c2(NP_001288339) c3(4333) c4(30447, 43504, 56561, 17390, 69618) c5(adH); #c1(GAN) c2(NP_071324) c3(4334) c4(30448, 43505, 56562, 17391, 69619) c5(b, cG, KG, bK, Y, v, cb, aTI, ac); #c1(GAP43) c2(NP_001123536) c3(4335) c4(30449, 43506, 56563, 17392, 69620) c5(amC, qJ, ao, xM, gE, bS, dk, aY, bK, tW, cO, cV, aN, aUV, sp, tl, dc, x, OA, aV, cM); #c1(GAPDH) c2(NP_001243728) c3(4336) c4(30450, 43507, 56564, 17393, 69621) c5(ml, aw, dB, bzu, dM, bf, e, O, cp, bzw, cy, Os, mR, aC, yL, yO, gm, bp, ft, od, Jj, x, fx, jT, dL, jE, qt, nG, ag, w, iT, i, aA, jl, Dr, gk, aBv, X, U, y, ce, VO, f, bu, B, av, fy, bm, pW, afL, iF, V, qq, v, gv, cK, en, OW, b, wn, fl, oR, z, d, jh, jd, re, hV, q, Jq, jF, ar, ff, fv, Tv, u, nj, o, da, sQ, I, wV, j, by, bzv, ao, nV, eQ, UW, dh, wP, zO, bL, A, k, fr, xj, BY, gE, wf, JK, aX, wp, Tq, h, F, ik, aV, aq, si, tP, nQ, cV, me, J, W, P, T, fO, pw, Bb, aM, Jh, fP, bh, at, Bi); #c1(GAPDHS) c2(NP_055179) c3(4337) c4(30451, 43508, 56565, 17394, 69622) c5(e); #c1(GARI) c2(NP_061856) c3(4338) c4(30452, 43509, 56566, 17395, 69623) c5(yt, ss, ps, eM); #c1(GAREM) c2(NP_001229338) c3(4339) c4(30453, 43510, 56567, 17396, 69624) c5(ey); #c1(GARNL3) c2(NP_001273708) c3(4340) c4(30454, 43511, 56568, 17397, 69625) c5(ak); #c1(GARS) c2(NP_002038) c3(4341) c4(30455, 43512, 56569, 17398, 69626) c5(A, b, cG, X, EM, Ik, IB, HS, Md, e, y, d, qZ, jT, BL, cN, cb, re, B, q, bu, fr, kz, cc, OF, av, u, iT, bhn, bm, V, nl, aB, ft, Ca, by, ac, ao, Ma, Y, IV, ag, Im, at); #c1(GART) c2(NP_780294) c3(4342) c4(30456, 43513, 56570, 17399, 69627) c5(IJ, A, V, Ma, cG, afg, nl, f, Nq, Ns, Y, e, PS, aq, aW); #c1(GAS1) c2(NP_002039) c3(4343) c4(30457, 43514, 56571, 17400, 69628) c5(Dr, aai, A, aw, V, b, asx, X, B, cV, bu, og, fx, i, Nq, aX, U, by, dh, O, ez); #c1(GAS2) c2(NP_001137302) c3(4344) c4(30458, 43515, 56572, 17401, 69629) c5(jG, hR, rb, I, do); #c1(GAS2L1) c2(NP_001265659) c3(4345) c4(30459, 43516, 56573, 17402, 69630) c5(h); #c1(GAS6) c2(NP_000811) c3(4346) c4(30460, 43517, 56574, 17403, 69631) c5(pM, dx, A, b, qd, X, Dr, dB, ix, wh, O, Uq, aW, m, ce, bb, am, kJ, t, h, hV, N, nv, bu, cU, aC, pn, y, LI, av, aV, u, fh, be, I, hf, du, BC, J, by, G, dv, bzx, Qt, cy, jT, jU, pq, aH, dO, hU, iK, bzy, B, ji, rb, ap); #c1(GAS7) c2(NP_001124303) c3(4347) c4(30461, 43518, 56575, 17404, 69632) c5(jH, fl, bb, V, h, J, U, QJ, aA, Q, ez); #c1(GAS8) c2(NP_001273137) c3(4348) c4(30462, 43519, 56576, 17405, 69633) c5(u, y, cO); #c1(GAST) c2(NP_000796) c3(4349) c4(30463, 43520, 56577, 17406, 69634) c5(Ir, Zq, Yq, HC, w, baB, O, cp, DE, bx, bzz, yO, asM, bp, azo, x, hR, kN, mO, ape, xO, akn, os, ag, cT, dc, EO, X, eu, fU, bw, U, cM, bjV, ce, js, bu, cs, bv, av, aBU, V, qq, bt, qH, JY, ahT, wu, aY, aNp, bzA, iu, b, aF, Bh, eA, OC, ar, fv, u, Zz, atr, gL, by, et, aee, aJA, Mp, k, BY, D, jR, hP, aW, qn, bzC, yx, y, bzq, ma, bzB, J, W, P, T, nP, ad, fM, qp, cv, qJ, azG, Yv); #c1(GATA1) c2(NP_002040) c3(4350) c4(30464, 43521, 56578, 17407, 69635) c5(azR, jK, A, b, aGk, Ln, bzH, pz, xK, NH, Em, bzJ, ps, od, y, CZ, gR, Ei, cy, pH, t, oB, B, N, adH, M, fr, n, bzD, bw, Ch, jG, u, D, fe, aYo, bzG, iv, eM, J, ft, dt, Rk, bzF, bzl, T, ew, pF, pq, P, G, bzE, NG, pP, aq, Ck, h, fg, yM, bgd, eN, AJa, ci, pv); #c1(GATA2) c2(NP_001139133) c3(4351) c4(30465, 43522, 56579, 17408, 69636) c5(Qd, A, aw, b, tC, pD, Em, xK, bzL, eM, VJ, bj, oU, y, co, Qc, pp, h, B, q, jV, cy, M, hf, hN, uz, iv, jG, fy, hD, n, cj, fe, cV, lb, Dc, J, bp, W, pr, Q, II, bzK, aKr, bb, jT, azK, iw, bvO, vz, u, yE, ji, at, eG, ci); #c1(GATA3) c2(NP_002042) c3(4352) c4(30466, 43523, 56580, 17409, 69637) c5(pm, en, aw, dB, vp, e, aFR, cy, t, AX, aDx, eE, aD, fH, gl, TP, aC, ee, aiL, jT, i, dc, pt, Kc, mk, Ni, kY, bf, ajw, bw, vl, cM, co, ave, na, DM, f, bu, B, fY, bb, fJ, aY, bzM, ji, iu, re, b, bah, d, Ag, aKA, bxk, CO, oO, iR, aE, da, j, lo, ig, u, gd, I, vZ, A, Pb, pR, mW, di, eM, Pm, m, fq, y, NX, cV, ti, T, oM, aVu, aM, nk, Rd, eB, DI, Af, rr, oT); #c1(GATA4) c2(NP_002043) c3(4353) c4(30467, 43524, 56581, 17410, 69638) c5(KC, by, bzQ, aw, b, sO, X, uC, IW, jB, wy, Mw, id, jj, cO, bzS, bf, U, e, y, mR, aoa, QJ, ag, bQ, bb, or, tg, Be, cK, k, wN, d, bu, cU, mL, bzP, O, cs, bw, ik, av, JY, u, aE, g, aAH, py, bm, V, il, cV, sX, me, blU, bp, ad, Hq, T, bzN, ar, fy, cr, iA, hR, Cd, aM, rQ, hQ, ji, ck, ch, mB, aq, bzR, yy, ji, aE, acw, mx, bzO, bq, ahp, at, Ca); #c1(GATA5) c2(XP_006723762) c3(4354) c4(30468, 43525, 56582, 17411, 69639) c5(aw, b, sO, pR, dB, bw, U, e, y, hh, Mw, cr, bu, ik, su, cs, Gs, u, amO, d, V, il, bp, ad, T, ar, by, sP, JY, py, acw, ag); #c1(GATA6) c2(NP_005248) c3(4355) c4(30469, 43526, 56583, 17412, 69640) c5(gG, bm, bzW, aw, b, bx, X, IW, wy, O, Hq, w, jj, bf, bzT, U, y, bQ, MI, ajn, kJ, bzX, k, wN, Lo, bu, mL, ar, bzU, cr, cs, bw, fv, av, QJ, u, aKy, kF, V, I, LR, j, ad, IR, Ih, sf, T, bp, bb, Mw, by, Lx, bzV, aM, W, rQ, hQ, IX, acw, iR, mB, fP, aq, aLq, qP, IS, ji, at, eG); #c1(GATAD1) c2(NP_066990) c3(4356) c4(30470, 43527, 56584, 17413, 69641) c5(od, bzY, mR); #c1(GATAD2A) c2(NP_001287875) c3(4357) c4(30471, 43528, 56585, 17414, 69642) c5(l); #c1(GATAD2B) c2(XP_006711532) c3(4358) c4(30472, 43529, 56586, 17415, 69643) c5(en, b, WW, jk, nU, F, ad, bzZ, co, B, A, cs, O, u, y); #c1(GATB) c2(NP_004555) c3(4359) c4(30473, 43530, 56587, 17416, 69644) c5(hT, di); #c1(GATM) c2(NP_001473) c3(4360) c4(30474, 43531, 56588, 17417, 69645) c5(Ag, aH, A, ch, Qf, B, T, Af, cO, at, et, bT, bAa); #c1(GBA2) c2(NP_065995) c3(4361) c4(30475, 43532, 56589, 17418, 69646) c5(aX, bAb, wz, KA, f, LG, bN, bcZ, kS, LF); #c1(GBA) c2(NP_001165282) c3(4362) c4(30476, 43533, 56590, 17419, 69647) c5(Jy, eZ, bAc, bg, dw, IW, xw, bj, b, f, v, bAe, o, em, afx, bAd, bK, GS, LG, tz, gm, fO, jT, aGm, pq, aFd, zp, aGI, yH, wz); #c1(GBAS) c2(NP_001189398) c3(4363) c4(30477, 43534, 56591, 17420, 69648) c5(kW); #c1(GBE1) c2(NP_000149) c3(4364) c4(30478, 43535, 56592, 17421, 69649) c5(At, BM, cy, dA, cJ, cK, bAg, gv, aOp, bAi, bh, fl, z, oD, aA, bAf, bAh); #c1(GBF1) c2(NP_004184) c3(4365) c4(30479, 43536, 56593, 17422, 69650) c5(vQ, gL); #c1(GBGT1) c2(NP_001269558) c3(4366) c4(30480, 43537, 56594, 17423, 69651) c5(ig, U, by, V, bu); #c1(GBX1) c2(NP_001092304) c3(4367) c4(30481, 43538, 56595, 17424, 69652) c5(h, A, B, dA); #c1(GBX2) c2(NP_001476) c3(4368) c4(30482, 43539, 56596, 17425, 69653) c5(A, b, dA, h, B, PY, ow, fH, fJ); #c1(GCA) c2(NP_036330) c3(4369) c4(30483, 43540, 56597, 17426, 69654) c5(PJ, aV, hW, V, b, cV, Xc, f, jh, bAj, aiM, au, fy, kK, cy, U, at, pP, aA, apz); #c1(GCC1) c2(NP_078799) c3(4370) c4(30484, 43541, 56598, 17427, 69655) c5(acT, dd, jN); #c1(GCDH) c2(NP_000150) c3(4371) c4(30485, 43542, 56599, 17428, 69656) c5(em, awK, aw, ni, f, dt, sc, bM, yj); #c1(GCFC2) c2(NP_003194) c3(4372) c4(30486, 43543, 56600, 17429, 69657) c5(t, w, T, yQ, ajv); #c1(GCG) c2(NP_002045) c3(4373) c4(30487, 43544, 56601, 17430, 69658) c5(dx, bL, dM, bAk, b, mz, rq, z, VP, eu, eH, dv, id, di, jJ, cO, bf, ey, A, y, bAm, ag, hR, Xy, kJ, bll, bba, f, ys, Jy, om, kz, mR, B, cs, hi, ar, bAn, u, aE, apz, da, em, SA, du, fs, Rb, I, cV, QU, qq, gJ, v, hep, ad, qp, eX, bh, Qt, x, aPK, gF, gv, fM, aM, aJX, Lc, wn, bAI, cf, Du, mD, jd, bq, jB, gz, aA, at, rr, jU, ap); #c1(GCGR) c2(XP_006722340) c3(4374) c4(30488, 43545, 56602, 17431, 69659) c5(ahT, mz, qs, qp, I, bll, cx, di, fD, mD, bf, ey, aA, aM); #c1(GCH1) c2(NP_001019195) c3(4375) c4(30489, 43546, 56603, 17432, 69660) c5(dx, akC, lb, hT, bf, dN, de, bAw, ajs, cA, WA, bAx, H, aNU, bAt, If, ey, bj, yv, aWX, mR, bL, b, dv, aTt, zo, sG, ak, bAr, bAv, eE, vu, Gs, aO, dj, bfi, Wy, zb, adf, bAq, be, bAs, Wi, cV, aC, bK, du, cz, dt, P, PL, bAu, aeV, re, di, Wz, aib, aM, DY, qt, Ww, xM, aDd, SJ, hn, aXb, bAo, pi, HV, n/v, bM, yA, at, bAp, ap); #c1(GCHFR) c2(NP_005249) c3(4376) c4(30490, 43547, 56604, 17433, 69661) c5(lc, eZ, Xd, fr, Pv, iL, xw, iy, m, aX, k, aE, o, adf, ae, cV, bK, v, ft, bb, cz, hT, bM, Xe); #c1(GC) c2(NP_000574) c3(4377) c4(30491, 43548, 56605, 17434, 69662) c5(QU, fh, A, fl, b, aPm, dB, fN, ey, i, jD, aeP, yU, nl, O, bf, al, bj, U, y, cp, hi, jT, aX, Iz, ag, qc, f, q, aG, dl, dQ, B, cs, fB, wu, mm, aV, u, aE, o, bk, Ps, vR, V, I, aC, yL, be, yO, bp, ad, P, xO, bh, aDA, cy, fx, cz, dL, qe, aM, at, aZS, iy, aY, ch, Bu, DD, ih, sG, fP, iu, tl, awi, I, di, aA, IA, eG, rn, oT); #c1(GCK) c2(NP_000153) c3(4378) c4(30492, 43549, 56606, 17435, 69663) c5(dx, gK, mv, bAy, bAk, mz, mC, dM, di, bw, bAz, bf, ey, Hi, bAA, BQ, m, qs, yE, et, mI, f, q, aQd, aE, yW, bm, bze, o, em, fd, I, ado, aC, yL, du, Fp, dt, akw, eX, gA, gF, dL, aM, wU, Y, ch, mB, cf, mA, xU, ag, mx, fD, fN, mD, aA, at); #c1(GCKR) c2(NP_001477) c3(4379) c4(30493, 43550, 56607, 17436, 69664) c5(bP, nX, td, bAk, dx, bf, ey, aO, bb, rh, dL, eX, nH, I, du, dK, P, bq, et, aM, jH, fN, mA, ag, fP, fD, mD, aA, at, ap); #c1(GCLC) c2(NP_001489) c3(4380) c4(30494, 43551, 56608, 17437, 69665) c5(dx, A, vk, b, k, X, iP, HG, w, di, U, ha, Vn, y, co, bb, ag, h, f, q, ar, B, cs, bzq, av, fy, u, aE, fU, hW, V, cV, aC, bAC, ht, J, bp, ad, I, fO, aZ, bq, x, cy, gx, bAB, du, art, Y, bm, cf, gd, oi, bk, fD, sc, aU, at, anE, ap); #c1(GCM1) c2(NP_003634) c3(4381) c4(30495, 43552, 56609, 17438, 69666) c5(fl, sH, HC, gA, di, II, od, eQ, o, ap); #c1(GCM2) c2(XP_011513293) c3(4382) c4(30496, 43553, 56610, 17439, 69667) c5(vR, b, jF, LG, azo, W, HC, bAD, Pm, wR); #c1(GCNIL1) c2(NP_006827) c3(4383) c4(30497, 43554, 56611, 17440, 69668) c5(pB, dB, jR); #c1(GCNT1) c2(XP_006717115) c3(4384) c4(30498, 43555, 56612, 17441, 69669) c5(oy, co, aw, V, ch, B, q, ar, ag, A, T, cs, bw, di, U, Lt); #c1(GCNT2) c2(NP_001482) c3(4385) c4(30499, 43556, 56613, 17442, 69670) c5(dx, ml, pV, bAI, ig, sE, iU, VG, aHc, sJ, w, bV, aCP, baB, aw, yi, pz, e, O, wo, dv, cy, b, kJ, Mu, mR, Lt, aO, Cp, cq, bze, g, Ad, aUM, nW, du, aB, gm, aAe, dB, Lz, Ce, Lb, PZ, fx, jT, pq, AL, xO, aZS, Ty, bAQ, arA, bY, os, ag, NU, pv, bk, i, aC, bq, qD, bT, rn, aln, aWj, Zm, fl, gE, fO, bid, aHb, asL, jz, eu, oH, mk, fU, vp, et, O, Co, io, y, bxm, ed, co, fm, yE, amo, f, cs, bAP, bu, VF, aFL, B, Eh, iv, av, fy, bm, iT, is, if, be, Gl, V, ae, bAD, Fp, cd, IR, bpC, bnH, bAH, bt, bAL, wA, gC, aRS, fJ, fr, JY, en, W, pk, wu, wp, yN, dP, kU, jR, xe, fG, tl, Im, WS, iu, ci, nl, bol, bAK, am, Y, apC, qz, m, A, jC, jD, aD, d, jh, wZ, btg, aiT, mZ, re, nU, q, es, bAN, ar, jG, aM, u, aE, wY, kF, I, im, ir, LR, j, ad, IX, aFj, Ca, fH, bAG, oV, et, px, jH, DY, anG, hS, hT, bAF, iq, na, IS, Bm, xX, CV, bp, bL, bAE, SR, bf, k, nX, iC, XI, amt, UX, jc, di, iL, eM, zK, al, Bz, hP, jw, jQ, YT, bAJ, abe, il, sG, fq, h, F, do, bAM, ik, n, cB, qB, sV, aV, jZ, Yb, ax, ap, cV, Xn, atl, J, fl, dt, P, hl, T, II, ji, aX, by, qT, eJ, eN, QN, ID, zl, QJ, gu, fP, Yv, iB, Ez, X, at, ja); #c1(GCNT3) c2(NP_004742) c3(4386) c4(30500, 43557, 56614, 17443, 69671) c5(V, b, ad, ag, cs, x, U); #c1(GCNT7) c2(NP_542182) c3(4387) c4(30501, 43558, 56615, 17444, 69672) c5(ag, U, V); #c1(GCOM1) c2(NP_001018100) c3(4388) c4(30502, 43559, 56616, 17445, 69673) c5(f, A, B, at); #c1(GCSAM) c2(NP_001177188) c3(4389) c4(30503, 43560, 56617, 17446, 69674) c5(Ut, dB, w, iG, iC, cA, e, O, d, ak, q, fp, dQ, cs, fH, dj, fs, gm, LG, jT, fJ, fl, aT); #c1(GCSAML) c2(NP_001268764) c3(4390) c4(30504, 43561, 56618, 17447, 69675) c5(Eo); #c1(GCSH) c2(NP_004474) c3(4391) c4(30505, 43562, 56619, 17448, 69676) c5(aC, Vn, jT, bAR); #c1(GDA) c2(NP_001229434) c3(4392) c4(30506, 43563, 56620, 17449, 69677) c5(ao, Ag, bAS, T, Af); #c1(GDAP1) c2(NP_001035808) c3(4393) c4(30507, 43564, 56621, 17450, 69678) c5(cG, qZ, bAV, cN, f, nv, bhn, JP, cV, aC, v, aoo, ac, RO, PL, kW, Y, bAT, bxo, bAU, bq, bAW); #c1(GDE1) c2(NP_057725) c3(4394) c4(30508, 43565, 56622, 17451, 69679) c5(GD, A, aw, cT, b, X, aF, pR, oi, axq, O, e, y, d, aoR, B, q, bu, fr, ar, rR, av, fy, u, n, if, xE, V, nl, J, xF, ft, pF, fO, by, pi, jH, pp, bm, yE, gA, gR, ci); #c1(GDF10) c2(NP_004953) c3(4395) c4(30509, 43566, 56623, 17452, 69680) c5(co, iP, b, ra, qL, f, bp, ft, fr, G, fy, bq, Oi, at, u, fs); #c1(GDF11) c2(XP_006719257) c3(4396) c4(30510, 43567, 56624, 17453, 69681) c5(LB, O, LA, V, b); #c1(GDF15) c2(NP_004855) c3(4397) c4(30511, 43568, 56625, 17454, 69682) c5(dx, B, aw, Ob, w, cO, bf, e, O, dv, dN, kT, wY, g, aC, yL, du, yO, bp, fx, Yp, pP, ag, i, bg, aA, id, cY, bw, U, Co, y, co, f, LI, bu, cs, av, fy, bm, iT, V, IR, aR, Qt, Fr, kU, aUZ, ji, ap, b, aw, axg, d, bb, re, hV, q, X, u, dh, o, I, Mi, ad, IX, nV, Ck, IS, I, A, qd, di, gE, hP, ajb, qs, aX, F, tF, pN, Fs, W, T, by, aM, hq, at); #c1(GDF1) c2(NP_001483) c3(4398) c4(30512, 43569, 56626, 17455, 69683) c5(co, cr, cT, bwl, ck, Cj, bAX, hV, aLq, mx, nV, tl, Lv, u, aLv, y, zD); #c1(GDF2) c2(NP_057288) c3(4399) c4(30513, 43570, 56627, 17456, 69684) c5(oy, A, hW, ag, X, B, q, xd, Cr, fr, Cz, bh, av, ft, u, dh, y, bAY); #c1(GDF3) c2(NP_065685) c3(4400) c4(30514, 43571, 56628, 17457, 69685) c5(wV, bBd, I, Lx, bAZ, bBa, wy, bBc, wP, Lo, T, y, HE, Lr, aA, u, bBb, kH); #c1(GDF5) c2(NP_001306067) c3(4401) c4(30515, 43572, 56629, 17458, 69686) c5(aDX, sm, VY, bBh, Ak, rF, aeC, y, atj, bBi, fy, u, QM, bBj, aC, aDY, bBe, bBf, atF, btp, bBk, ID, bBl, bBg); #c1(GDF6) c2(NP_001001557) c3(4402) c4(30516, 43573, 56630, 17459, 69687) c5(kH, bBd, bBn, bBo, bAZ, Nq, bBc, ea, Ns, Nx, aW, nR, kD, bBm, kg); #c1(GDF7) c2(NP_878248) c3(4403) c4(30517, 43574, 56631, 17460, 69688) c5(do); #c1(GDF9) c2(XP_011541610) c3(4404) c4(30518, 43575, 56632, 17461, 69689) c5(A, kF, wp, b, UJ, aTZ, B, qi, bQ, Ca, asT, jw, Ap, u); #c1(GD11) c2(NP_001484) c3(4405) c4(30519, 43576, 56633, 17462, 69690) c5(bBq, f, IZ, X, nz, nU, PY, bBp, Bj); #c1(GD12) c2(NP_001108628) c3(4406) c4(30520, 43577, 56634, 17463, 69691) c5(nU, aq, f, T, jh); #c1(GDNF) c2(NP_001177397) c3(4407) c4(30521, 43578, 56635, 17464, 69692) c5(ml, alz, EM, w, dd, bf, O, bBs, xl, fp, do, zb, cc, g, fe, aC, aQw, wV, MO, ahO, cV, jT, OA, vz, f, KN, DD, ag, dc, aiS, Jy, cY, ahS, wy, dV, bw, U, cM, tp, co, ak, dZ, B, cs, av, fy, yJ, GS, V, v, Qz, aY, PY, fw, ck, kE, b, jq, ahP, dk, A, ic, aiR, ey, bb, hV, es, X, Km, Gj, u, dh, o, jz, ad, xq, bBr, ao, nV, bBt, hX, hT, ih, wP, aMp, fl, OP, FY, QU, de, Qv, IO, k, ds, wf, bj, jx, aX, h, F, oE, y, sV, jQ, si, nQ, afx, sB, Fs, II, hW, ac, aM, qp, Y, aAx, adu, HM, sf, at, iE); #c1(GDPD3) c2(NP_077283) c3(4408) c4(30522, 43579, 56636, 17465, 69693) c5(ep); #c1(GDPD5) c2(NP_110419) c3(4409) c4(30523, 43580, 56637, 17466, 69694) c5(u, y, b, cV); #c1(GEM) c2(NP_859053) c3(4410) c4(30524, 43581, 56638, 17467, 69695) c5(afE, aw, b, fO, ig, eM, iU, mW, mk, bBu, ix, iL, bf, JH, al, xe, G, aYA, aW, m, co, aX, ae, yX, sG, t, h, q, vQ, M, gX, aFL, y, jG, aV, u, gl, n, I, aC, aXd, HQ, nl, dB, J, j, gv, dt, pr, axl, aE, II, bh, jC, cz, anf, aMw, aM, jT, ale, fc, pP, Jh, P, jZ, gA, Bm, Xf, Im, aA, gE, fR); #c1(GEMIN2) c2(NP_001009182) c3(4411) c4(30525, 43582, 56639, 17468, 69696) c5(b, ahS, dB, ix, iG, e, O, d, F, q, bu, kz, cs, av, fy, bm, im, by, P, ahO, T, ad, OA, ao, Tu, ag, aAp); #c1(GEMIN4) c2(NP_056536) c3(4412) c4(30526, 43583, 56640, 17469, 69697) c5(ny, b, dB, alV, y, bS, jh, aX, ip, re, f, q, kz, ik, ff, oD, u, o, jE, il, v, KL, T, iD, fx, ao, BX, bm, iT, i); #c1(GEMIN6) c2(NP_079051) c3(4413) c4(30527, 43584, 56641, 17470, 69698) c5(0A, kz); #c1(GEN1) c2(NP_872431) c3(4414) c4(30528, 43585, 56642, 17471, 69699) c5(g, A, b, X, B, O, av, u, y); #c1(GET4) c2(NP_057033) c3(4415) c4(30529, 43586, 56643, 17472, 69700) c5(ac); #c1(GFAP) c2(NP_001124491) c3(4416) c4(30530, 43587, 56644, 17473, 69701) c5(f, Ob, BF, EM, aN, w, ku, bf, aK, e, O, jR, tX, Pn, mR, Qx, g, p, Ij, Lw, Hr, HR, fc, mE, we, qP, bq, aaA, aaL, hS, dV, ai, xw, arW, cM, rc, mI, ak, amg, dZ, ky, oD, OA, apK, iF, auP, cJ, bBw, v, kp, aEP, hw, buB, er, PY, dY, oj, aBF, aG, b, jq, bBv, bg, aiR, ey, aGX, jy, d, jd, q, DC, pB, u, dh, o, fh, fs, qC, acv, KL, xj, vS, sf, aeC, Ut, ao, kB, hT, aE, kC, fl, aJR, acE, k, fr, gw, HJ, ds, fw, iL, bj, asN, aWu, LI, Tq, bqT, tF, y, bK, kD, Kw, aV, aq, HI, dj, hW, nQ, GS, Fs, Ix, P, ac, aM, eJ, adb, sp); #c1(GFER) c2(NP_005253) c3(4417) c4(30531, 43588, 56645, 17474, 69702) c5(gE, b, aF, bBx, LM, iL, z, wf, bf, O, kW, t, f, q, oD, bm, dh, gG, gv, G, T, ac, aM, aH, Lc, gs, aE, yy, na, bBy, bh); #c1(GFIIB) c2(NP_001128503) c3(4418) c4(30532, 43589, 56646, 17475, 69703) c5(jK, jT, b, h, jR, bBz, G, n, jG, eN, pz); #c1(GFII) c2(XP_011539548) c3(4419) c4(30533, 43590, 56647, 17476, 69704) c5(A, kV, bBA, blD, co, t, aoM, B, aKt, hN, n, aV, bm, fU, J, fO, P, T, jT, iw, ci, bBB, ie, G, jR, h, zM, ael, aXD); #c1(GFM1) c2(NP_079272) c3(4420) c4(30534, 43591, 56648, 17477, 69705) c5(ake, hT, kW, bBC, sE, bBD, u, y); #c1(GFPT1) c2(NP_001231639) c3(4421) c4(30535, 43592, 56649, 17478, 69706) c5(g, xQ, gF, afE, I, ch, bBE, BQ, eH, ag, bw, bf, bBF, aCT, et, aA, aM); #c1(GFPT2) c2(NP_005101) c3(4422) c4(30536, 43593, 56650, 17479, 69707) c5(bq, bj, I, gO); #c1(GFRA1) c2(NP_001138925) c3(4423) c4(30537, 43594, 56651, 17480, 69708) c5(QU, lb, Ev, ahS, KN, dV, gE, Lr, y, sf, aX, hV, g, dZ, O, sV, OA, u, dh, fh, vR, MO, nV, bb, nP, ac, ao, qp, vz, Y, bm, FI, HM, ag, ahO, HV); #c1(GFRA2) c2(NP_001158511) c3(4424) c4(30538, 43595, 56652, 17481, 69709) c5(de, Y, hV, ahS, HM, ag, ahO, bBG, HV, o); #c1(GFRA3) c2(NP_001487) c3(4425) c4(30539, 43596, 56653, 17482, 69710) c5(hV, fD, fy, y, MO); #c1(GFRA4) c2(NP_071422) c3(4426) c4(30540, 43597, 56654, 17483, 69711) c5(bxC, cy, ahO, ahS); #c1(GGA1) c2(NP_001001560) c3(4427) c4(30541, 43598, 56655, 17484, 69712) c5(0); #c1(GGA3) c2(NP_001166175) c3(4428) c4(30542, 43599, 56656, 17485, 69713) c5(o, fh); #c1(GGACT) c2(NP_149101) c3(4429) c4(30543, 43600, 56657, 17486, 69714) c5(cy); #c1(GGCT) c2(NP_001186744) c3(4430) c4(30544, 43601, 56658, 17487, 69715) c5(jp, fr, A, b, LD, Lv, oH, wn, ck, Fh, aJj, y, m, co, am, B, F, bu, X, ar, cl, iJ, av, u, iF, qw, el, be, J, afn, cz, W, CM, P, KK, T, j, rT, by, ft, rQ, aaf, bm, qJ, yy, fl, bp); #c1(GGCX) c2(NP_000812) c3(4431) c4(30545, 43602, 56659, 17488, 69716) c5(dx, A, bb, bBI, aaP, bpR, du, dr, eN, bqE, bBH, aOo); #c1(6611) c2(NP_003869) c3(4432) c4(30546, 43603, 56660, 17489, 69717) c5(IJ, IH, b, w, O, e, y, d, t, re, q, dl, ar, bm, iT, da, fs, V, aC, J, G, T, dH, jH, qp, u, i, I, ap); #c1(GGNBP2) c2(NP_079111) c3(4433) c4(30547, 43604, 56661, 17490, 69718) c5(T, rR, b, cV); #c1(GGN) c2(NP_689870) c3(4434) c4(30548, 43605, 56662, 17491, 69719) c5(cU, A, am, b, iR, afj, afh, yy, PS, B, Lv, iA, PH, u, aA, y, eX); #c1(GGPS1) c2(NP_001032354) c3(4435) c4(30549, 43606, 56663, 17492, 69720) c5(jE, aw, V, q, gv, bh, U, bm, gF); #c1 (GGT1) c2(NP_038347) c3(4436) c4(30550, 43607, 56664, 17493, 69721) c5(aw, eH, bV, bf, e, vr, t, gB, bw, mz, og, fO, aJT, jT, dL, qt, akn, fc, pP, Nv, ag, fD, fN, bq, aA, Dr, X, Ck, act, U, co, fC, amo, eX, bv, fy, bm, EX, qw, ae, aZz, gv, MW, bt, rT, bBJ, aJX, aoy, iY, wj, b, aPK, asY, bBK, z, bns, d, Ag, kW, jd, nU, q, ar, jG, bzf, VD, G, et, wV, aOO, ch, tW, aoA, aE, wP, rv, yA, kK, A, di, gE, al, vl, iK, m, aX, h, cU, n, aV, J, T, cr, Pk, aM, Af, bh, alX, rb); #c1(GGT2) c2(XP_011528923) c3(4437) c4(30551, 43608, 56665, 17494, 69722) c5(A, aw, b, gE, eH, wj, bBK, bw, bf, vl, al, iK, vr, co, kW, wP, t, h, gB, q, cU, jT, bv, fy, bm, og, fC, m, aZz, gv, G, T, bt, rT, aJT, Pk, dL, aM, wV, akn, U, fN, Nv, ag, bh, yA, rb); #c1(GGT5) c2(NP_001093251) c3(4438) c4(30552, 43609, 56666, 17495, 69723) c5(bm, q, bp); #c1(GGTLC1) c2(XP_005260922) c3(4439) c4(30553, 43610, 56667, 17496, 69724) c5(gB, aFq, au, di, z, ha, aK, vr, B, q, bjP, bv, bBM, aOS, gD, m, P, bt, dL, iw, bm, aeg, gu, bBL, fN); #c1(6111) c2(NP_000506) c3(4440) c4(30554, 43611, 56668, 17497, 69725) c5(dx, gK, dM, aw, IA, avW, EM, eH, ck, hM, adt, cO, bf, xl, gO, jl, dv, uT, rh, HR, bba, DB, axd, bBT, mR, Dd, tU, bBP, cc, mz, vO, agQ, vN, nz, du, asM, ft, Jj, Bd, fx, dL, DA, cq, pb, wh, aYZ, fN, bdB, yE, xr, i, mD, aA, bnp, bP, jS, el, X, Dv, aic, wy, rd, ali, W, fH, DV, bw, U, cC, y, bBS, na, mI, f, bBW, bmi, av, cp, bm, wP, iF, bBN, bBR, V, QQ, qq, kp, gv, zi, eX, rT, iA, pi, fJ, ahT, dt, Fu, cf, P, B, uK, bBU, ahO, UT, fD, ap, aDX, b, qz, z, avX, ey, gF, Me, bb, Ox, q, fr, pn, ar, kg, Km, qT, u, aE, o, da, kF, I, Fb, wV, cz, xk, IG, aoT, Fk, asG, avF, et, nc, jU, US, nV, aVI, acw, ON, Ck, mA, eo, bBQ, bO, rv, bq, aX, biS, A, bBV, zF, gw, pD, rU, di, asl, wf, GT, S, wp, ty, XQ, aml, blh, cU, aC, ik, oJ, kD, PT, ZU, aq, Ry, aXH, si, adh, me, vF, aDY, aXN, T, HK, bBO, are, aM, rM, eJ, acK, AR, fP, Af, bh, aT, amL, eG); #c1(6112) c2(NP_002050) c3(4441) c4(30555, 43612, 56669, 17498, 69726) c5(ck, b, Lv, wy, eX, Me, ar, ik, sH, iF, ali, I, yL, W, bkt, od, jT, wV, mA, wP, T, aA); #c1(GHITM) c2(NP_055209) c3(4442) c4(30556, 43613, 56670, 17499, 69727) c5(BX, ny, ip); #c1(GHRH) c2(XP_011527089) c3(4443) c4(30557, 43614, 56671, 17500, 69728) c5(EO, bP, A, adt, b, X, dB, vB, w, bBY, kY, OV, bw, jw, e, y, cp, d, co, cy, ak, el, bu, cU, ar, B, hb, Km, av, fy, u, Ry, o, iF, fU, kF, aqQ, Be, Fh, qq, gm, by, W, T, avF, iA, pq, bBX, qp, EZ, ym, OW, pO, cf, TE, ih, yE, Yv, OU, aA, rv, eG); #c1(GHR) c2(NP_001229328) c3(4444) c4(30558, 43615, 56672, 17501, 69729) c5(gK, eX, bf, cp, rh, jS, mz, bp, ft, asH, FW, hR, FG, wh, gs, fQ, yE, xr, i, aA, avX, dE, eu, OV, asl, U, y, bBZ, B, bu, cc, av, bm, iT, iF, V, aoz, gv, aDY, auK, py, aaf, rl, ap, aDX, dt, b, aF, eR, z, jh, bb, jd, q, ar, aRY, Km, u, aE, o, wp, atr, by, aoT, asG, et, bCa, VQ, aJA, ch, kM, he, cC, bBQ, rv, I, Mp, OS, adq, A, fr, gw, di, hP, m, aX, I, jk, oJ, Ry, aMH, adh, bBR, W, T, jl, cz, ac, aM, zl, bh, at); #c1(GHRHR) c2(NP_000814) c3(4445) c4(30559, 43616, 56673, 17502, 69730) c5(dx, A, b, fr, jj, hM, kY, OV, asl, y, cp, dv, aX, ip, B, PR, cU, ar, Km, PT, u, Ry, o, iF, vR, du, W, T, Jj, ny, bBO, BX, yE, eG, bBW); #c1(GHRL) c2(NP_001128416) c3(4446) c4(30560, 43617, 56674, 17503, 69731) c5(bP, dx, hV, b, mz, fN, aqu, jJ, OS, rd, ig, Gr, dd, HS, cD, bf, A, gF, bq, aqQ, bQ, cy, si, eA, rh, f, bu, aC, bh, ik, B, yE, Km, ar, kN, u, bn, bx, sz, ma, kF, V, I, jH, vN, du, cx, gL, by, W, eX, vM, x, jl, nP, hR, fM, aM, wR, qp, py, aY, aos, fD, OW, mA, aaf, Yv, dc, rv, di, aA, at, bp, bT, jU, ap); #c1(GHSR) c2(NP_004113) c3(4447) c4(30561, 43618, 56675, 17504, 69732) c5(dx, A, b, aeB, jj, jJ, ck, di, cO, bf, iF, hP, ca, y, cp, co, yE, ml, hV, cU, B, fy, u, agQ, g, sz, V, I, bCc, aC, du, bp, W, dv, T, eX, vM, iA, aM, xg, jH, qp, mz, OW, aaf, aos, bCb, OV, bBQ, fP, rv, bq, aA, at); #c1(GID8) c2(NP_060366) c3(4448) c4(30562, 43619, 56676, 17505, 69733) c5(bu); #c1(GIF) c2(NP_005133) c3(4449) c4(30563, 43620, 56677, 17506, 69734) c5(EO, avO, gE, bx, aiV, eM, aMr, mW, sJ, Ku, cO, bf, al, fD, rN, m, co, cy, bCe, qj, mT, aM, gl, V, bzB, aC, be, P, T, aSB, Ny, cK, fx, Vd, bCd, nh, kx, aEL, mS, bP, i, fR, aZo); #c1(GIGYF1) c2(XP_005250589) c3(4450) c4(30564, 43621, 56678, 17507, 69735) c5(pk, u, y, cO); #c1(GIGYF2) c2(NP_001096616) c3(4451) c4(30565, 43622, 56679, 17508, 69736) c5(bj, u, bCf, y); #c1(GIMAP5) c2(NP_060854) c3(4452) c4(30566, 43623, 56680, 17509, 69737) c5(m, b, aC, aE, Dc, bf, gl, aM); #c1(GIMAP7) c2(NP_694968) c3(4453) c4(30567, 43624, 56681, 17510, 69738) c5(aE, Dc); #c1(GIMAP8) c2(XP_005250007) c3(4454) c4(30568, 43625, 56682, 17511, 69739) c5(A); #c1(GIN1) c2(NP_060146) c3(4455) c4(30569, 43626, 56683, 17512, 69740) c5(aC); #c1 (GINSI) c2(NP_066545) c3(4456) c4(30570, 43627, 56684, 17513, 69741) c5(fl, b, re, f, iT, nl, cs, u, y); #c1(GINS2) c2(NP_057179) c3(4457) c4(30571, 43628, 56685, 17514, 69742) c5(b, nl, ig, rb, oM, pt, u, y); #c1(GIPC1) c2(NP_005707) c3(4458) c4(30572, 43629, 56686, 17515, 69743) c5(A, aw, V, b, X, B, ag, jo, fv, ff, bw, bf, av, pp, u, U, y, aM); #c1(GIPC3) c2(NP_573568) c3(4459) c4(30573, 43630, 56687, 17516, 69744) c5(alH, bCg, bCh, dZ, dV, Bx, u); #c1(GIP) c2(NP_004114) c3(4460) c4(30574, 43631, 56688, 17517, 69745) c5(dx, eX, aN, hM, z, bf, ey, aK, dv, jk, f, Jq, ar, avP, em, vR, I, aoz, vN, du, gJ, W, Hq, gF, dL, fM, aM, qp, ch, mA, fN, mD, aA, Ah, ap); #c1(GIPR) c2(NP_000155) c3(4461) c4(30575, 43632, 56689, 17518, 69746) c5(mz, qp, I, b, dA, rh, ch, Hq, eX, Jq, vN, vR, jj, aA, jk, fy, tU, aV, ey, ap); #c1(GIT1) c2(NP_001078923) c3(4462) c4(30576, 43633, 56690, 17519, 69747) c5(iU, qs, A, aX, V, b, bj, B, cs, ad, do, iT, y, cO, si, U, u, av, oN); #c1(GIT2) c2(NP_001128685) c3(4463) c4(30577, 43634, 56691, 17520, 69748) c5(aF, iU, bf, aox, aM); #c1(GJA1) c2(NP_000156) c3(4464) c4(30578, 43635, 56692, 17521, 69749) c5(avO, Qd, by, ml, aw, wN, biF, w, ak, dx, cO, e, O, dv, iy, acL, kJ, bCI, wv, dl, mR, jM, g, bCi, du, bp, ft, fx, hR, wh, Lz, f, ag, Fi, i, bq, aA, alH, cY, iP, Ak, hS, IW, U, cM, SV, co, Qc, pp, hg, Ns, bu, B, cs, fy, bm, V, Bs, bCk, fl, bav, cK, pi, aJX, arJ, er, jR, bCj, re, b, uC, q, wn, bCm, ic, d, Fp, bb, jd, cn, k, bCn, arm, X, OC, mL, ar, u, dh, fh, il, sX, Jt, UG, ad, BZ, Mw, DP, wV, acw, ch, wP, kC, aDa, Bx, vZ, acq, y, bbN, A, qd, fr, ate, xj, BY, di, brA, sx, aX, I, h, ox, iZ, ik, oJ, sV, sB, W, P, T, II, bed, cr, cz, fM, sK, bgV, eB, eG, ja, gl); #c1(GJA3) c2(NP_068773) c3(4465) c4(30579, 43636, 56693, 17522, 69750) c5(an, u, aru, bel, cB, as, bCe, kD, y); #c1(GJA8) c2(XP_011507719) c3(4466) c4(30580, 43637, 56694, 17523, 69751) c5(A, aPw, b, X, iP, Id, hS, U, y, jr, aX, amo, h, B, q, ar, aW, as, av, u, fi, cV, an, aru, jG, aWN, fO, dt, G, T, Qt, aWF, pk, mk, hX, eo, ag, tl, bCp, kD); #c1(GJB1) c2(NP_000157) c3(4467) c4(30581, 43638, 56695, 17524, 69752) c5(aeK, aFY, aw, b, cG, bid, dB, IM, A, W, rj, ch, kV, O, pp, ed, co, cN, ag, bCs, f, q, bu, dl, X, zm, bCr, B, as, ar, aV, bm, ov, ff, bhn, qZ, an, nl, el, bp, by, dt, jo, mX, T, aoo, ac, bgD, xV, PL, Lz, gt, Y, fc, amJ, ex, na, ahe, ji, dR, bCq); #c1(GJB2) c2(NP_003995) c3(4468) c4(30582, 43639, 56696, 17525, 69753) c5(aw, bCA, Zy, IM, JH, aNa, aTh, xl, awU, XE, e, dl, bCJ, bCC, bCE, g, aRh, sH, Dt, bp, Lz, bCv, fx, aPg, ata, aQT, tO, bCH, bk, i, bq, alH, cG, X, eu, Kc, mk, bCB, bCz, bw, U, arW, y, aed, akh, bCw, ale, B, bu, dZ, bm, bCt, bCF, V, fl, bnH, HO, rV, iA, gt, bCD, iV, xe, Cy, dR, b, ag, ic, d, jh, jd, cn, bCK, q, qu, u, da, il, as, wL, Lk, rB, bvg, ch, na, Bx, dV, KC, A, bCu, In, bCy, ow, bbE, aX, or, ik, pN, aq, aGI, an, W, co, T, bCI, ip, bCG, bCx, bgo); #c1(GJB6) c2(NP_001103691) c3(4469) c4(30583, 43640, 56697, 17526, 69754) c5(alH, bjF, Kc, mk, bCy, vZ, dV, cO, cM, aed, or, ip, AG, cn, bCO, bch, bCC, xl, bCt, bCM, awS, SV, bod, bCN, dZ, aPg, ata, dk, ch, bmt, bCL, bCx, na, dh, Bx, bgo, ow); #c1(GJC1) c2(NP_001073852) c3(4470) c4(30584, 43641, 56698, 17527, 69755) c5(V, iP, xj, W, di, U, u, aA, y); #c1(GJC2) c2(NP_065168) c3(4471) c4(30585, 43642, 56699, 17528, 69756) c5(Qd, f, Qc, NV, mZ, cJ, fc, KU, bCQ, aV, bN, bCR, bel, PL, IK, VJ, bCP, u, y); #c1(GJC3) c2(NP_853516) c3(4472) c4(30586, 43643, 56700, 17529, 69757) c5(na, Cd, ac, Bx); #c1(GJD2) c2(NP_065711) c3(4473) c4(30587, 43644, 56701, 17530, 69758) c5(A, b, I, bmt, Bt, dZ, dV, jr, Bu); #c1(GJD3) c2(NP_689343) c3(4474) c4(30588, 43645, 56702, 17531, 69759) c5(W, ch, V, Cd); #c1(GK) c2(NP_000158) c3(4475) c4(30589, 43646, 56703, 17532, 69760) c5(bgu, c, nU, I, ni, f, q, bgp, bCS, UT, bzm, bf, aA, at, bm, xl); #c1(GKN1) c2(NP_062563) c3(4476) c4(30590, 43647, 56704, 17533, 69761) c5(b, cV, re, KL, gL, bu, W, T, iT, bt, ar, od, by, u, y); #c1(GKN2) c2(NP_872342) c3(4477) c4(30591, 43648, 56705, 17534, 69762) c5(A, b, B, bp, bu, ar, by); #c1(GLA) c2(NP_000160) c3(4478) c4(30592, 43649, 56706, 17535, 69763) c5(bP, asL, en, dN, LF, di, iC, aO, bb, bdH, ni, as, em, eg, an, LG, asM, dt, aZ, cK, bCU, et, sK, dy, bCT, er, iV, bCV, fD, aOB); #c1(GLB1) c2(NP_000395) c3(4479) c4(30593, 43650, 56707, 17536, 69764) c5(B, aeB, arF, dB, eH, sJ, w, cO, e, fx, O, cp, cy, t, zP, bCZ, bty, aYX, Hs, n, eg, aC, gm, fO, vc, od, bCX, jT, dL, av, Ip, fN, ie, QI, cT, i, ry, aA, wz, bT, X, aYW, jz, kB, adp, iG, bw, U, cM, bCY, co, pp, rr, f, IN, bu, ky, cc, cs, gg, bm, jB, V, ae, v, LG, alf, bzh, bfg, aYY, bDe, P, nJ, aNw, ci, aeK, DB, b, Lq, aMh, azn, gF, d, AY, hV, q, jV, dQ, ar, jG, u, dh, fs, I, j, ad, G, lo, aAA, jU, jH, aMi, Eu, bzo, xU, fl, QP, cK, aAZ, A, qd, fr, bDa, di, fw, iL, iC, Ic, qs, aX, bCW, ni, fq, h, bDb, M, jQ, y, cB, jx, Yb, Ps, aYh, cV, be, J, dt, jo, bDc, T, II, cr, nP, by, rM, Lc, Jh, hq, fP, E, bDd, iE); #c1(GLCCI1) c2(NP_612435) c3(4480) c4(30594, 43651, 56708, 17537, 69765) c5(er, cy, cV); #c1(GLCE) c2(XP_005254355) c3(4481) c4(30595, 43652, 56709, 17538, 69766) c5(A, b, B, fU, co, u, y); #c1(GLDC) c2(NP_000161) c3(4482) c4(30596, 43653, 56710, 17539, 69767) c5(jT, co, b, bAR, aC, nU, xJ, nJ, aZs, ey, fy, Vn); #c1(GLDN) c2(NP_861454) c3(4483) c4(30597, 43654, 56711, 17540, 69768) c5(zm, bm, q, b, anB); #c1(GLE1) c2(NP_001003722) c3(4484) c4(30598, 43655, 56712, 17541, 69769) c5(bDf, bnv); #c1(GLG1) c2(NP_001139138) c3(4485) c4(30599, 43656, 56713, 17542, 69770) c5(g, by, u, b, k); #c1(GLI1) c2(NP_001161081) c3(4486) c4(30600, 43657, 56714, 17543, 69771) c5(aw, sJ, w, e, O, kJ, kB, cl, zW, R, g, aeM, fO, ft, fx, fp, jE, bm, ag, cT, i, axg, cY, oa, ig, kY, bw, U, y, co, B, bu, cs, av, fy, bDg, iT, is, jB, V, auw, iA, YU, qW, py, QG, nJ, tl, b, oi, ic, AI, fD, d, re, q, jV, es, X, ar, ac, fv, iR, il, qL, by, jU, jH, mk, acw, u, IW, aiJ, QP, A, alg, fr, pD, jc, jR, iL, iK, MT, aX, h, F, cU, ik, oJ, gg, fM, aV, fU, hW, cV, QV, bDh, W, QI, T, ad, iG, fP); #c1(GLI2) c2(NP_005261) c3(4487) c4(30601, 43658, 56715, 17544, 69772) c5(azt, bDk, by, A, aw, b, X, Ib, kB, ic, iG, ahU, e, y, d, acK, arl, pp, kJ, f, q, jV, bu, fr, B, hb, cs, fM, av, u, zW, o, cl, QD, dj, i, aeM, cV, qL, ft, bDj, gv, P, bBW, bh, x, aX, fx, ad, AP, YU, aPc, bDi, aai, iR, mb, BV, avX, ih, ag, tl, HV, Im, biS); #c1(GLI3) c2(XP_011513575) c3(4488) c4(30602, 43659, 56716, 17545, 69773) c5(fn, bDk, aua, td, alg, b, arB, agt, gE, eu, Ak, hS, bDI, di, jR, iL, cO, bDn, U, xw, A, y, wB, aoa, ahN, atj, G, aeT, fv, t, h, f, q, bu, M, ix, bDe, bkm, bDp, cs, Cp, u, dh, Yj, jB, Ph, V, dA, Al, fl, v, bDh, J, P, bxr, T, II, aUC, amR, x, ad, AP, Qx, avY, cq, bwH, bg, ao, aai, aVX, LY, fP, bDm, PY, Dj, zW, ag, k, w, j, tl, bq, Xi, ar); #c1(GLIPR1) c2(NP_006842) c3(4489) c4(30603, 43660, 56717, 17546, 69774) c5(g, fe, A, b, hX, B, w, fl, i, fx, O); #c1(GLIPR2) c2(NP_001273939) c3(4490) c4(30604, 43661, 56718, 17547, 69775) c5(oy, Hs, q, O); #c1(GLIS2) c2(NP_001305847) c3(4491) c4(30605, 43662, 56719, 17548, 69776) c5(bP, jK, aX, b, hf, bm, vU, q, J, VN, bDq, bDr, et, aEY, gO); #c1(GLIS3) c2(XP_006716794) c3(4492) c4(30606, 43663, 56720, 17549, 69777) c5(xc, aCg, I, Sc, mB, f, na, Nz, bDs, bf, et, aE, aM); #c1(GLMN) c2(XP_011538848) c3(4493) c4(30607, 43664, 56721, 17550, 69778) c5(aKI, bL, b, X, bDu, cs, U, aK, aKE, aHA, GW, q, YP, cB, bDt, ar, av, ov, IG, V, bDv, ad, W, P, Ce, T, agm, Kv, Oi, JJ, et, Yy, nd, asJ, aKB, Y, amj, kM, cT, aKG, aT); #c1(GLO1) c2(NP_006699) c3(4494) c4(30608, 43665, 56722, 17551, 69779) c5(dx, bL, by, A, td, b, dB, bw, bf, ey, kV, y, jh, dv, aX, Iz, si, IO, f, bu, M, O, cs, fH, aV, u, dh, o, wR, dj, afh, hW, I, du, v, J, jo, wX, eX, bd, ad, afj, fJ, aM, aE, ih, cz, fD, dc, zS, at, hz); #c1(GLUD4) c2(NP_057164) c3(4495) c4(30609, 43666, 56723, 17552, 69780) c5(bm, T, q); #c1(GLPIR) c2(NP_002053) c3(4496)

c4(30610, 43667, 56724, 17553, 69781) c5(dx, jz, di, bf, bw, ey, hP, jQ, dv, bb, f, hi, aE, V, I, cV, p, du, v, aM, qp, ch, vH, ag, fN, mD, aA, ap); #c1(GLP2R) c2(NP_004237) c3(4497) c4(30611, 43668, 56725, 17554, 69782) c5(jH, cs, jU, fM, ad); #c1(GLRA1) c2(NP_000162) c3(4498) c4(30612, 43669, 56726, 17555, 69783) c5(ec, Jl, fU, bb, IB, bK, aWR, aWt, bM, JE, If, bDw, DY, IV); #c1(GLRA2) c2(NP_001112357) c3(4499) c4(30613, 43670, 56727, 17556, 69784) c5(hS, o); #c1(GLRA3) c2(NP_001036008) c3(4500) c4(30614, 43671, 56728, 17557, 69785) c5(Eo, hS, cA, iZ); #c1(GLRB) c2(NP_001159532) c3(4501) c4(30615, 43672, 56729, 17558, 69786) c5(aLt, IK, IB, nU, aWR, bDw, IV); #c1(GLRX2) c2(NP_057150) c3(4502) c4(30616, 43673, 56730, 17559, 69787) c5(ck, bq, hR, dh, eX); #c1(GLRX3) c2(NP_006532) c3(4503) c4(30617, 43674, 56731, 17560, 69788) c5(co, bb, b, q, ad, fl, di, ff, cs, U, u, y); #c1(GLRX5) c2(NP_057501) c3(4504) c4(30618, 43675, 56732, 17561, 69789) c5(oy, avO, kU, bDx, sL, awS, oD, Vn, pq); #c1(GLRX) c2(NP_001230588) c3(4505) c4(30619, 43676, 56733, 17562, 69790) c5(oy, LS, OA, b, ch, sH, f, v, vZ, gA, di, aZ, Bs, aCP, sJ, aA); #c1(GLS2) c2(NP_037399) c3(4506) c4(30620, 43677, 56734, 17563, 69791) c5(mz, Xw, b, fi, aC, jq, k, Fs, q, mA, ad, hS, gA, w, cs, Lw, iZ, bm, O); #c1(GLS) c2(NP_001243239) c3(4507) c4(30621, 43678, 56735, 17564, 69792) c5(QU, bm, wj, b, aPm, aiW, axl, hS, w, Og, Fh, O, Oh, pz, ca, y, co, aX, t, h, q, ar, cM, iJ, fy, u, iF, qw, mD, aC, J, bp, gv, dt, P, T, bh, fx, ad, Ut, G, pP, Ck, eo, i, fq, aU); #c1(GLT1D1) c2(NP_653270) c3(4508) c4(30622, 43679, 56736, 17565, 69793) c5(T, u, bg); #c1(GLT6D1) c2(XP_011516939) c3(4509) c4(30623, 43680, 56737, 17566, 69794) c5(vl, TP); #c1(GLT8D1) c2(NP_001010983) c3(4510) c4(30624, 43681, 56738, 17567, 69795) c5(cA, hW); #c1(GLTSCR1) c2(XP_005258890) c3(4511) c4(30625, 43682, 56739, 17568, 69796) c5(g, jd, Fs, O, Qz); #c1(GLTSCR2) c2(NP_056525) c3(4512) c4(30626, 43683, 56740, 17569, 69797) c5(g, by, A, kF, b, k, aq, cV, Fs, q, v, Fo, w, od, ar, bu, u, O); #c1(GLUD1) c2(NP_005262) c3(4513) c4(30627, 43684, 56741, 17570, 69798) c5(ma, aZe, mp, aPm, aiz, bK, cf, yH, dY, bDy, hS, aWQ, iZ, Id, xM, gF, pP, fh); #c1 (GLUD2) c2(NP_036216) c3(4514) c4(30628, 43685, 56742, 17571, 69799) c5(bj); #c1(GLUL) c2(XP_006711341) c3(4515) c4(30629, 43686, 56743, 17572, 69800) c5(ak, hS, w, ku, wf, bf, xw, cM, bfJ, I, SQ, h, f, q, iZ, O, kN, iz, bws, aE, o, em, jB, bm, nQ, FR, bK, bp, cz, P, aFj, cA, hw, aM, Yz, Lz, gt, aY, IV, tW, ex, El, kC, bDz, dc, aA, rr); #c1(GLYAT) c2(NP_005829) c3(4516) c4(30630, 43687, 56744, 17573, 69801) c5(en, pV, jt, eW, bV, aw, VX, e, O, cy, nV, fe, pN, ZY, EC, ft, Ce, od, aJT, jT, fp, f, ag, mD, X, jz, oH, U, kV, y, co, px, ak, bu, aMN, B, cs, av, fy, bm, iT, iF, jB, V, ae, afj, Jc, eX, aMQ, P, jR, Ri, hV, b, eY, Lq, d, re, nU, q, es, ra, pn, dQ, pB, ar, u, aE, Kx, I, gL, Dg, ad, rw, HE, bDA, an, KK, Ck, Dj, fl, I, af, bL, A, fr, Jn, og, iL, iM, jQ, m, aX, fq, F, aBd, cO, Vr, iK, Jf, qB, fU, cV, Be, J, W, aoN, T, nP, by, at); #c1(GLYATL3) c2(NP_001010904) c3(4517) c4(30631, 43688, 56745, 17574, 69802) c5(hT); #c1(GLYCTK) c2(NP_001138423) c3(4518) c4(30632, 43689, 56746, 17575, 69803) c5(bDC, bDB); #c1(GM2A) c2(NP_000396) c3(4519) c4(30633, 43690, 56747, 17576, 69804) c5(bDD, ml, kz, awU, bDe); #c1(GMCL1) c2(NP_848526) c3(4520) c4(30634, 43691, 56748, 17577, 69805) c5(at, hW, f, b, cV); #c1(GMDS) c2(NP_001240775) c3(4521) c4(30635, 43692, 56749, 17578, 69806) c5(V, b, ad, cs, U, ez); #c1(GMFB) c2(NP_004115) c3(4522) c4(30636, 43693, 56750, 17579, 69807) c5(bDE, w, pw, bDF, cV); #c1(GMFG) c2(NP_004868) c3(4523) c4(30637, 43694, 56751, 17580, 69808) c5(X, av, at, ap); #c1(GMIP) c2(NP_001275927) c3(4524) c4(30638, 43695, 56752, 17581, 69809) c5(cA); #c1(GML) c2(XP_011515271) c3(4525) c4(30639, 43696, 56753, 17582, 69810) c5(fy, ik, il, b); #c1(GMNN) c2(XP_005249216) c3(4526) c4(30640, 43697, 56754, 17583, 69811) c5(aJK, eu, pD, bw, y, co, aX, b, sG, q, av, aV, u, fO, gv, P, ew, bh, jT, fc, os, ag, cT, Oi, af); #c1(GMPPA) c2(NP_995319) c3(4527) c4(30641, 43698, 56755, 17584, 69812) c5(bDG); #c1(GMPPB) c2(NP_037466) c3(4528) c4(30642, 43699, 56756, 17585, 69813) c5(bDH, bDI, bDJ, kG); #c1(GMPR2) c2(NP_001002000) c3(4529) c4(30643, 43700, 56757, 17586, 69814) c5(ar, u, J, y, bu); #c1(GMPR) c2(NP_006868) c3(4530) c4(30644, 43701, 56758, 17587, 69815) c5(at, aX); #c1(GMPS) c2(NP_003866) c3(4531) c4(30645, 43702, 56759, 17588, 69816) c5(ch, h, q); #c1 (GNA11) c2(NP_002058) c3(4532) c4(30646, 43703, 56760, 17589, 69817) c5(bDL, Pb, b, TU, bDK, cr, DO, HC, D, jC, aX, aAP, avy, u); #c1(GNA12) c2(NP_001269369) c3(4533) c4(30647, 43704, 56761, 17590, 69818) c5(bDM, A, b, qd, X, kN, iU, di, dV, iL, U, e, y, d, bDN, iy, DE, h, q, fJ, OC, dZ, n, fH, gg, u, g, V, aC, qq, fO, T, VP, jT, av, jH, qp, Fz, anG, at); #c1(GNA13) c2(NP_001269354) c3(4534) c4(30648, 43705, 56762, 17591, 69819) c5(A, aX, ig, pD, ag, jT, u, y); #c1(GNA14) c2(NP_004288) c3(4535) c4(30649, 43706, 56763, 17592, 69820) c5(iZ, di, q, bu); #c1(GNA15) c2(NP_002059) c3(4536) c4(30650, 43707, 56764, 17593, 69821) c5(px, jl, b, h, cO, ag, G, iv, oO, zD); #c1(GNAI1) c2(NP_001243343) c3(4537) c4(30651, 43708, 56765, 17594, 69822) c5(cO, eB, dA, aK, aN); #c1(GNAI2) c2(NP_001159897) c3(4538) c4(30652, 43709, 56766, 17595, 69823) c5(bDO, di, z, ey, oy, Ag, qs, co, eX, q, Jq, cs, iF, bDP, I, ad, Hq, T, beK, dL, aes, qp, bDQ, fN, fP, Af, aA, OS); #c1(GNAL) c2(NP_001248373) c3(4539) c4(30653, 43710, 56767, 17596, 69824) c5(ajs, bA, ak, ao, WA, bDS, bM, Wy, Wz, bDR); #c1(GNAO1) c2(NP_066268) c3(4540) c4(30654, 43711, 56768, 17597, 69825) c5(bDT, IC, hT, q, wn, y); #c1(GNAQ) c2(NP_002063) c3(4541) c4(30655, 43712, 56769, 17598, 69826) c5(td, b, cY, DO, bDU, cO, iq, avy, aQu, cr, AP, jC, auE, aFF, kF, Dw, P, bQ, Sq, aX, wd, bDV, ql, Dz, aA, eN, CA); #c1(GNAS) c2(NP_000507) c3(4542) c4(30656, 43713, 56770, 17599, 69827) c5(bck, dx, B, aw, gG, dB, hM, bEd, aic, bf, e, gO, bQ, cy, DE, yh, dl, vN, du, Jj, x, fx, HR, bDX, fy, EZ, ym, yE, cT, bk, i, aA, pO, arC, ic, adt, sm, iF, rd, mk, W, OV, bw, U, y, V, aQZ, ip, f, bEb, bEe, bu, cs, av, yB, bm, em, vR, yV, ae, qq, Hq, ny, cK, mF, JY, bDW, dt, bEa, OW, nc, jR, Eo, bDY, ahl, b, MS, aYf, bEf, Jq, eV, Mr, d, ec, bb, oB, nU, aVM, vu, ar, ff, Km, u, bzf, ahT, kF, bEg, il, Fb, ad, beK, auA, bdu, nV, bDQ, iR, aAV, Sk, aof, bDZ, OU, OS, af, WP, adq, A, fr, Sc, pR, QV, di, fs, yw, oy, qs, aX, or, sG, jk, ik, n, cV, bEc, adh, J, GB, T, ML, qp, ql, adi, auy, bsX); #c1(GNAT1) c2(NP_653082) c3(4543) c4(30657, 43714, 56771, 17600, 69828) c5(ch, ml, bEh, ayr); #c1(GNAT3) c2(NP_001095856) c3(4544) c4(30658, 43715, 56772, 17601, 69829) c5(am, ch, ys, kC, aA, oG); #c1(GNAZ) c2(NP_002064) c3(4545) c4(30659, 43716, 56773, 17602, 69830) c5(yE, ak, aX); #c1(GNBIL) c2(NP_443730) c3(4546) c4(30660, 43717, 56774, 17603, 69831) c5(ahi, hW, ak, he, cz, cA); #c1(GNB2L1) c2(NP_006089) c3(4547) c4(30661, 43718, 56775, 17604, 69832) c5(A, aw, b, cY, og, cO, bf, e, y, d, jh, aX, f, F, q, bu, ar, B, cs, av, aq, o, bm, v, ad, IR, IX, by, aM, u, IS, bk); #c1(GNB3) c2(NP_002066) c3(4548) c4(30662, 43719, 56776, 17605, 69833) c5(dx, dM, iq, dN, aeB, dD, eH, w, tH, aEK, cO, bf, e, dv, dl, IV, tS, sH, du, hR, pb, akn, vY, tO, cT, i, dc, bq, aA, bP, fl, td, Jy, vD, rd, nb, cA, cM, uD, ip, rr, ak, B, tQ, Bd, fD, dA, cx, gv, eX, ny, dO, aY, ap, Dr, eR, MG, uk, gZ, pi, d, Fp, bb, vj, hV, mL, Wf, jG, u, aE, o, fh, Tl, kF, I, sX, gL, uw, qg, et, bdu, ao, nV, dn, bL, A, gE, di, eO, wf, aW, ny, qs, VD, sG, tL, F, Uq, y, sV, aV, dj, W, P, Bb, aM, QK, Ic, E, bh, at, oT); #c1(GNB4) c2(XP_006713784) c3(4549) c4(30663, 43720, 56777, 17606, 69834) c5(bEi, fx, i, cG); #c1(GNB5) c2(NP_006569) c3(4550) c4(30664, 43721, 56778, 17607, 69835) c5(cs, ad); #c1(GNE) c2(NP_001121699) c3(4551) c4(30665, 43722, 56779, 17608, 69836) c5(A, bS, b, Ik, dB, AA, bZ, aX, bEj, B, alz, cc, oD, WG, nl, ajl, P, bhy, alt, ag, ajg, alw, OG); #c1 (GNG10) c2(NP_001017998) c3(4552) c4(30666, 43723, 56780, 17609, 69837) c5(aX); #c1(GNG11) c2(NP_004117) c3(4553) c4(30667, 43724, 56781, 17610, 69838) c5(ji); #c1(GNG2) c2(XP_011535148) c3(4554) c4(30668, 43725, 56782, 17611, 69839) c5(aX, b); #c1(GNG4) c2(NP_004476) c3(4555) c4(30669, 43726, 56783, 17612, 69840) c5(ho, dB); #c1(GNG7) c2(NP_443079) c3(4556) c4(30670, 43727, 56784, 17613, 69841) c5(ik, F, hP); #c1 (GNG8) c2(NP_150283) c3(4557) c4(30671, 43728, 56785, 17614, 69842) c5(P, sJ, m, aC, yh, bEk, cT, T, z, oO, av); #c1(GNGT1) c2(NP_068774) c3(4558) c4(30672, 43729, 56786, 17615, 69843) c5(cy); #c1(GNGT2) c2(XP_006721882) c3(4559) c4(30673, 43730, 56787, 17616, 69844) c5(cT); #c1(GNL1) c2(NP_005266) c3(4560) c4(30674, 43731, 56788, 17617, 69845) c5(sQ, nl, iu, nj, m); #c1(GNL3) c2(NP_055181) c3(4561) c4(30675, 43732, 56789, 17618, 69846) c5(is, by, en, aw, b, k, fr, dB, jc, w, gE, O, re, A, e, y, d, tp, cn, RD, AX, ak, q, bu, dQ, cM, jG, u, g, il, B, ze, hZ, NZ, J, bd, T, fx, ft, IU, JY, jT, aY, bm, jh, jR, uH, i, dc, h); #c1(GNL3L) c2(NP_061940) c3(4562) c4(30676, 43733, 56790, 17619, 69847) c5(A, hP, B); #c1(GNLY) c2(NP_001289687) c3(4563) c4(30677, 43734, 56791, 17620, 69848) c5(P, bDN, cy, b, pS, Dg, DM, sE, rq, J, fO, eV, cT, Dl, yi, ajf, aq, bT, aO); #c1(GNMT) c2(NP_061833) c3(4564) c4(30678, 43735, 56792, 17621, 69849) c5(gG, bEl, A, aX, jE, b, bm, h, B, q, vQ, Nq, Ns, xf, IJ, z, u, y); #c1(GNPAT) c2(NP_055051) c3(4565) c4(30679, 43736, 56793, 17622, 69850) c5(Mh, nf, FE, bEm); #c1(GNPDA1) c2(XP_005268405) c3(4566) c4(30680, 43737, 56794, 17623, 69851) c5(dx, b, X, jL, mW, iL, eM, fR, yt, m, dv, fm, h, eX, F, q, bEo, n, av, bm, gl, aFZ, du, ae, be, dt, pr, Pk, jG, bEn, eo, aU); #c1 (GNPDA2) c2(NP_001257809) c3(4567) c4(30681, 43738, 56795, 17624, 69852) c5(cy, I, dA, Jt, hT, di, eO, aA, oG, ap); #c1(GNPTAB) c2(NP_077288) c3(4568) c4(30682, 43739, 56796, 17625, 69853) c5(bEp, bCW, IU, em, LG, aQX, bEq, bfg); #c1(GNPTG) c2(NP_115909) c3(4569) c4(30683, 43740, 56797, 17626, 69854) c5(nW, bfg, bEq, bCW, LG); #c1(GNRH1) c2(NP_000816) c3(4570) c4(30684, 43741, 56798, 17627, 69855) c5(A, b, X, w, di, aqX, vl, bEs, bEr, jn, Hq, aX, am, jd, B, avW, cU, y, av, u, oJ, g, vR, kF, Mi, Fw, afh, US, vF, UT, jC, iA, afj, wh, jR, yE, bU, eG, bEt); #c1(GNRH2) c2(NP_847901) c3(4571) c4(30685, 43742, 56799, 17628, 69856) c5(wh, A, b, X, B, oJ, av, bEu); #c1(GNRHR) c2(NP_000397) c3(4572) c4(30686, 43743, 56800, 17629, 69857) c5(bEv, A, aiF, b, X, Tw, aVX, yD, PM, y, bQ, aX, jd, B, cU, oJ, av, u, iF, NT, kF, Fw, US, W, Hq, T, Ca, iA, wh, bCb, yE, agc, UT, aA, eG); #c1(GNS) c2(NP_002067) c3(4573) c4(30687, 43744, 56801, 17630, 69858) c5(fl, LG, IU, kA); #c1(GOLGA1) c2(NP_002068) c3(4574) c4(30688, 43745, 56802, 17631, 69859) c5(Ns, Nq, bEw); #c1(GOLGA2) c2(NP_004477) c3(4575) c4(30689, 43746, 56803, 17632, 69860) c5(co, b); #c1(GOLGA3) c2(NP_001166028) c3(4576) c4(30690, 43747, 56804, 17633, 69861) c5(at); #c1(GOLGA4) c2(NP_001166184) c3(4577) c4(30691, 43748, 56805, 17634, 69862) c5(A, Pz, b, dB, aZQ, mk, pt, oM, jG, bq, pv); #c1(GOLGA5) c2(NP_005104) c3(4578) c4(30692, 43749, 56806, 17635, 69863) c5(og, U, hV, nV); #c1(GOLGA8B) c2(NP_001018861) c3(4579) c4(30693, 43750, 56807, 17636, 69864) c5(U, Bt); #c1(GOLGB1) c2(NP_001243415) c3(4580) c4(30694, 43751, 56808, 17637, 69865) c5(bb, b, FM, jR, P, cO); #c1(GOLM1) c2(NP_808800) c3(4581) c4(30695, 43752, 56809, 17638, 69866) c5(gG, jh, by, A, gE, b, bEx, B, q, gv, bY, C, z, bh, bu, bm, o); #c1(GOLPH3) c2(NP_071413) c3(4582) c4(30696, 43753, 56810, 17639, 69867) c5(A, aw, b, k, X, gE, dB, HG, w, z, nT, U, ps, e, y, Ne, d, jh, co, aeF, B, q, bu, ik, O, dQ, av, u, arQ, V, il, by, P, bEy, RS, dP, at); #c1(GOLT1A) c2(NP_940849) c3(4583) c4(30697, 43754, 56811, 17640, 69868) c5(bEz, fw, di, n, Yv, ci); #c1 (GOLT1B) c2(NP_057156) c3(4584) c4(30698, 43755, 56812, 17641, 69869) c5(wV, bEz, fw, wP, n, Yv, ci); #c1(GON4L) c2(NP_001269787) c3(4585) c4(30699, 43756, 56813, 17642, 69870) c5(nU); #c1(GOPC) c2(NP_001017408) c3(4586) c4(30700, 43757, 56814, 17643, 69871) c5(b, fr, afY, hS, w, Fh, aHd, O, co, aX, f, y, as, u, EM, an, Dg, aow, fO, ft, aFs, Io, Ty, agb, bEA, cT); #c1(GORAB) c2(NP_001139511) c3(4587) c4(30701, 43758, 56815, 17644, 69872) c5(alm, q, bEB, vc, UB, Ux, cp); #c1(GORASP1) c2(NP_114105) c3(4588) c4(30702, 43759, 56816, 17645, 69873) c5(B, DT, w, bf, e, O, cy, kJ, azY, azx, g, aC, fO, iU, nV, x, qt, ag, cT, pt, asL, X, jz, U, y, f, bu, xl, av, iT, V, BV, bt, pi, jR, oM, he, b, aF, oi, ey, d, jh, bb, fv, re, hV, q, ar, pB, dQ, u, o, cl, fs, j, by, et, jU, JH, ao, axM, aAs, eQ, fl, hd, A, Iv, brx, yw, jQ, m, aX, fq, h, F, lb, ik, n, aV, aq, cV, J, bEC, T, XO, aM, ii, Jh, fP, bh, eG); #c1(GORASP2) c2(NP_056345) c3(4589) c4(30703, 43760, 56817, 17646, 69874) c5(aA, I); #c1(GOSR1) c2(NP_001007026) c3(4590) c4(30704, 43761, 56818, 17647, 69875) c5(il, nQ, b, Bu, jz, gm, q, v, iL, jQ, u, y, aoc); #c1(GOSR2) c2(NP_001012529) c3(4591) c4(30705, 43762, 56819, 17648, 69876) c5(oy, dx, dv, xM, du, bED, zk, di, bEF, bEE, zp, ap); #c1(GOT1) c2(NP_002070) c3(4592) c4(30706, 43763, 56820, 17649, 69877) c5(is, gK, A, sQ, mz, bEz, bEG, B, fw, bT, jc, eX, Yv, cO, n, bX, ci, jH); #c1(GOT2) c2(NP_001273149) c3(4593) c4(30707, 43764, 56821, 17650, 69878) c5(dx, f, b, ak, bf, U, y, dv, hV, ra, ar, O, u, da, kF, V, I, du, bcp, afz, eX, ad, aM, nV, fN, vF, aA, at, ap); #c1(GP1BA) c2(NP_000164) c3(4594) c4(30708, 43765, 56822, 17651, 69879) c5(dx, bL, wa, DW, dD, qz, jK, ve, dv, vY, di, sF, bf, e, d, m, Ei, bb, fm, f, bEK, dl, Em, kk, bEI, akk, aV, u, wY, fh, Tl, qC, be, sj, sH, du, xf, bEJ, II, bq, bEH, jG, L, qt, ql, fw, tO, vK, fD, vZ, qD, at); #c1(GP1BB) c2(NP_000398) c3(4595) c4(30709, 43766, 56823, 17652, 69880) c5(Ei, kF, K, L, kk, cr, AP); #c1(GP2) c2(NP_001007241) c3(4596) c4(30710, 43767, 56824, 17653, 69881) c5(bof, aE); #c1(GP5) c2(NP_004479) c3(4597) c4(30711, 43768, 56825, 17654, 69882) c5(Ei, rY, xK, vK, kk, xX, L); #c1(GP6) c2(NP_001077368) c3(4598) c4(30712, 43769, 56826, 17655, 69883) c5(dx, bL, id, pT, gE, vY, di, cO, wf, bf, aO, bb, bEL, N, DZ, fh, wK, du, I, aC, qC, et, be, aM, at, SJ, vK, fD, bq, eN, ap); #c1(GP9) c2(NP_000165) c3(4599) c4(30713, 43770, 56827, 17656, 69884) c5(tw, bb, Ei, L, n, Em, dl, xK, kk, fD, bEM, eN, ci, fh); #c1(GPA33) c2(NP_005805) c3(4600) c4(30714, 43771, 56828, 17657, 69885) c5(ad, di, cs, cp); #c1 (GPAA1) c2(NP_003792) c3(4601) c4(30715, 43772, 56829, 17658, 69886) c5(d, b, GS, F, q, gv, sL, i, bh, fx, u, e, y); #c1(GPALPP1) c2(NP_061029) c3(4602) c4(30716, 43773, 56830, 17659, 69887) c5(ak, bb); #c1(GPAM) c2(XP_005270055) c3(4603) c4(30717, 43774, 56831, 17660, 69888) c5(aX, I, ch, bd, fN, aA, dL, n); #c1 (GPANK1) c2(NP_149417) c3(4604) c4(30718, 43775, 56832, 17661, 69889) c5(aC, m, jl, jD, ac); #c1(GPAT2) c2(NP_997211) c3(4605) c4(30719, 43776, 56833, 17662, 69890) c5(aX, u, y); #c1(GPATCH1) c2(NP_060495) c3(4606) c4(30720, 43777, 56834, 17663, 69891) c5(cp); #c1(GPATCH2) c2(NP_001284683) c3(4607) c4(30721, 43778, 56835, 17664, 69892) c5(ck, u, y, b, cO); #c1 (GPATCH2L) c2(NP_060396) c3(4608) c4(30722, 43779, 56836, 17665, 69893) c5(oy, t); #c1(GPATCH8) c2(NP_001002909) c3(4609) c4(30723, 43780, 56837, 17666, 69894) c5(zF, nb); #c1(GPBAR1) c2(XP_011509046) c3(4610) c4(30724, 43781, 56838, 17667, 69895) c5(gB, Jy, w, Jq, bf, Jx, bmo, d, aX, rr, gz, PE, e, em, hW, I, Fw, gY, P, cy, aM, jH, qp, py, gC, ag, gu, dn, aA, eN); #c1(GPC1) c2(NP_002072) c3(4611) c4(30725, 43782, 56839, 17668, 69896) c5(c, EZ, b, kJ, X, f, aB, q, aN, O, ag, aax, n, acX, bw, FG, u, fQ, y); #c1(GPC2) c2(NP_689955) c3(4612) c4(30726, 43783, 56840, 17669, 69897) c5(u, b); #c1(GPC3) c2(NP_001158089) c3(4613) c4(30727, 43784, 56841, 17670, 69898) c5(Dr, OG, nU, aw, iL, b, bEN, X, na, kB, jc, Bd, Ni, iG, gE, IO, e, y, d, co, aX, SI, Bi, hV, q, ra, FN, ar, av, QJ, u, fQ, R, is, jB, fe, wB, cV, gG, bp, by, W, T, mF, Lt, TY, jE, nV, iP, ID, bm, jR, Lo, bh, rb); #c1(GPC4) c2(NP_001439) c3(4614) c4(30728, 43785, 56842, 17671, 69899) c5(fe, dA, sf, Um, aP, fQ); #c1 (GPC5) c2(NP_004457) c3(4615) c4(30729, 43786, 56843, 17672, 69900) c5(IJ, at, td, dA, Dq, aV, bp, bd, dl, co, jT, cl, rw, ji, fy, bb, hR); #c1(GPC6) c2(NP_005699) c3(4616) c4(30730, 43787, 56844, 17673, 69901) c5(oy, qf, atj, V, u, Ks, aHj, agT, qa, T, cB, U, aV, AP, aA, y); #c1(GPCPD1) c2(NP_062539) c3(4617) c4(30731, 43788, 56845, 17674, 69902) c5(cc); #c1(GPD1) c2(NP_001244128) c3(4618) c4(30732, 43789, 56846, 17675, 69903) c5(bEO, l, u, q, y); #c1(GPD1L) c2(NP_055956) c3(4619) c4(30733, 43790, 56847, 17676, 69904) c5(Fp, aw, bEP, F, ajW, rw, cO, at); #c1(GPD2) c2(NP_001076581) c3(4620) c4(30734, 43791, 56848, 17677, 69905) c5(gD, bEQ, aHw, I, bER, ch, f, aiC, A, eO, nU, cp); #c1(GPER1) c2(NP_001091671) c3(4621) c4(30735, 43792, 56849, 17678, 69906) c5(dx, B, iD, b, X, w, kY, A, y, dv, ip, aua, bu, cU, oJ, hb, av, aV, u, dh, sQ, Be, du, by, T, eX, ny, iA, hR, wh, BX, zX, at, eG, ap); #c1(GPHA2) c2(NP_570125) c3(4622) c4(30736, 43793, 56850, 17679, 69907) c5(aX); #c1(GPHN) c2(NP_001019389) c3(4623) c4(30737, 43794, 56851, 17680, 69908) c5(bES, de, oy, IB, nz, f, jL, J, W, aWR, iZ, dd, hS, IV, CG, o); #c1(GPIHBP1) c2(NP_835466) c3(4624) c4(30738, 43795, 56852, 17681, 69909) c5(A, aw, wm, f, ZJ, B, u, y); #c1(GPI) c2(NP_001171651) c3(4625) c4(30739, 43796, 56853, 17682, 69910) c5(dx, bL, en, dt, b, zH, X, MR, Dr, IW, jL, mW, aN, xb, iL, eM, bw, U, qG, bEU, yt, M, co, LS, fm, bET, h, f, F, q, BQ, bEo, fr, dQ, y, cs, hV, av, pq, u, gl, aFZ, n, be, fs, V, ae, m, aC, bpR, du, kp, ft, IR, pr, P, dv, eX, Jm, fy, byK, gx, Pk, jG, aec, qT, CY, bEn, wu, IX, ks, aFw, bm, PB, eo, ag, fR, IS, dh, xX, fl, aU); #c1(GPKOW) c2(NP_056513) c3(4626) c4(30740, 43797, 56854, 17683, 69911) c5(da); #c1(GPLD1) c2(NP_001494) c3(4627) c4(30741, 43798, 56855, 17684, 69912) c5(Dr, dG, og, aX, b, X, eT, eX, EN, fN); #c1(GPMGA) c2(NP_001248377) c3(4628) c4(30742, 43799, 56856, 17685, 69913) c5(to, ak, aY, f, cO, ix, jN, dc, cM); #c1 (GPM6B) c2(NP_001001994) c3(4629) c4(30743, 43800, 56857, 17686, 69914) c5(cJ, bK, bel, aX, qt); #c1(GPN1) c2(NP_001138519) c3(4630) c4(30744, 43801, 56858, 17687, 69915) c5(oG); #c1(GPNMB) c2(NP_001005340) c3(4631) c4(30745, 43802, 56859, 17688, 69916) c5(A, aw, b, cY, awh, fl, O, U, y, zi, aX, yE, re, B, q, X, ar, ff, av, u, g, bm, V, qb, ze, J, gv, jo, T, pi, fM, aH, aeq, aq, DO, P, TD, ag, bEV, iB, bh, aA); #c1(GPR101) c2(NP_473362) c3(4632) c4(30746, 43803, 56860, 17689, 69917) c5(oy, bEW, OQ); #c1(GPR119) c2(NP_848566) c3(4633) c4(30747, 43804, 56861, 17690, 69918) c5(dx, em, dv, I, du, bf, aA, aM); #c1(GPR12) c2(NP_005279) c3(4634) c4(30748, 43805, 56862, 17691, 69919) c5(jH, aA, cy, cO); #c1(GPR132) c2(NP_001265623) c3(4635) c4(30749, 43806, 56863, 17692, 69920) c5(d, dx, du, e, m); #c1 (GPR135) c2(NP_072093) c3(4636) c4(30750, 43807, 56864, 17693, 69921) c5(aD); #c1(GPR137C) c2(NP_001093122) c3(4637) c4(30751, 43808, 56865, 17694, 69922) c5(cO); #c1(GPR139) c2(NP_001002911) c3(4638) c4(30752, 43809, 56866, 17695, 69923) c5(dA); #c1(GPR143) c2(NP_000264) c3(4639) c4(30753, 43810, 56867, 17696, 69924) c5(aAk, pk, aX, NV, bEX, KO); #c1(GPR148) c2(NP_997247) c3(4640) c4(30754, 43811, 56868, 17697, 69925) c5(f); #c1(GPR149) c2(NP_001033794) c3(4641) c4(30755, 43812, 56869, 17698, 69926) c5(dA); #c1(GPR150) c2(NP_954713) c3(4642) c4(30756, 43813, 56870, 17699, 69927) c5(X); #c1(GPR151) c2(NP_919227) c3(4643) c4(30757, 43814, 56871, 17700, 69928) c5(d, qp, hW, I, b, Fw, Jq, cy, ag, P, w, dn, aX, aA, eN, e); #c1(GPR152) c2(NP_996880) c3(4644) c4(30758, 43815, 56872, 17701, 69929) c5(aW); #c1(GPR153) c2(XP_011539736) c3(4645) c4(30759, 43816, 56873, 17702, 69930) c5(ar, iG); #c1(GPR155) c2(NP_001253980) c3(4646) c4(30760, 43817, 56874, 17703, 69931) c5(cz); #c1(GPR156) c2(NP_001161743) c3(4647) c4(30761, 43818, 56875, 17704, 69932) c5(bj, do, bb); #c1(GPR158) c2(NP_065803) c3(4648) c4(30762, 43819, 56876, 17705, 69933) c5(d, at, ik, e); #c1(GPR15) c2(NP_005281) c3(4649) c4(30763, 43820, 56877, 17706, 69934) c5(aC, P, ac); #c1(GPR160) c2(NP_055188) c3(4650) c4(30764, 43821, 56878, 17707, 69935) c5(bb, b); #c1(GPR161) c2(NP_001254540) c3(4651) c4(30765, 43822, 56879, 17708, 69936) c5(di, cp); #c1(GPR162) c2(NP_055264) c3(4652) c4(30766, 43823, 56880, 17709, 69937) c5(dx, A, Xl, eH, sJ, bf, U, dv, B, q, aM, bm, ri, jB, V, du, Xn, ZG, ZF, Ha, eU, eT, bq, at); #c1(GPR171) c2(NP_037440) c3(4653) c4(30767, 43824, 56881, 17710, 69938) c5(ow); #c1(GPR174) c2(NP_115942) c3(4654) c4(30768, 43825, 56882, 17711, 69939) c5(iu); #c1 (GPR176) c2(NP_001258784) c3(4655) c4(30769, 43826, 56883, 17712, 69940) c5(oy, Hl, do, dA); #c1(GPR179) c2(NP_001004334) c3(4656) c4(30770, 43827, 56884, 17713, 69941) c5(bEY); #c1(GPR17) c2(NP_001154889) c3(4657) c4(30771, 43828, 56885, 17714, 69942) c5(wK, sB, dh); #c1(GPR180) c2(NP_851320) c3(4658) c4(30772, 43829, 56886, 17715, 69943) c5(Ic, Au); #c1(GPR182) c2(XP_011536129) c3(4659) c4(30773, 43830, 56887, 17716, 69944) c5(dv, ag, azs, di, IW, I, u, y); #c1(GPR183) c2(NP_004942) c3(4660) c4(30774, 43831, 56888, 17717, 69945) c5(fl, aE); #c1(GPR19) c2(XP_011518926) c3(4661) c4(30775, 43832, 56889, 17718, 69946) c5(co); #c1(GPR1) c2(NP_001091669) c3(4662) c4(30776, 43833, 56890, 17719, 69947) c5(P, et); #c1(GPR20) c2(NP_005284) c3(4663) c4(30777, 43834, 56891, 17720, 69948) c5(l); #c1(GPR22) c2(XP_011514358) c3(4664) c4(30778, 43835, 56892, 17721, 69949) c5(Dz, f, Dw); #c1(GPR26) c2(NP_703143) c3(4665) c4(30779, 43836, 56893, 17722, 69950) c5(aY, ih, w, cM, dc, O); #c1(GPR34) c2(NP_001091048) c3(4666) c4(30780, 43837, 56894, 17723, 69951) c5(g, jT, jl); #c1(GPR35) c2(NP_001182311) c3(4667) c4(30781, 43838, 56895, 17724, 69952) c5(jH, gC, EZ, I, brm, mm); #c1(GPR37) c2(NP_005293) c3(4668) c4(30782, 43839, 56896, 17725, 69953) c5(vR, h, f, rQ, H, bj); #c1(GPR37L1) c2(NP_004758) c3(4669) c4(30783, 43840, 56897, 17726, 69954) c5(hR); #c1(GPR39)

c2(NP_001499) c3(4670) c4(30784, 43841, 56898, 17727, 69955) c5(jh, A, il, I, B, Eo, vR, ik, cO, aA); #c1(GPR4) c2(NP_005273) c3(4671) c4(30785, 43842, 56899, 17728, 69956) c5(co, aPt, b, X, f, av); #c1(GPR50) c2(NP_004215) c3(4672) c4(30786, 43843, 56900, 17729, 69957) c5(dj, vR, Wk, ak, cC, rQ, aA); #c1(GPR52) c2(NP_005675) c3(4673) c4(30787, 43844, 56901, 17730, 69958) c5(he, ayZ); #c1 (GPR55) c2(XP_011510479) c3(4674) c4(30788, 43845, 56902, 17731, 69959) c5(d, b, I, X, e, T, ic, yA, av, aA, jN); #c1(GPR65) c2(NP_003599) c3(4675) c4(30789, 43846, 56903, 17732, 69960) c5(fl, b, ak, A, bq, aV); #c1(GPR68) c2(NP_001171147) c3(4676) c4(30790, 43847, 56904, 17733, 69961) c5(X, av, A, B); #c1(GPR6) c2(NP_001273028) c3(4677) c4(30791, 43848, 56905, 17734, 69962) c5(do); #c1(GPR75) c2(NP_006785) c3(4678) c4(30792, 43849, 56906, 17735, 69963) c5(aW); #c1(GPR78) c2(NP_543009) c3(4679) c4(30793, 43850, 56907, 17736, 69964) c5(ak, vQ); #c1(GPR83) c2(NP_057624) c3(4680) c4(30794, 43851, 56908, 17737, 69965) c5(mz, aA, bQ); #c1(GPR87) c2(NP_076404) c3(4681) c4(30795, 43852, 56909, 17738, 69966) c5(d, vR, e); #c1(GPRASP1) c2(NP_001092881) c3(4682) c4(30796, 43853, 56910, 17739, 69967) c5(cy); #c1(GPRC5A) c2(NP_003970) c3(4683) c4(30797, 43854, 56911, 17740, 69968) c5(A, b, gG, pK, e, y, d, jh, MT, co, B, q, jV, bu, cU, ar, cs, Jk, jG, fy, u, da, fU, cV, J, bp, ad, T, aZ, et, by, hx, gd, cT, Yv, I, ji); #c1(GPRC5B) c2(NP_001291700) c3(4684) c4(30798, 43855, 56912, 17741, 69969) c5(Jt, FU, aA, I, dA); #c1(GPRC5C) c2(NP_061123) c3(4685) c4(30799, 43856, 56913, 17742, 69970) c5(jh, dj, fU, cy, q, fO, co, alx, bEZ, u, y); #c1(GPRC5D) c2(NP_061124) c3(4686) c4(30800, 43857, 56914, 17743, 69971) c5(jh, dj, fU, cy, b, q, fO, co, vR, alx, bEZ, u, y); #c1(GPRC6A) c2(NP_001273283) c3(4687) c4(30801, 43858, 56915, 17744, 69972) c5(d, qp, hW, I, Fw, B, Jq, cy, ag, P, w, dn, aX, aA, eN, A, e); #c1(GPR1N1) c2(XP_005265863) c3(4688) c4(30802, 43859, 56916, 17745, 69973) c5(aA, ak, dl, Gn); #c1(GPR1N2) c2(XP_011538700) c3(4689) c4(30803, 43860, 56917, 17746, 69974) c5(cA, ak); #c1 (GPR1N3) c2(XP_005262993) c3(4690) c4(30804, 43861, 56918, 17747, 69975) c5(bq, bj); #c1(GPS2) c2(NP_004480) c3(4691) c4(30805, 43862, 56919, 17748, 69976) c5(rd, aA, aX, P); #c1(GPSM1) c2(NP_001139110) c3(4692) c4(30806, 43863, 56920, 17749, 69977) c5(aCg, Nz, sE, dd, xc); #c1(GPSM2) c2(XP_011539605) c3(4693) c4(30807, 43864, 56921, 17750, 69978) c5(b, FR, bFa, na, Bx, et, u, y); #c1(GPSM3) c2(NP_071390) c3(4694) c4(30808, 43865, 56922, 17751, 69979) c5(da, jH, m); #c1(GPT2) c2(NP_001135938) c3(4695) c4(30809, 43866, 56923, 17752, 69980) c5(fN, f, aNw, z); #c1(GPT) c2(XP_011515295) c3(4696) c4(30810, 43867, 56924, 17753, 69981) c5(avO, gK, ck, gE, mz, fN, f, q, J, aNw, cl, z, sQ, bm, dh, aG); #c1(GPX5) c2(NP_001500) c3(4697) c4(30811, 43868, 56925, 17754, 69982) c5(dA); #c1 (GRAMD1B) c2(NP_001273492) c3(4698) c4(30812, 43869, 56926, 17755, 69983) c5(cT); #c1(GRAMD3) c2(NP_001139791) c3(4699) c4(30813, 43870, 56927, 17756, 69984) c5(gk); #c1(GRAMD4) c2(NP_055939) c3(4700) c4(30814, 43871, 56928, 17757, 69985) c5(rH, aX, byr, rJ); #c1(GRAP2) c2(NP_001278754) c3(4701) c4(30815, 43872, 56929, 17758, 69986) c5(dx, en, Ob, gG, dB, Od, w, cO, bf, e, O, dv, dN, kz, cl, Hs, Oe, aC, du, aB, gm, bp, ft, jT, ag, cT, bk, dc, aA, fO, X, LM, mk, bw, O, y, V, co, DM, f, bu, B, cs, av, fy, bm, iT, if, rN, ae, NZ, BV, Da, yM, zS, b, aF, Of, NY, ey, gZ, d, fv, re, q, dQ, ar, jG, u, dh, o, da, I, j, ad, CZ, jU, nV, kB, HN, xU, yA, Jh, zD, A, k, fr, di, gE, al, jx, aX, h, F, n, aV, cV, be, J, Oc, P, II, ji, nP, by, wU, mb, fP, iB, eG, ja); #c1(GRAP) c2(NP_006604) c3(4702) c4(30816, 43873, 56930, 17759, 69987) c5(gn, am); #c1(GRASP) c2(NP_001258785) c3(4703) c4(30817, 43874, 56931, 17760, 69988) c5(W, U, T, V); #c1(GRB10) c2(NP_001001549) c3(4704) c4(30818, 43875, 56932, 17761, 69989) c5(d, QU, S, wp, I, mF, AX, gE, ahS, j, e, Me, ahO, cB, Em, av, u, h, y); #c1(GRB14) c2(NP_001290351) c3(4705) c4(30819, 43876, 56933, 17762, 69990) c5(l, hV, u, nV, y); #c1(GRB2) c2(NP_002077) c3(4706) c4(30820, 43877, 56934, 17763, 69991) c5(b, X, OO, gE, U, O, jd, q, bu, Mr, y, jG, u, o, oJ, V, I, cV, J, fO, by, P, T, fx, wh, ie, jR, yE, i, iu); #c1(GRB7) c2(NP_001229371) c3(4707) c4(30821, 43878, 56935, 17764, 69992) c5(A, aw, b, X, dB, kY, y, yK, q, bu, ar, ik, av, u, il, bp, by, T, jG, Lt, ag, cT); #c1(GREB1) c2(NP_683701) c3(4708) c4(30822, 43879, 56936, 17765, 69993) c5(co, kF, b, X, Mi, B, bQ, A, di, av, u, eG, y); #c1(GREM1) c2(NP_001178252) c3(4709) c4(30823, 43880, 56937, 17766, 69994) c5(dx, A, b, bvY, pR, kY, IW, vp, U, e, V, d, dv, aeM, B, arm, bu, sV, oD, gg, fy, u, n, I, du, j, W, P, T, bp, aZ, ct, jT, arJ, Ns, tl, eG); #c1(GREM2) c2(XP_005273283) c3(4710) c4(30824, 43881, 56938, 17767, 69995) c5(mL, aV, cp); #c1(GRHL1) c2(NP_937825) c3(4711) c4(30825, 43882, 56939, 17768, 69996) c5(V, cV, q, ad, bFb, cs, U, bm, hip); #c1(GRHL2) c2(NP_079191) c3(4712) c4(30826, 43883, 56940, 17769, 69997) c5(d, IJ, bm, aw, V, b, bFc, pR, LR, q, e, dl, jo, ff, U, u, gg, y); #c1(GRHPR) c2(NP_036335) c3(4713) c4(30827, 43884, 56941, 17770, 69998) c5(TW, A, MR); #c1(GRIA1) c2(NP_000818) c3(4714) c4(30828, 43885, 56942, 17771, 69999) c5(ak, IK, b, aPm, hS, w, dd, bb, cA, bFe, cM, gM, hF, sG, xJ, iZ, O, o, ma, hW, Et, IM, cz, P, hH, ao, dP, dk, aY, bFf, qP, bFd, dc, aCB); #c1(GRIA2) c2(NP_000817) c3(4715) c4(30829, 43886, 56943, 17772, 70000) c5(nU, IK, oa, jf, hS, w, dd, bFe, cA, bf, O, aO, bb, sG, ak, Vr, iZ, ar, abp, Ue, o, hW, bK, T, aM, ao, dk, ih, bFg); #c1(GRIA3) c2(NP_000819) c3(4716) c4(30830, 43887, 56944, 17773, 70001) c5(nU, b, jJ, hS, bFe, cM, hH, bFi, ag, qc, ak, iZ, qu, o, Et, hZ, nz, J, rV, jT, ao, aY, PY, sG, bFh, dc); #c1(GRIA4) c2(NP_001070711) c3(4717) c4(30831, 43888, 56945, 17774, 70002) c5(ao, sG, Bu, Id, w, cA, IV, eg); #c1 (GRID1) c2(NP_060021) c3(4718) c4(30832, 43889, 56946, 17775, 70003) c5(cf, mp, xM, ak, bDy, hS, gF, jv, ap); #c1(GRID2) c2(NP_001273767) c3(4719) c4(30833, 43890, 56947, 17776, 70004) c5(kS, cO); #c1(GRIK1) c2(NP_000821) c3(4720) c4(30834, 43891, 56948, 17777, 70005) c5(ao, si, dA, bK, aq, ak, dk, PY, Id, hS, iZ, cA, u, CG); #c1(GRIK2) c2(XP_005267002) c3(4721) c4(30835, 43892, 56949, 17778, 70006) c5(nX, ak, IK, hY, bV, rV, e, cM, oy, bb, nU, bu, vu, qu, IV, d, dj, ma, si, Et, cz, G, hH, by, ao, aY, ie, bFj, fw, ih, iZ, dc, bq); #c1(GRIK4) c2(NP_001269399) c3(4722) c4(30836, 43893, 56950, 17779, 70007) c5(qf, ak, hW, nU, he, jN, bb, aX); #c1 (GRIK5) c2(NP_001287959) c3(4723) c4(30837, 43894, 56951, 17780, 70008) c5(d, dj, ma, hH, aY, ak, ie, iZ, cz, ih, hY, G, vu, bV, dc, qu, e, cM); #c1(GRIN1) c2(NP_000823) c3(4724) c4(30838, 43895, 56952, 17781, 70009) c5(b, hS, WA, hi, bFe, bj, dl, ak, iZ, Nf, y, u, o, da, si, Lw, hw, HL, bFk, cf, dd, aA, Gn); #c1(GRIN2A) c2(NP_000824) c3(4725) c4(30839, 43896, 56953, 17782, 70010) c5(bFo, byV, b, nF, aF, hS, aCB, ak, iL, Lw, cA, si, U, cM, aX, nU, do, iZ, Nf, aUu, cs, nB, bFm, dh, o, dj, ma, hW, gv, IL, bq, iN, bb, ad, hw, bFn, HL, ao, rQ, aQT, dk, aY, hT, cz, bFd, akp, dc, bFI, bh, aWt); #c1(GRIN2B) c2(XP_011518932) c3(4726) c4(30840, 43897, 56954, 17783, 70011) c5(lb, ak, tr, b, jJ, hS, qa, dV, cO, cA, U, bj, e, cM, d, jh, jv, bb, Iz, Wk, nU, bu, dZ, Nf, dl, aqz, qu, fH, rV, fy, dh, o, ma, si, yQ, nQ, dc, gv, IL, fl, bFq, Gl, cy, by, xx, fJ, HL, ao, rQ, dk, aY, ch, cf, iZ, bFp, HV, bh, at, Gn); #c1(GRIN2C) c2(NP_000826) c3(4727) c4(30841, 43898, 56955, 17784, 70012) c5(ak); #c1(GRIN2D) c2(NP_000827) c3(4728) c4(30842, 43899, 56956, 17785, 70013) c5(bK, ak, HS, fl); #c1(GRIN3A) c2(NP_597702) c3(4729) c4(30843, 43900, 56957, 17786, 70014) c5(d, aL, GL, bK, ak, ox, e, ik, Io, pl, o); #c1(GRIN3B) c2(NP_619635) c3(4730) c4(30844, 43901, 56958, 17787, 70015) c5(ao, hW, o); #c1(GRINA) c2(NP_001009184) c3(4731) c4(30845, 43902, 56959, 17788, 70016) c5(hS, si); #c1(GRIP1) c2(NP_066973) c3(4732) c4(30846, 43903, 56960, 17789, 70017) c5(Yj, ao, fy, b, tW, aBd, bq, at, u); #c1(GRK1) c2(NP_002920) c3(4733) c4(30847, 43904, 56961, 17790, 70018) c5(bFu, aX, cO, ch, ml, bFt, bFr, bgm, hZ, ayr, bFs, nW, bFv); #c1(GRK4) c2(NP_001004056) c3(4734) c4(30848, 43905, 56962, 17791, 70019) c5(oy, dx, qs, du, bb, yu, vh, f, vR, di, bq, at, u, sH, y); #c1(GRK5) c2(NP_005299) c3(4735) c4(30849, 43906, 56963, 17792, 70020) c5(A, b, aF, cO, bg, di, z, bj, aW, cy, B, do, mR, cs, o, I, cV, mc, ad, cK, hR, at); #c1(GRK6) c2(NP_001004105) c3(4736) c4(30850, 43907, 56964, 17793, 70021) c5(de, vR, aX, aC, fO, bj); #c1(GRK7) c2(NP_631948) c3(4737) c4(30851, 43908, 56965, 17794, 70022) c5(bFr, bgm, bFv); #c1(GRM1) c2(NP_001264995) c3(4738) c4(30852, 43909, 56966, 17795, 70023) c5(b, fr, dB, hS, kY, cA, y, aX, bFw, iZ, cM, aV, u, afx, ft, bFx, T, cy, kS, ao, KK, dk, KR, fc, bk, dc, aY); #c1(GRM2) c2(NP_000830) c3(4739) c4(30853, 43910, 56967, 17796, 70024) c5(IK, hS, w, bFe, cA, bf, O, abp, bb, f, Vr, iZ, aO, o, dj, Oe, cM, xg, aM, to, ao, aY, hn, he, aal, dc); #c1(GRM3) c2(NP_000831) c3(4740) c4(30854, 43911, 56968, 17797, 70025) c5(b, ns, hS, nm, nt, ng, nr, nn, cA, bFe, no, np, cM, jT, aX, bFi, ak, iZ, O, Gj, dj, hZ, J, jv, to, aY, tW, he, jN, dc, jP); #c1(GRM4) c2(NP_000832) c3(4741) c4(30855, 43912, 56969, 17798, 70026) c5(jR, dm, jv, fr, hY, fc, ak, Id, ft, hS, iZ, HS, jr, x, aV, EG); #c1(GRM5) c2(NP_000833) c3(4742) c4(30856, 43913, 56970, 17799, 70027) c5(k, fr, vD, bg, dk, dd, cA, xw, cM, bb, ak, oE, iZ, fH, IV, aV, o, hW, cV, cz, KK, ft, fJ, ao, rQ, aY, tW, he, fc, dc); #c1(GRM6) c2(NP_000834) c3(4743) c4(30857, 43914, 56971, 17800, 70028) c5(ayr, mI, Bu, dZ, bFy, dV, Wf, iN, aWt); #c1(GRM7) c2(NP_000835) c3(4744) c4(30858, 43915, 56972, 17801, 70029) c5(oy, oC, IK, dA, aY, wr, ak, nu, ih, Ns, dZ, dV, wX, cA, hF, IV, hW); #c1(GRM8) c2(XP_006716001) c3(4745) c4(30859, 43916, 56973, 17802, 70030) c5(fh, fU, hW, fc, dA, aY, at, cz, ih, hS, aaB, rQ, aWt, eO, iN, bb, aV, bq, Fg, ap); #c1(GRN) c2(XP_005257310) c3(4746) c4(30860, 43917, 56974, 17803, 70031) c5(dx, en, gG, bFz, aN, w, aK, e, dv, iy, DE, tF, oN, du, fO, fx, jT, DA, ahX, amq, jE, mE, cT, i, aA, bS, kN, X, bFE, ai, xw, y, f, bFA, B, aaR, av, bm, em, qq, v, eX, VP, hw, anG, fw, b, bg, aAb, d, jh, bFB, re, q, ff, jG, u, o, I, qL, sf, Lk, Ha, ao, iR, hT, bFD, xU, amb, acE, A, HS, bj, iK, aX, h, bxW, Vr, n, aV, cV, hZ, be, LG, jo, T, bFC, aj, eJ, qp, xM, eB, sp); #c1(GRPEL1) c2(NP_079472) c3(4747) c4(30861, 43918, 56975, 17804, 70032) c5(Eo, P, VD); #c1(GRP) c2(NP_001012530) c3(4748) c4(30862, 43919, 56976, 17805, 70033) c5(Dr, A, b, fi, X, aF, ag, dB, tR, w, hA, O, wX, U, bu, hP, iA, y, V, d, jh, bFF, co, cy, Zq, pp, kJ, f, F, es, cU, YP, B, aJ, cs, ik, av, fy, u, e, ff, g, iF, fU, YV, hb, il, cV, aC, bK, asM, bp, ad, jo, T, ar, x, nP, by, JY, gp, gt, Bg, ip, zM, eB, Bh, fl, gj, hd); #c1(GRPR) c2(NP_005305) c3(4749) c4(30863, 43920, 56977, 17806, 70034) c5(by, A, b, X, aF, dB, tR, YO, Bh, jR, wX, U, hP, y, co, B, F, bu, ff, cs, av, fy, o, fi, fU, V, cV, bK, bp, ad, T, x, cz, YM, rQ, in, tQ, oN, i); #c1(GRSF1) c2(NP_001091947) c3(4750) c4(30864, 43921, 56978, 17807, 70035) c5(en); #c1(GRXCR1) c2(NP_001073945) c3(4751) c4(30865, 43922, 56979, 17808, 70036) c5(bFG, aQp, Bx); #c1(GRXCR2) c2(XP_011535976) c3(4752) c4(30866, 43923, 56980, 17809, 70037) c5(bFH); #c1(GSC2) c2(NP_005306) c3(4753) c4(30867, 43924, 56981, 17810, 70038) c5(xJ, hW, afb, K); #c1(GSC) c2(NP_776248) c3(4754) c4(30868, 43925, 56982, 17811, 70039) c5(jE, aw, b, bFJ, ajx, bm, KA, f, q, jR, aNS, w, bFI, jT, AP, aE, O); #c1(GSDMA) c2(XP_006721895) c3(4755) c4(30869, 43926, 56983, 17812, 70040) c5(by, cy, aE, b, bu); #c1(GSDMB) c2(XP_011523318) c3(4756) c4(30870, 43927, 56984, 17813, 70041) c5(jH, nk, cy, b, aC, JR, bu, dl, ti, fP, rB, aA, bm, aE, qe); #c1(GSDMC) c2(NP_113603) c3(4757) c4(30871, 43928, 56985, 17814, 70042) c5(O, dP, bu); #c1(GSDMD) c2(NP_079012) c3(4758) c4(30872, 43929, 56986, 17815, 70043) c5(bu); #c1(GSE1) c2(NP_001127945) c3(4759) c4(30873, 43930, 56987, 17816, 70044) c5(U, V); #c1(GSGIL) c2(NP_001103233) c3(4760) c4(30874, 43931, 56988, 17817, 70045) c5(o); #c1(GSK3A) c2(NP_063937) c3(4761) c4(30875, 43932, 56989, 17818, 70046) c5(em, A, ak, q, dB, ag, B, dc, bw, at, bm); #c1(GSK3B) c2(NP_001139628) c3(4762) c4(30876, 43933, 56990, 17819, 70047) c5(dx, f, dB, ns, nm, nt, nq, nr, cO, bf, no, np, O, dv, du, fO, ft, x, aai, yE, w, i, dc, mD, bS, em, X, nn, cA, bw, U, cM, co, pw, ag, ak, bu, cc, cs, fy, bm, fi, V, v, bQ, bq, aH, aY, jR, B, aG, b, bb, aua, q, jV, ar, jG, u, o, kF, LR, ad, et, HN, I, de, oC, A, fr, iL, hP, jx, aX, bj, h, tF, y, dj, cV, YR, J, W, P, T, II, by, aM, xM, zM, wr, gI); #c1(GSN) c2(NP_000168) c3(4763) c4(30877, 43934, 56991, 17820, 70048) c5(gK, B, w, hM, cO, aK, e, O, cp, cy, aC, nW, Ij, bp, aax, fx, aL, aKB, ag, bFM, fD, bq, Hk, iP, i, bw, U, eo, bFL, y, co, DG, f, cs, av, fy, pP, iT, V, v, J, aNc, asJ, jR, ji, Xe, b, aF, WA, bFK, d, re, aYd, QE, ar, u, aE, il, ad, xk, aZ, et, aaK, et, Zl, ov, aOB, kK, A, k, aKE, aX, h, ik, Jf, aq, hZ, bd, W, T, boI, pG, Y, adb, Af, bM, aT, eN); #c1(GSPT1) c2(NP_001123478) c3(4764) c4(30878, 43935, 56992, 17821, 70049) c5(co, cy, b, h, QJ, bu, cX, T, C, z, bf, jG, by, u, y); #c1(GSPT2) c2(NP_060564) c3(4765) c4(30879, 43936, 56993, 17822, 70050) c5(A); #c1(GSR) c2(NP_000628) c3(4766) c4(30880, 43937, 56994, 17823, 70051) c5(dx, jR, al, ps, pi, y, cp, d, co, bb, oB, f, e, eV, Vr, pP, ar, aaj, u, o, aAU, ae, cV, du, ao, v, BZ, dv, mD, pq, aH, ii, ch, aFa, cf, mA, cT, I, aU, aA, at, oF); #c1(GSS) c2(XP_011527098) c3(4767) c4(30881, 43938, 56995, 17824, 70052) c5(dx, bFO, zP, acA, aw, bFN, Ag, f, aya, ar, cs, nR, aaQ, du, v, bp, ad, dt, P, T, et, bCb, Af, I, aU, bxm); #c1(GSTA1) c2(NP_665683) c3(4768) c4(30882, 43939, 56996, 17825, 70053) c5(B, b, X, aaP, A, di, z, bf, U, e, y, d, co, cy, f, q, bu, dl, ar, n, fH, u, fi, V, I, bp, W, xq, et, fx, fJ, aM, YM, iw, hp, bm, ah, i, Lr, at, iE); #c1(GSTA2) c2(XP_011512834) c3(4769) c4(30883, 43940, 56997, 17826, 70054) c5(gK, co, iP, V, ip, GK, f, GM, GB, cT, A, ik, nS, u, dh, y); #c1(GSTA4) c2(XP_005249092) c3(4770) c4(30884, 43941, 56998, 17827, 70055) c5(dx, iP, ic, bf, bw, nS, bj, e, d, co, cy, aeM, f, q, fy, bm, o, QD, V, I, du, bp, dv, T, aM, ch, i, I, aA); #c1(GSTA5) c2(NP_714543) c3(4771) c4(30885, 43942, 56999, 17828, 70056) c5(di); #c1(GSTCD) c2(NP_001026890) c3(4772) c4(30886, 43943, 57000, 17829, 70057) c5(A, id, di, aZ, I, DF); #c1(GSTK1) c2(NP_001137151) c3(4773) c4(30887, 43944, 57001, 17830, 70058) c5(dx, by, B, pV, sE, iU, w, Gq, aw, e, O, cp, dv, cy, b, t, aZv, jU, Dc, fH, n, g, bm, asQ, aC, ft, du, is, ao, bp, gY, fx, hR, pq, pb, akn, Ic, ie, aeR, ag, cT, bk, i, dn, pt, aA, GD, fO, cG, X, ix, iG, bf, U, y, yt, co, js, f, cs, bu, k, awd, iv, av, fy, QD, iT, cj, vi, jB, azd, V, ae, IT, bq, aZD, JY, aNc, py, er, fw, aNw, tl, DL, ji, fD, ci, vL, ap, ck, kE, am, au, aZB, bFR, ya, d, jh, bb, Dx, re, hV, g, es, ar, ff, as, jG, aM, u, aE, o, da, fs, il, j, ad, gO, G, Lt, jH, aWN, nV, iR, hT, Bg, ex, zZ, xX, I, aO, yA, A, pF, asx, fr, Lv, gE, bFP, NA, og, di, C, iL, eM, hP, aW, m, qs, Wj, aX, I, fg, h, F, az, ik, rR, cB, qB, Jk, fU, hW, ez, cV, an, fJ, be, dB, J, W, P, ti, T, II, Ez, bFS, D, bek, qe, bFQ, jT, hq, fP, bh, at, eG, gf); #c1(GSTM3) c2(XP_011539598) c3(4774) c4(30888, 43945, 57002, 17831, 70059) c5(dx, GD, A, b, Gm, X, rR, cr, i, gN, jc, di, ic, O, U, nS, bj, e, y, cp, d, jl, co, aX, aeM, ip, jd, re, f, q, bu, bmM, fr, ik, B, aJ, bm, ar, NB, u, iT, o, ff, g, iP, V, il, aub, GK, du, is, aWN, bp, GB, GQ, GI, ny, cy, k, pk, nk, BX, iR, er, QD, GM, cX, cT, bk, tl, I, Ez, at, fW); #c1(GSTO1) c2(NP_001177931) c3(4775) c4(30889, 43946, 57003, 17832, 70060) c5(dx, Dr, hV, il, b, gG, jz, eR, Ip, mk, A, sF, iL, eO, si, Bz, vV, fx, y, jQ, Ag, dv, bb, nV, NR, t, Bi, f, q, dl, ff, u, o, aoc, bm, Pz, V, VD, hO, bj, du, gm, v, xq, T, eX, aZ, cy, J, ao, dO, iR, Bu, jh, xb, i, I, Mp, fh, ap); #c1 (GSTO2) c2(NP_001177942) c3(4776) c4(30890, 43947, 57004, 17833, 70061) c5(b, X, mk, si, bj, y, Ag, cy, NR, t, f, q, bu, ff, av, u, o, QD, bm, Pz, V, hO, T, fx, ao, dO, iR, i, I, ap); #c1(GSTP1) c2(NP_000843) c3(4777) c4(30891, 43948, 57005, 17834, 70062) c5(dx, by, mL, pV, Gm, gG, fN, dB, w, bbG, ali, aw, O, Wj, ps, fx, bFV, gM, hO, jT, cy, b, iR, t, pq, Si, e, nZ, dl, JF, aD, ik, IV, Zv, biz, gl, R, g, JP, asQ, aeM, ajc, aC, bK, sH, du, is, gm, bp, gY, GK, vc, Ge, x, aAM, JN, OA, dH, azM, M, BX, cX, aei, bm, DO, jh, ag, cT, qP, dh, i, sg, pt, aA, GJ, bT, Dr, aEX, id, GM, kN, X, iW, aGg, mk, fU, Bg, iG, bf, bw, U, Oh, y, ez, co, bi, ip, yE, bsr, aAa, f, IW, cs, vQ, bu, tv, gX, k, awd, iv, bv, av, fy, QD, iT, bk, yJ, if, SA, aNY, azd, V, ae, vr, n, Qz, gv, Os, cO, eO, bt, bq, Fr, bd, fJ, YU, YM, GB, pk, dO, gt, py, ju, er, B, kJ, TQ, ov, tl, iA, ji, bn, iu, fW, ck, ny, am, GD, jq, aWN, jH, ic, tG, z, re, bFO, ya, Mr, d, Ag, Iz, Ox, Qi, hV, je, q, bkm, ac, aJ, wj, ar, atr, u, nj, o, ff, aCC, Pz, I, gL, awy, aH, gL, ad, BZ, gO, G, xg, rB, fH, et, et, jG, Lt, aaJ, iw, ao, nV, eV, aJA, fD, pY, kM, he, xp, gd, Ns, ex, ah, dn, I, aff, Mp, zD, de, A, iL, akn, gU, fr, Lv, OA, Oe, gN, bFP, jc, di, C, vg, eM, ft, hP, aW, oy, m, Bz, aX, il, aRh, sG, bj, h, F, qr, oE, lr, hN, Ex, rR, qB, LI, QJ, aq, jZ, fp, NO, ax, tP, bFT, cV, be, Fs, J, W, jo, ti, T, fO, Oi, jl, nP, cz, qe, aM, to, nk, js, Y, CA, Nq, sf, Lr, E, fq, bh, at, eG, gf); #c1(GSTT1) c2(NP_000844) c3(4778) c4(30892, 43949, 57006, 17835, 70063) c5(SB, dB, aoK, e, cp, dl, TP, ajc, aC, ft, pq, DO, ag, bk, fD, pt, aA, Dr, GD, X, vD, iG, bw, vl, Oh, ak, awd, av, fy, is, V, fJ, YM, pk, aY, HB, ji, qh, apU, vL, ap, ck, Ag, fv, aJ, oO, atr, pY, aE, da, il, gL, pF, rB, iw, aWN, nV, Ns, Zu, Mp, de, fr, gn, gN, jc, C, iL, gE, jw, m, wG, Uq, rR, qB, Jk, ao, be, J, jo, aBe, fP, E, dx, iU, qP, bf, O, Os, azb, bmM, Gp, Zv, Oe, eg, aeM, du, gm, bp, Ce, x, aOo, qt, BX, dS, bT, sU, bP, aEX, ie, mk, ix, U, yt, co, f, bbG, bu, tv, Go, vi, bd, ny, bq, Le, tl, Ig, am, Y, wn, z, d, bb, jd, g, ra, ff, wj, ar, iR, o, fh, RG, kF, aPe, et, jH, kM, GM, gd, bpB, lb, k, bpE, eO, al, aW, bn, hN, Gs, ag, ax, ez, aMH, Fs, asg, T, II, Bb, aCC, nk, hg, aeg, gj, gf, aw, ps, bFV, hO, bx, aMq, aD, fH, g, bK, fO, vc, Q, fx, bFY, akn, hD, bY, cT, yJ, tp, na, B, gX, iv, bv, OA, pP, iT, QD, SA, azd, bt, gC, iA, YU, JY, dO, fw, iu, fW, ach, b, jq, tN, tG, ZR, re, TQ, je, Cu, vu, as, n, xp, NT, ju, nd, xq, et, yA, Lt, jM, aJA, hX, hT, Bg, ex, cX, gU, ah, awy, IA, GK, bFP, vg, eM, wf, gs, sG, bj, cO, ik, bFX, bFZ, bFW, W, jl, fM, aM, ale, Ez, at, eG, pV, Gm, w, tH, gO, dv, cy, t, JF, PH, R, sH, gY, qx, jT, dH, azM, fN, Hf, i, id, hS, aAM, y, ip, vQ, cs, kN, bm, cj, iF, aub, IT, auw, cK, py, er, jR, gA, qO, ci, hV, Pg, ic, Og, xg, bFU, eV, Fp, Iz, iW, jh, jV, bkm, qe, jG, u, Pz, tg, I, by, BZ, G, eQ, he, dn, I, A, di, Bz, hP, aX, fq, h, F, qr, M, Ex, ID, aV, jZ, fU, GB, iB, P, j, ad, ac, QK, QN, Nq, bh); #c1(GSTT2B) c2(NP_001074312) c3(4779) c4(30893, 43950, 57007, 17836, 70064) c5(d, V, b, f, U, e); #c1(GSTT2) c2(NP_000845) c3(4780) c4(30894, 43951, 57008, 17837, 70065) c5(GB, iP, V, ip, cG, GK, f, gN, dl, xq, di, gL, GM, rO, ik, U, nS, Gl); #c1(GSTZ1) c2(NP_665877) c3(4781) c4(30895, 43952, 57009, 17838, 70066) c5(aaJ, kM, gO, SS, bj, ak, Tw, cT, vu, ac, i, aRh, I, fx, u, y, ale); #c1(GSX1) c2(NP_663632) c3(4782) c4(30896, 43953, 57010, 17839, 70067) c5(alF); #c1(GSX2) c2(NP_573574) c3(4783) c4(30897, 43954, 57011, 17840, 70068) c5(PY); #c1(GTDC1) c2(NP_001006637) c3(4784) c4(30898, 43955, 57012, 17841, 70069) c5(d, ik, e); #c1(GTF2A1) c2(NP_056943) c3(4785) c4(30899, 43956, 57013, 17842, 70070) c5(by, ig, P, bu, u, fp); #c1(GTF2A1L) c2(NP_001180416) c3(4786) c4(30900, 43957, 57014, 17843, 70071) c5(NT, gE, am, nU, q, vQ, Ky, z); #c1 (GTF2A2) c2(NP_004483) c3(4787) c4(30901, 43958, 57015, 17844, 70072) c5(P, fp); #c1(GTF2E1) c2(NP_005504) c3(4788) c4(30902, 43959, 57016, 17845, 70073) c5(u); #c1(GTF2E2) c2(NP_002086) c3(4789) c4(30903, 43960, 57017, 17846, 70074) c5(jH); #c1 (GTF2F1) c2(NP_002087) c3(4790) c4(30904, 43961, 57018, 17847, 70075) c5(av, u); #c1(GTF2F2) c2(NP_004119) c3(4791) c4(30905, 43962, 57019, 17848, 70076) c5(av); #c1(GTF2H1) c2(NP_001135779) c3(4792) c4(30906, 43963, 57020, 17849, 70077) c5(A, bS, b, gG, mk, w, bZ, kY, Lq, ai, xw, U, y, TG, d, co, cy, kJ, f, aBx, g, e, do, Kz, ky, B, WF, ar, aV, u, o, V, nl, GS, v, bp, BV, dt, P, T, bt, aj, ac, ao, fy, KN, bm, Dj, zM, bdY, iT, amb, fl, aA); #c1(GTF2H2C_2) c2(NP_001035955) c3(4793) c4(30907, 43964, 57021, 17850, 70078) c5(Lq, wV, A, b, wP, ck, nl, B, aBx, eu, Dj, dt, mk, kz, ky, aJ, VT); #c1(GTF2H2C) c2(XP_005248650) c3(4794) c4(30908, 43965, 57022, 17851, 70079) c5(Lq, wV, A, b, wP, ck, nl, B, aBx, eu, Dj, dt, mk, kz, ky, aJ, VT); #c1(GTF2H2) c2(NP_001506) c3(4795) c4(30909, 43966, 57023, 17852, 70080) c5(Lq, apR, wV, A, b, bdY, ck, nl, asf, B, aBx, eu, Dj, dt, mk, kz, ky, aJ, VT, wP); #c1(GTF2H3) c2(NP_001258796) c3(4796) c4(30910, 43967, 57024, 17853, 70081) c5(Lq, co, cr, b, nl, B, aBx, Dj, ad, dt, mk, A, ky, cs, et, pF, eg); #c1(GTF2H4) c2(NP_001508) c3(4797) c4(30911, 43968, 57025, 17854, 70082) c5(Lq, m, A, ar, ae, b, ag, nl, B, Dj, dt, mk, P, aBx, ky, cs, bw, T, aV); #c1(GTF2H5) c2(NP_997001) c3(4798) c4(30912, 43969, 57026, 17855, 70083) c5(A, bnG, V, b, nF, nl, aey, B, Dj, dt, mk, aBx, ky, bnF, Lq, nB, yA, U, aV, vl, rT); #c1(GTF2I) c2(NP_001267729) c3(4799) c4(30913, 43970, 57027, 17856, 70084) c5(bhL, f, b, Wk, h, nU, gn, agU, ih, A, T, B, xw, AP, anW, alM); #c1(GTF2IRD1) c2(NP_001186136) c3(4800) c4(30914, 43971, 57028, 17857, 70085) c5(d, co, QJ, bp, e, alM, bwe, xw, AP, azq, FY); #c1(GTF2IRD2) c2(NP_775808) c3(4801) c4(30915, 43972, 57029, 17858, 70086) c5(alM); #c1(GTF3A) c2(NP_002088) c3(4802) c4(30916, 43973, 57030, 17859, 70087) c5(dx, A, b, du, B, P, dv, II, aA, u, y); #c1(GTF3C1) c2(NP_001511) c3(4803) P, dv, II, aA, u, y); #c1(GTF3C1) c2(NP_001511) c3(4803) c4(30917, 43974, 57031, 17860, 70088) c5(adJ); #c1 (GTPBP1) c2(NP_004277) c3(4804) c4(30918, 43975, 57032, 17861, 70089) c5(amo, be); #c1(GTPBP3) c2(NP_001122327) c3(4805) c4(30919, 43976, 57033, 17862, 70090) c5(1); #c1(GTPBP4) c2(NP_036473) c3(4806) c4(30920, 43977, 57034, 17863, 70091) c5(b, w, Iv, adt, bf, y, co, u, o, g, iF, Bd, cV, Fb, bmh, HR, aM, nV, EZ, hX, kC, fD, ku); #c1(GTSF1) c2(NP_653195) c3(4807) c4(30921, 43978, 57035, 17864, 70092) c5(yh); #c1 (GUCA1A) c2(NP_000400) c3(4808) c4(30922, 43979, 57036, 17865, 70093) c5(wV, nQ, Pa, mI, bfX, oH, wP, BY, SF, Nx, od, nR, bGa, nW, aW); #c1(GUCA1B) c2(NP_002089) c3(4809) c4(30923, 43980, 57037, 17866, 70094) c5(bGb, ml, nR, nW, nQ); #c1(GUCD1) c2(NP_001271183) c3(4810) c4(30924, 43981, 57038, 17867, 70095) c5(ao, Lc, q); #c1(GUCY1A2)

c2(NP_000846) c3(4811) c4(30925, 43982, 57039, 17868, 70096) c5(bq, u); #c1(GUCY1A3) c2(NP_001124157) c3(4812) c4(30926, 43983, 57040, 17869, 70097) c5(oy, bU, bGc, bGd, di, rb, x, bq, mK, at, O); #c1(GUCY1B3) c2(NP_000848) c3(4813) c4(30927, 43984, 57041, 17870, 70098) c5(X, av); #c1(GUCY2C) c2(NP_004954) c3(4814) c4(30928, 43985, 57042, 17871, 70099) c5(f, aw, Jy, b, di, cA, bD, U, cM, bbc, bQ, kc, ak, gX, ar, hb, cs, iz, avP, V, bGf, P, aqx, Qt, bGe, et, ad, jU, qT, aY, fP, bk, dn, dc, aA, eG, RB); #c1(GUCY2D) c2(NP_000171) c3(4815) c4(30929, 43986, 57043, 17872, 70100) c5(Pa, bGi, bGh, ea, oi, aVC, bFu, bb, nQ, sG, ml, nR, bFs, fC, nW, T, jT, aQD, OZ, bGg, bfX, bGj, Nx); #c1(GUCY2F) c2(NP_001513) c3(4816) c4(30930, 43987, 57044, 17873, 70101) c5(bw, Nx); #c1(GUK1) c2(NP_001152862) c3(4817) c4(30931, 43988, 57045, 17874, 70102) c5(W, ch, at, fl); #c1(GULP1) c2(NP_001239597) c3(4818) c4(30932, 43989, 57046, 17875, 70103) c5(dC, oy, jf, iq, ar); #c1(GUSB) c2(NP_000172) c3(4819) c4(30933, 43990, 57047, 17876, 70104) c5(iL, b, LF, iU, au, sU, bGI, ajb, aX, h, N, q, vQ, az, bGk, jG, ajR, u, fe, V, aC, bK, LG, J, dt, P, anG, bm, cT, kA, ji); #c1(GYG1) c2(NP_001171649) c3(4820) c4(30934, 43991, 57048, 17877, 70105) c5(BM, bGm, at); #c1(GYG2) c2(NP_001073324) c3(4821) c4(30935, 43992, 57049, 17878, 70106) c5(ake); #c1(GYLTL1B) c2(NP_001287650) c3(4822) c4(30936, 43993, 57050, 17879, 70107) c5(A, bb, b, u, B, T, et, xl); #c1(GYPA) c2(NP_002090) c3(4823) c4(30937, 43994, 57051, 17880, 70108) c5(Lq, b, TQ, vM, aFd, IE, di, ic, eM, bf, qG, eD, aYA, cM, co, cy, VX, h, ak, pn, amG, atg, n, pt, Jm, ae, nl, pF, FC, J, G, Io, aff, No, Th, bq, eq, wu, aY, qv, fR, ah, dc, I, oM, iu); #c1(GYPB) c2(NP_002091) c3(4824) c4(30938, 43995, 57052, 17881, 70109) c5(ae, TQ, aY, VX, FC, gn, aFd, atg, di, ah, dc, Jm, qG, iu, amG, cM); #c1(GYPC) c2(NP_001243513) c3(4825) c4(30939, 43996, 57053, 17882, 70110) c5(bps, ae, t, nf, cD, av, bsh, ya, gK); #c1(GYPE) c2(NP_002093) c3(4826) c4(30940, 43997, 57054, 17883, 70111) c5(fk, ae, TQ, aY, amG, aFd, atg, di, ah, dc, Jm, qG, iu, Qx, cM); #c1(GYS1) c2(NP_001155059) c3(4827) c4(30941, 43998, 57055, 17884, 70112) c5(l, cK, eX, bGn, om, di, fD, z, bq, ey); #c1(GYS2) c2(NP_068776) c3(4828) c4(30942, 43999, 57056, 17885, 70113) c5(bQ, bGn, I, rh, blt, mA, z, kF, aA); #c1(GZF1) c2(XP_005260860) c3(4829) c4(30943, 44000, 57057, 17886, 70114) c5(dA); #c1(GZMA) c2(NP_006135) c3(4830) c4(30944, 44001, 57058, 17887, 70115) c5(Jh, en, cy, G, aC, t, DM, Fc, gL, gn, boS, P, Dl, j, I, iU, alg); #c1(GZMB) c2(NP_004122) c3(4831) c4(30945, 44002, 57059, 17888, 70116) c5(dx, en, aw, dB, bW, yi, e, gM, dv, cy, t, fH, n, aC, du, bv, Q, fx, jT, aEY, dH, sS, ag, cT, i, GD, cY, Ku, U, aaw, y, ed, DM, B, aee, vo, aye, av, V, cd, bd, IR, pi, fJ, re, b, aF, d, bxk, gz, dQ, jG, u, aE, o, da, ER, gL, cz, IX, G, Ia, et, jH, rQ, pS, bGp, gd, IS, ZL, I, bL, A, Ik, C, iL, PI, al, m, aX, h, rR, qB, jZ, ax, J, iB, P, T, II, nk, Dl, fP, gj, gf); #c1(GZMH) c2(NP_001257710) c3(4832) c4(30946, 44003, 57060, 17889, 70117) c5(jG, ac, gE); #c1(GZMK) c2(NP_002095) c3(4833) c4(30947, 44004, 57061, 17890, 70118) c5(aF, aV); #c1(GZMM) c2(NP_005308) c3(4834) c4(30948, 44005, 57062, 17891, 70119) c5(A, pp, jz, EM, B, F, gm, axa, T, Iv, cA, u, jQ); #c1(H1F0) c2(NP_005309) c3(4835) c4(30949, 44006, 57063, 17892, 70120) c5(jH, DG, b, X, bm, h, q, J, P, iL, cB, u, y, eg); #c1(H1FX) c2(NP_006017) c3(4836) c4(30950, 44007, 57064, 17893, 70121) c5(gp); #c1(H2AFJ) c2(NP_808760) c3(4837) c4(30951, 44008, 57065, 17894, 70122) c5(u, y); #c1(H2AFX) c2(NP_002096) c3(4838) c4(30952, 44009, 57066, 17895, 70123) c5(A, aw, b, qd, X, Zy, i, wn, adB, w, di, kY, U, O, kV, ai, y, d, m, co, aX, ajF, h, f, q, e, cU, ra, kz, B, cB, HE, av, aV, u, n, fU, si, V, kM, Bs, NT, dk, gm, fO, J, qO, T, bGg, Bd, pt, jl, qy, jT, jG, fM, cq, WZ, wU, fy, YQ, fc, bm, vZ, py, aeD, fw, xX, iA, oM, aA, fj, Bi); #c1(H2AFY2) c2(NP_061119) c3(4839) c4(30953, 44010, 57067, 17896, 70124) c5(co, A); #c1(H2AFY) c2(NP_004884) c3(4840) c4(30954, 44011, 57068, 17897, 70125) c5(m, co, b, re, q, mW, ad, fl, iT, cs, cz, u, gl, y); #c1(H2AFZ) c2(NP_002097) c3(4841) c4(30955, 44012, 57069, 17898, 70126) c5(A, b, u, B, fl, Mn, y); #c1(H2BFWT) c2(NP_001002916) c3(4842) c4(30956, 44013, 57070, 17899, 70127) c5(wn, am); #c1(H3F3B) c2(NP_005315) c3(4843) c4(30957, 44014, 57071, 17900, 70128) c5(aAH, Ag, b, zJ, g, k, Cb, atd, qP, w, T, Af, Ut, O); #c1(HAA0) c2(NP_036337) c3(4844) c4(30958, 44015, 57072, 17901, 70129) c5(ao, A, B, cO, iA, aV); #c1(HABP2) c2(NP_001171131) c3(4845) c4(30959, 44016, 57073, 17902, 70130) c5(dx, aw, bGr, vY, gE, bf, e, aO, d, dv, bb, ar, bc, du, gv, aM, ql, lc, bh, at, gf, ap); #c1(HABP4) c2(NP_055097) c3(4846) c4(30960, 44017, 57074, 17903, 70131) c5(x); #c1(HACD1) c2(NP_055056) c3(4847) c4(30961, 44018, 57075, 17904, 70132) c5(b, xj, Ku, gE, si, al, U, y, awa, cy, aej, uj, q, bm, kF, V, ui, fl, P, dP, u, At, awb, avZ, arC); #c1(HACD2) c2(NP_940684) c3(4848) c4(30962, 44019, 57076, 17905, 70133) c5(da); #c1(HACD4) c2(NP_001010915) c3(4849) c4(30963, 44020, 57077, 17906, 70134) c5(at); #c1(HACE1) c2(NP_065822) c3(4850) c4(30964, 44021, 57078, 17907, 70135) c5(fe, V, b, cV, f, T, O); #c1(HACL1) c2(NP_036392) c3(4851) c4(30965, 44022, 57079, 17908, 70136) c5(gK); #c1(HADHA) c2(NP_000173) c3(4852) c4(30966, 44023, 57080, 17909, 70137) c5(A, bGs, z, gF, bGu, Fp, co, bGt, as, em, aag, ao, bp, cK, Bb, ac, fN, cf, gA, i, I, aA, at, gf); #c1(HADHB) c2(NP_001268441) c3(4853) c4(30967, 44024, 57081, 17910, 70138) c5(aag, fN, qR, ex, hR, u); #c1(HADH) c2(NP_001171634) c3(4854) c4(30968, 44025, 57082, 17911, 70139) c5(nf, cf, bGv, I, ch, oB, bqe, ex, bGw, z, bq, mY, aA, gE); #c1(HAGH) c2(NP_001035517) c3(4855) c4(30969, 44026, 57083, 17912, 70140) c5(bP, A, IO, aC, f, gJ, dB, jo, ar, u, y); #c1(HAL) c2(NP_001245262) c3(4856) c4(30970, 44027, 57084, 17913, 70141) c5(fr, jz, mW, ic, e, bpt, jQ, d, m, t, fB, Jm, gl, QD, jB, aeM, J, ft, G, T, aml, tl, ji, aA); #c1(HAMP) c2(NP_066998) c3(4857) c4(30971, 44028, 57085, 17914, 70142) c5(bP, dx, eX, aw, b, bx, Rr, att, bGx, Ck, rd, dv, fO, iL, z, bf, al, ex, eV, y, gO, yK, m, yO, IE, gC, bGA, Re, kT, t, f, alx, q, qU, II, aHH, pn, k, n, aNC, bm, et, Ch, EG, pq, u, jZ, ae, Ad, kF, alA, I, aC, kt, du, gJ, gL, gv, W, Rk, P, bQ, MD, PZ, jT, pi, jU, aM, qt, aci, fD, pP, nc, bGz, bGy, ye, gA, fP, yM, bh, aA, gE, aVh, ci, oT); #c1(HAND1) c2(NP_004812) c3(4858) c4(30972, 44029, 57086, 17915, 70143) c5(by, at, cr, hQ, b, acw, cK, mc, jR, bu, ix, mR, cO, bf, Mw, hR, acL); #c1(HAND2) c2(NP_068808) c3(4859) c4(30973, 44030, 57087, 17916, 70144) c5(ahi, cr, arB, bjF, Em, arm, cU, mk, cO, iA, cK, apg, Mw, zW); #c1(HAO1) c2(NP_060015) c3(4860) c4(30974, 44031, 57088, 17917, 70145) c5(t, bpR, A, bb, MR); #c1(HAO2) c2(XP_011539860) c3(4861) c4(30975, 44032, 57089, 17918, 70146) c5(gK, bb, MR, i); #c1(HAP1) c2(NP_001073339) c3(4862) c4(30976, 44033, 57090, 17919, 70147) c5(dx, A, bS, am, qz, rd, di, aaw, cp, c, qs, co, b, B, HW, se, fH, o, si, ZA, du, bd, dv, T, fJ, iZ, gf, ZL, bGB, at, bT); #c1(HAPLN1) c2(NP_001875) c3(4863) c4(30977, 44034, 57091, 17920, 70148) c5(atj, ID, aC, Dq, iP, ad, dl, oi, A, nl, cs, x, ry, AP, bg); #c1(HAPLN4) c2(NP_075378) c3(4864) c4(30978, 44035, 57092, 17921, 70149) c5(0); #c1(HARS2) c2(NP_001265660) c3(4865) c4(30979, 44036, 57093, 17922, 70150) c5(aQI, wu, bGC, aC, Ik, cl, oD, ac); #c1(HARS) c2(NP_001244969) c3(4866) c4(30980, 44037, 57094, 17923, 70151) c5(lk, LI, aY, fH, cl, le, ajW, cs, dB, aC, EM, wu, bGD, ac, dc, oD, vv, fJ, cM); #c1(HAS1) c2(NP_001284365) c3(4867) c4(30981, 44038, 57095, 17924, 70152) c5(aw, b, X, di, C, IW, bf, fx, y, bb, ar, O, cs, av, u, Ov, fO, ad, T, bq, VP, aX, iA, aM, Ou, i, asg, aA, at); #c1(HAS2) c2(XP_011515304) c3(4868) c4(30982, 44039, 57096, 17925, 70153) c5(dx, b, X, EM, IW, Ou, Co, adR, y, dv, aX, Ov, f, fr, ar, O, bGF, sR, gg, bGE, u, LR, I, im, du, fO, ft, IX, zk, T, cV, fx, av, Hs, xL, acw, ag, Cr, zp, i, I, aA, at, fW, TA); #c1(HAS3) c2(NP_005320) c3(4869) c4(30983, 44040, 57097, 17926, 70154) c5(d, ji, A, b, I, dA, X, cK, B, cs, ad, T, C, IW, ar, av, at, aYw, e); #c1(HAT1) c2(NP_003633) c3(4870) c4(30984, 44041, 57098, 17927, 70155) c5(gt, aKV); #c1(HAVCR1) c2(NP_001166864) c3(4871) c4(30985, 44042, 57099, 17928, 70156) c5(b, pR, gE, bGG, dB, eW, sJ, di, C, z, jD, O, gO, m, cy, wd, DM, f, q, gP, aD, jG, aV, dh, fY, ff, I, aC, be, jU, jo, ti, II, aeV, et, qe, cq, aH, aoC, dP, P, uH, gd, Dl, MR, fq, vJ, sU); #c1(HAVCR2) c2(NP_116171) c3(4872) c4(30986, 44043, 57100, 17929, 70157) c5(mZ, gE, Kt, b, cY, aiW, iU, aE, Kc, eW, sJ, vZ, C, iL, z, re, m, jT, aX, h, q, bu, Em, fy, aV, jZ, iT, n, bGH, aC, eM, gm, gv, P, nk, II, cy, by, jU, jH, aoC, dP, fN, Ox, bY, dY, xU, DI, akT, bh, jl, DM, gl); #c1(HAX1) c2(NP_001018238) c3(4873) c4(30987, 44044, 57101, 17930, 70158) c5(da, iw, aX, BW, jh, ps, f, j, hS, hN, n, vl, bGI, ael, u, zQ, y); #c1(HBA2) c2(NP_000508) c3(4874) c4(30988, 44045, 57102, 17931, 70159) c5(avO, aU, bGN, Rr, bge, dD, gn, oH, bGL, bgd, iV, Fh, bf, hP, awa, baV, bb, ae, Re, bjQ, re, nU, bGT, aFG, gU, xW, pn, N, n, bgb, si, Ch, NB, pQ, pP, aE, aXE, xc, qw, aNC, I, bGQ, ZY, J, dt, qt, P, bGK, bGJ, bGO, bGV, alP, et, aM, aaa, bGU, bGS, Ck, bGM, bGP, bGR, ah, yM, n/v, IL, ci, byB); #c1(1188) c2(NP_000509) c3(4875) c4(30989, 44046, 57103, 17932, 70160) c5(avO, aw, adn, Rr, bHc, Ka, eW, bgd, bV, ps, bGX, bGY, gU, bHe, Cp, bGW, Ti, yO, bHd, jT, pq, aL, qt, LZ, bk, bHa, td, tG, Kc, Eh, qG, bGZ, y, bgb, Ch, NB, pP, adf, gw, ae, bHb, bGK, aDL, tl, bsh, b, aF, au, byz, eV, bb, Re, re, pn, vu, bGO, u, aE, aXE, kt, aWh, rw, HE, nV, bkZ, Ck, na, ah, fl, aU, bge, di, iL, al, awa, baV, Ea, bGQ, dt, P, T, pF, CY, bGM, at, byB); #c1(HBD) c2(NP_000510) c3(4876) c4(30990, 44047, 57104, 17933, 70161) c5(awa, b, qw, qt, bgb, Re, bGS, bge, bGQ, Ti, Ck, gU, Kc, bgd, ah, tl, Ch, NB, pP); #c1(HBE1) c2(NP_005321) c3(4877) c4(30991, 44048, 57105, 17934, 70162) c5(co, qt, b, bm, J, q, C, iL, Ck, fy, pP, eV); #c1(HBEGF) c2(NP_001936) c3(4878) c4(30992, 44049, 57106, 17935, 70163) c5(dx, by, A, aw, b, X, HJ, aBd, w, xa, kY, e, U, adr, fD, y, d, co, Vx, vR, zn, B, F, q, bu, IY, ar, O, cs, iJ, av, JY, u, dh, da, ma, V, anZ, du, ad, dv, T, eX, bt, fx, vA, et, fM, Ha, aH, Eu, bm, eQ, fw, ag, i, vJ, bq, at, eG); #c1(11861) c2(NP_000550) c3(4879) c4(30993, 44050, 57107, 17936, 70164) c5(avO, jK, A, bge, gn, bHg, gw, bgd, byH, Eh, ps, awa, Re, bGY, f, gU, M, Ch, NB, pP, avo, BO, Ti, gm, J, dt, rw, aYw, jG, pq, bHf, qt, Ck, ah, pJ); #c1(11862) c2(NP_000175) c3(4880) c4(30994, 44051, 57108, 17937, 70165) c5(A, IL, IW, Eh, bf, ey, Co, bGY, f, gU, pn, ss, Cp, aM, pP, qw, dt, IX, bHi, bHh, aYw, pq, aH, qt, Ck, ah, pt); #c1(HBM) c2(NP_001003938) c3(4881) c4(30995, 44052, 57109, 17938, 70166) c5(Tr, Tp, bHj); #c1(HBP1) c2(NP_001231191) c3(4882) c4(30996, 44053, 57110, 17939, 70167) c5(A, aw, f, B, u, y); #c1(HBQ1) c2(NP_005322) c3(4883) c4(30997, 44054, 57111, 17940, 70168) c5(sl); #c1(HBS1L) c2(NP_001138630) c3(4884) c4(30998, 44055, 57112, 17941, 70169) c5(qf, awK, qt, Ck, qw, di, rw, aV, pP); #c1(HBZ) c2(NP_005323) c3(4885) c4(30999, 44056, 57113, 17942, 70170) c5(qw, qt, Kt, b, rS, jz, Ck, Iv, Eh, Nu, jfl); #c1(HCAR1) c2(NP_115943) c3(4886) c4(31000, 44057, 57114, 17943, 70171) c5(ag, zl, b, Pg); #c1(HCAR2) c2(NP_808219) c3(4887) c4(31001, 44058, 57115, 17944, 70172) c5(d, dx, du, Ez, zl, ak, ad, da, dv, ic, aM, cs, wf, bf, yA, at, u, e, y, ap); #c1(HCAR3) c2(NP_006009) c3(4888) c4(31002, 44059, 57116, 17945, 70173) c5(b, w, ic, adt, bf, ku, e, y, d, co, ak, u, o, if, Bd, cV, Fb, bmh, HR, aM, nV, EZ, hX, kC, Iv); #c1(HCCS) c2(NP_001116080) c3(4889) c4(31003, 44060, 57117, 17946, 70174) c5(aWf, bo, bf, cy, pp, aeF, Zh, Us, aye, av, aV, dh, o, HI, I, cz, aM, fc, aE, bHk, gd, bHl, kD); #c1(HCFC1) c2(NP_005325) c3(4890) c4(31004, 44061, 57118, 17947, 70175) c5(m, jE, bBq, Fx, bm, nz, nU, J, ad, fl, cs, bM, AP); #c1(HCFC2) c2(NP_037452) c3(4891) c4(31005, 44062, 57119, 17948, 70176) c5(aQv, bm, cO); #c1(HCK) c2(NP_001165601) c3(4892) c4(31006, 44063, 57120, 17949, 70177) c5(aDX, t, h, fO, P, gL, bu, aDY, jo, jV, ff, I, Uq, by, pR); #c1(HCLS1) c2(NP_005326) c3(4893) c4(31007, 44064, 57121, 17950, 70178) c5(fl, eR, aN, iG, cA, bf, aK, O, jh, LS, LI, fq, h, f, N, bu, M, iv, gl, fs, agQ, cV, aC, bK, by, Fy, aX, anf, ac, an, jR, m, cT, zO, aCQ, Xm, zD); #c1(HCN1) c2(NP_066550) c3(4894) c4(31008, 44065, 57122, 17951, 70179) c5(hY, Id, jf, dk, y, X, iZ, zb, zR, u, CG, dj, aHZ, Zz, hw, av, HL, hS, IC, ch, hn, ih, dR, ahw); #c1(HCN2) c2(NP_001185) c3(4895) c4(31009, 44066, 57123, 17952, 70180) c5(aHZ, Zz, hY, ch, eE, hS, iZ, hM, cO, hw, CG, ii); #c1(HCN3) c2(NP_065948) c3(4896) c4(31010, 44067, 57124, 17953, 70181) c5(ch, bj, aHZ); #c1(HCN4) c2(NP_005468) c3(4897) c4(31011, 44068, 57125, 17954, 70182) c5(bgc, bHm, bHe, sX, bHp, bHn, mL, cK, arL, mO); #c1(HCRT) c2(NP_001515) c3(4898) c4(31012, 44069, 57126, 17955, 70183) c5(ach, en, b, ami, A, dd, amh, cA, bf, ey, Hq, bHq, sG, B, beP, cU, NJ, do, KL, cs, Yr, aE, dj, si, rv, I, bHs, bK, el, dc, v, ad, W, xk, iA, aM, bAQ, aBy, vW, bHr, bHt, aA); #c1(HCRTR2) c2(NP_001517) c3(4899) c4(31013, 44070, 57127, 17956, 70184) c5(cO, sG, b, ami, B, W, NJ, do, A, zb, amh, Yr); #c1(HCST) c2(NP_001007470) c3(4900) c4(31014, 44071, 57128, 17957, 70185) c5(f, iL, anf, b, iU); #c1(HDAC10) c2(NP_001152758) c3(4901) c4(31015, 44072, 57129, 17958, 70186) c5(cV, q, bp, gm, bm, jZ); #c1(HDAC11) c2(NP_001129513) c3(4902) c4(31016, 44073, 57130, 17959, 70187) c5(b, P, T, fH, pz, fJ, pv); #c1(HDAC1) c2(XP_011539611) c3(4903) c4(31017, 44074, 57131, 17960, 70188) c5(Dr, by, ak, aw, b, X, Lv, IW, Tw, O, jc, A, iL, bb, cA, e, U, G, al, y, cy, d, m, co, aX, kH, kJ, t, h, f, F, q, jV, bu, dl, aC, Mr, vu, fv, B, cB, cs, pB, av, fy, u, dh, iT, bm, si, cV, lb, YR, jG, J, fO, ad, P, sf, T, VO, iA, hR, fp, jE, bkR, ck, ch, tW, PY, jR, ag, cT, ji, eG, re); #c1(HDAC2) c2(NP_001518) c3(4904) c4(31018, 44075, 57132, 17961, 70189) c5(Dr, A, aw, b, TQ, X, Tw, oH, Df, bf, U, e, O, cy, d, M, co, aX, kJ, h, f, q, bu, dl, kz, cs, av, sK, u, bm, vO, V, cV, ct, ad, W, P, Ce, T, Qt, x, bb, by, aM, jE, OW, ch, tW, he, ih, ag, vu, I, ji, OS, eG, hd); #c1(HDAC3) c2(NP_003874) c3(4905) c4(31019, 44076, 57133, 17962, 70190) c5(dx, by, eX, aw, b, X, dv, si, Vy, iL, bf, xw, G, aDt, O, eE, co, f, JY, q, bu, dl, jT, cs, av, aV, u, aE, kF, Kx, cV, aC, du, fO, gm, gL, vF, W, ad, bQ, T, II, HL, x, hR, aM, jE, fy, fc, bm, aTZ, P, cT); #c1(HDAC4) c2(NP_006028) c3(4906) c4(31020, 44077, 57134, 17963, 70191) c5(nU, b, X, aE, vY, w, dd, cO, A, bb, sm, brm, g, bkr, kz, cc, av, fy, og, aqQ, G, fx, eq, ao, iY, ch, i, fl, vZ, aA); #c1(HDAC5) c2(XP_005256961) c3(4907) c4(31021, 44078, 57135, 17964, 70192) c5(dx, fl, du, IW, b, cV, fr, f, dc, J, jR, ft, G, dv, dd, bcf, cO, cA, vZ); #c1(HDAC6) c2(NP_006035) c3(4908) c4(31022, 44079, 57136, 17965, 70193) c5(Dr, by, A, aw, b, X, aE, gG, di, ic, kG, xw, bj, e, y, d, jT, aX, pz, h, B, q, bu, O, cs, fH, OA, fy, u, iT, xc, Gl, jE, cV, bK, gm, gL, v, dt, P, cy, ad, fJ, ac, bHu, ao, ID, bm, bk, re, pv); #c1(HDAC7) c2(NP_001091886) c3(4909) c4(31023, 44080, 57137, 17966, 70194) c5(bL, b, X, G, bw, av); #c1(HDAC8) c2(NP_001159890) c3(4910) c4(31024, 44081, 57138, 17967, 70195) c5(bHw, bHv, jE, cV, nU, jz, q, aNS, n, bm, ci, jQ); #c1(HDAC9) c2(NP_001191073) c3(4911) c4(31025, 44082, 57139, 17968, 70196) c5(dx, B, aw, DT, w, Ou, adr, e, O, dv, cy, t, aKH, kz, fH, gl, Fg, lb, iv, bp, ql, aDe, x, fx, jT, dH, pb, ag, cT, i, LD, hS, sF, kY, cA, bw, U, xw, y, co, pp, pz, mI, f, bu, cs, av, fy, bm, awe, em, V, Ov, v, pr, iA, fJ, JY, du, dO, jR, pv, b, m, aO, d, bb, q, jV, X, fv, pB, u, dh, I, by, G, Ut, ao, fl, vZ, aDF, A, pF, mW, ea, jc, di, al, hP, oy, c, aX, h, F, cU, aC, iZ, dj, ax, cV, J, P, T, fO, ad, at); #c1(HDC) c2(NP_002103) c3(4912) c4(31026, 44083, 57140, 17969, 70197) c5(f, b, cY, Kc, kB, ho, e, y, cy, d, aX, asy, DM, Tp, zh, uB, do, Pc, zb, Tr, jG, u, baH, bHx, sH, by, asz, bb, bu, nk, dP, DL, DI, rv); #c1(HDDC2) c2(NP_057147) c3(4913) c4(31027, 44084, 57141, 17970, 70198) c5(Fg); #c1(HDGF) c2(NP_001119522) c3(4914) c4(31028, 44085, 57142, 17971, 70199) c5(d, co, aw, V, b, cY, e, q, bp, ad, P, w, ik, cB, il, aX, U, fy, bm, BQ, O); #c1(HDGFL1) c2(NP_612641) c3(4915) c4(31029, 44086, 57143, 17972, 70200) c5(bb, eO); #c1(HDGFRP3) c2(NP_057157) c3(4916) c4(31030, 44087, 57144, 17973, 70201) c5(xw); #c1(HDHD1) c2(NP_001129037) c3(4917) c4(31031, 44088, 57145, 17974, 70202) c5(iE, bty); #c1(HDLBP) c2(NP_001230829) c3(4918) c4(31032, 44089, 57146, 17975, 70203) c5(dx, du, b, iu, brm, dY, gT, dv, A, cz, u, y); #c1(HEATR1) c2(NP_060542) c3(4919) c4(31033, 44090, 57147, 17976, 70204) c5(u, y); #c1(HEATR3) c2(NP_891552) c3(4920) c4(31034, 44091, 57148, 17977, 70205) c5(blH, jx); #c1(HEATR5B) c2(NP_061897) c3(4921) c4(31035, 44092, 57149, 17978, 70206) c5(fh, at, bb, bq, ap); #c1(HEATR6) c2(NP_071353) c3(4922) c4(31036, 44093, 57150, 17979, 70207) c5(dG, en, aX, b, eT, fo, T, fy, at, u, dF, y, ap); #c1(HEBP1) c2(NP_057071) c3(4923) c4(31037, 44094, 57151, 17980, 70208) c5(A, b, dY); #c1(HEBP2) c2(NP_055135) c3(4924) c4(31038, 44095, 57152, 17981, 70209) c5(bm); #c1(HECA) c2(NP_057301) c3(4925) c4(31039, 44096, 57153, 17982, 70210) c5(b, Kc, kB, zb, rv, u, y); #c1(HECTD2) c2(NP_001271203) c3(4926) c4(31040, 44097, 57154, 17983, 70211) c5(aaQ, A, eJ, B, kp, en); #c1(HECTD4) c2(NP_001103132) c3(4927) c4(31041, 44098, 57155, 17984, 70212) c5(oy, ik, at, di, I); #c1(HECW1) c2(NP_001273988) c3(4928) c4(31042, 44099, 57156, 17985, 70213) c5(oy, m, u, y); #c1(HECW2) c2(NP_065811) c3(4929) c4(31043, 44100, 57157, 17986, 70214) c5(re, cs, iT, ad); #c1(HEG1) c2(NP_065784) c3(4930) c4(31044, 44101, 57158, 17987, 70215) c5(X); #c1(HELLS) c2(NP_001275996) c3(4931) c4(31045, 44102, 57159, 17988, 70216) c5(fy, kF, V, b, qL, yh, F, bu, fG, U, by, u, av, y); #c1(HELQ) c2(NP_598375) c3(4932) c4(31046, 44103, 57160, 17989, 70217) c5(jh, ip, X, F, av, ho, ac); #c1(HELT) c2(NP_001287710) c3(4933) c4(31047, 44104, 57161, 17990, 70218) c5(vw, eC, bxk, fl); #c1(HELZ2) c2(NP_001032412) c3(4934) c4(31048, 44105, 57162, 17991, 70219) c5(eH, aA); #c1(HELZ) c2(NP_055692) c3(4935) c4(31049, 44106, 57163, 17992, 70220) c5(aA, aV, b, dA); #c1(HEMGN) c2(XP_011517148) c3(4936) c4(31050, 44107, 57164, 17993, 70221) c5(h, Nq, J, Ns, MK, iv, at); #c1(HEPACAM) c2(NP_689935) c3(4937) c4(31051, 44108, 57165, 17994, 70222) c5(bHz, BO, nU, E, b, cJ, iR, f, dB, q, cz, bHy, jo, w, aPu, ff, i, fx, bHA, u, y); #c1(HEPH) c2(NP_001124332) c3(4938) c4(31052, 44109, 57166, 17995, 70223) c5(yK, V, sG, yO, alx, yM, z, U, pq); #c1(HEPN1) c2(NP_001032647) c3(4939) c4(31053, 44110, 57167, 17996, 70224) c5(yE, q, OV); #c1(HERC1) c2(NP_003913) c3(4940) c4(31054, 44111, 57168, 17997, 70225) c5(nU, agw); #c1(HERC2) c2(NP_004658) c3(4941) c4(31055, 44112, 57169, 17998, 70226) c5(jH, aX, bHD, bHB, nU, cV, gY, bHE, bHC, agw, fP, ic, rv, cy, aE); #c1(HERC3) c2(NP_001258531) c3(4942) c4(31056, 44113, 57170, 17999, 70227) c5(bm); #c1(HERC5) c2(NP_057407) c3(4943) c4(31057, 44114, 57171, 18000, 70228) c5(en, BL, ht, J, P, aAM, cy, eG); #c1(HERC6) c2(NP_001158608) c3(4944) c4(31058, 44115, 57172, 18001, 70229) c5(en); #c1(HERPOD1) c2(NP_001010989) c3(4945) c4(31059, 44116, 57173, 18002, 70230) c5(A, b, jz, oR, Iv, aW, jQ, t, f, tE, iR, J, G, eX, fx, jT, ac, eg, P, i, xf, ap); #c1(HES1) c2(NP_005515) c3(4946) c4(31060, 44117, 57174, 18003, 70231) c5(jp, by, A, aw, b, k, X, jq, gG, FL, hS, ahV, w, Iv, bW, axq, U, BQ, y, jR, co, aX, jd, h, B, axr, q, cc, bu, cU, fr, iZ, ar, O, pt, bw, av, fy, u, aE, iT, cl, da, jB, fU, V, cV, ft, cs, Fs, ao, bp, gm, W, G, T, Qt, x, gC, J, ad, jG, fM, AI, jH, aH, Ty, bm, os, ag, oM, aA, bV); #c1(HES2) c2(XP_011539915) c3(4947) c4(31061, 44118, 57175, 18004, 70232) c5(cV); #c1(HES6) c2(NP_001136325) c3(4948) c4(31062, 44119, 57176, 18005, 70233) c5(QV, dj, pp, b, Fs, q, gv, T, O, cs, bh, u, XH, y, cl); #c1(HES7) c2(NP_001159439) c3(4949) c4(31063, 44120, 57177, 18006, 70234) c5(bga, AY, qt, bBo, bHE); #c1(HESX1) c2(NP_003856) c3(4950) c4(31064, 44121, 57178, 18007, 70235) c5(bBN, aC, acK, bHG, bHH, uH, yD, di, bHI, aeu, aA); #c1(HEXA) c2(NP_000511) c3(4951) c4(31065, 44122, 57179, 18008, 70236) c5(bHJ, LF, bDD, bHK, bj, O, awU, jT, ni, aYY, nU, kz, OA, asf, xy, em, si, aC, LG, v, dt, P, bDd, J, bN, kS, bDe, apR, bzo, aDH, bHL, bk, bM, atg); #c1(HEXB) c2(NP_000512) c3(4952) c4(31066, 44123, 57180, 18009, 70237) c5(aH, bHO, bHP, cy, ni, mI, aDH, LG, bDe, gv, aC, P, fl, bHM, awU, bh, OA, bHN, bHD, O, zD); #c1(HEXDC) c2(NP_775891) c3(4953) c4(31067, 44124, 57181, 18010, 70238) c5(awU, aDH, v, bDe); #c1(HEXIM1) c2(NP_006451) c3(4954) c4(31068, 44125, 57182, 18011, 70239) c5(AA, A, b, cV, h, B, IW, q, J, IR, IX, IS, jh, Au, QZ, oD, Fr, M, kg); #c1(HEY1) c2(NP_001035798) c3(4955) c4(31069, 44126, 57183, 18012, 70240) c5(apH, co, Tq, Wk, B, Fs, J, bp, dB, kB, w, di, jR, A, vE, Fr, gg, k, u, BQ, yG); #c1(HEY2) c2(NP_036391) c3(4956) c4(31070, 44127, 57184, 18013, 70241) c5(A, b, k, aVP, jq, xf, acH, bW, BQ, y, cr, tq, gB, ajW, aVQ, B, aq, tE, Nj, vF, gD, P, T, Mw, sK, rQ, hQ, acw, u, mx, Ol, at); #c1(HFE) c2(NP_000401) c3(4957) c4(31071, 44128, 57185, 18014, 70242) c5(dx, ml, aHH, dD, dB, aDq, hM, cO, baB, bf, eP, ps, O, gO, vr, dv, b, bbl, Vr, t, all, qU, sL, mR, bHX, fH, Zv, tC, bHS, n, mz, aJe, dK, alA, aC, du, yO, FC, fO, Ce, Gl, qt, hR, dL, mO, dH, eH, jE, aBy, bHG, bbH, fc, bm, pq, rJ, ag, cT, pv, bk, i, fN, bq, aA, wz, sU, bP, aEX, aVi, id, gE, Kt, fE, att, bGx, bHR, ig, qw, W, pK, rH, ex, y, rN, BL, VX, f, N, cs, vQ, bu, B, aNC, iv, av, pP, iT, QD, wK, Gr, V, ae, aub, v, afn, gv, eX, bt, tj, cK, pi, fJ, be, aDY, dO, aaa, kU, in, xe, aDL, gA, aGI, yM, fK, ci, aG, WH, aDX, am, qz, bla, m, A, adH, z, fD, aO, yK, Ag, qf, bh, Iz, Re, aiT, jd, Wk, q, jV, ap, re, ar, bGO, qT, pY, aE, o, fh, vD, aP, I, bc, dT, gL, ad, Rk, G, aZ, bHZ, GW, fu, ao, u, Ck, mA, uH, bHY, fg, ah, I, aU, Mp, aVh, fw, QU, uk, pF, k, eO, di, C, iL, eM, wf, kF, al, Bz, bj, U, oy, vH, aci, sG, h, M, tF, ik, oJ, aV, jZ, bHW, si, cV, bwU, aMK, mc, J, dt, P, T, II, hi, by, ac, aM, jT, bHT, ii, Y, xM, US, bHV, bh, at, oT); #c1(HFM1) c2(XP_011539154) c3(4958) c4(31072, 44129, 57186, 18015, 70243) c5(Lq, wU, fj, bnB, iu, b, rT, et, bib, ast, j, Dj, atj, II, Nh, blc, U, u, aE, y); #c1(HGD)

c2(NP_000178) c3(4959) c4(31073, 44130, 57187, 18016, 70244) c5(bP, em, be, jH, ni, gw, UG, bid, W, blf, ble, blg); #c1(HGFAC) c2(NP_001519) c3(4960) c4(31074, 44131, 57188, 18017, 70245) c5(A, iy, vR, X, re, B, dB, q, fO, gm, cU, ag, w, T, ar, iA, bw, av, EG, iT, amq); #c1(HGF) c2(NP_000592) c3(4961) c4(31075, 44132, 57189, 18018, 70246) c5(dx, gK, dM, pV, Io, dN, bx, md, EM, gG, dB, sJ, w, vl, cO, baB, aw, ra, O, gO, cU, dv, iy, bjP, Hj, e, iT, mR, cl, fH, Hs, gl, oP, g, xc, fe, asQ, aBE, kJ, du, fO, gm, bp, ft, rQ, jB, hU, fx, hR, dL, gg, acH, Bi, ata, fy, jM, dS, fN, YA, OJ, we, ag, oi, bk, i, RR, bg, aA, jl, bT, afd, Dr, is, wa, id, axq, wK, cY, kh, afY, vD, jz, eu, kB, fU, Ni, iG, bf, GV, bw, VJ, aVC, y, co, BL, pp, ml, f, IW, vQ, bu, tv, gX, B, cs, av, cp, bm, wY, fY, yJ, fi, SA, sB, V, Bu, jR, v, gv, Ih, brv, eX, bt, jC, iA, bvV, pi, fJ, be, W, dO, gt, py, zJ, fs, fw, add, gA, tl, T, re, II, bn, b, Y, blo, Hr, iD, at, vY, Bh, ic, z, ey, ba, fD, d, bh, eA, xa, bX, hV, PA, q, jV, ND, X, OC, ar, ff, jG, aM, u, dh, fh, bU, iP, aEf, jE, l, qL, LR, j, ad, blk, Sq, aZ, aC, aYw, et, Ut, jU, yG, cW, jH, ao, nV, Eu, ch, Bt, blh, Dj, agb, gd, aFi, aqq, I, di, Mp, cK, C, bL, ji, A, pF, k, fr, pR, bll, aKd, HJ, mW, QV, jc, og, ds, Iv, eO, wf, KT, bli, sx, U, jx, oy, m, qs, aso, LS, il, vR, bj, h, F, cc, bjp, HY, Vr, ik, aE, qB, fP, jQ, fk, ma, si, cV, mc, J, bln, dt, jo, Ql, asO, bol, Oi, aX, blj, by, ac, qT, jT, Lc, js, blm, LQ, Jh, Ic, Fl, zM, uG, so, Sv, bh, ap, eG, gf); #c1(116111) c2(NP_057542) c3(4962) c4(31076, 44133, 57190, 18019, 70247) c5(cf, aw, Ry); #c1(HGS) c2(NP_004703) c3(4963) c4(31077, 44134, 57191, 18020, 70248) c5(dx, aw, b, EM, Ik, di, U, aW, dv, LI, ajW, MV, cM, cs, fH, le, V, cV, bK, du, W, P, Ql, vv, fJ, aY, dc); #c1(HGSNAT) c2(NP_689632) c3(4964) c4(31078, 44135, 57192, 18021, 70249) c5(agP, ald, v, kA); #c1 (HHAT) c2(NP_001164035) c3(4965) c4(31079, 44136, 57193, 18022, 70250) c5(B, b, w, bW, U, A, iK, aX, pp, kJ, h, f, Ns, tF, O, QJ, blp, V, cV, blg, bc, BC, BV, P, aPe, apU, hU, cT, brK, uE, brL); #c1(HHATL) c2(NP_065758) c3(4966) c4(31080, 44137, 57194, 18023, 70251) c5(f); #c1(HHEX) c2(NP_002720) c3(4967) c4(31081, 44138, 57195, 18024, 70252) c5(dx, ml, gk, bf, ey, y, awU, bQ, aQF, bDe, h, eX, mm, aV, u, aE, o, mz, Bd, kF, I, du, P, T, Ah, iA, aM, nV, fN, mA, fG, aA, at); #c1(HHIP) c2(NP_071920) c3(4968) c4(31082, 44139, 57196, 18025, 70253) c5(by, A, avX, b, Fc, ic, bw, bf, U, O, co, kJ, f, q, bu, ar, cs, DF, bm, jB, I, dA, gv, T, aZ, ad, aM, jH, bY, jR, ag, xr, cV, I, bh, aA); #c1(HHIPL1) c2(NP_001120730) c3(4969) c4(31083, 44140, 57197, 18026, 70254) c5(at); #c1(HHLA1) c2(NP_001138567) c3(4970) c4(31084, 44141, 57198, 18027, 70255) c5(HE); #c1(HHLA2) c2(NP_001269487) c3(4971) c4(31085, 44142, 57199, 18028, 70256) c5(bb); #c1(HIAT1) c2(XP_011540259) c3(4972) c4(31086, 44143, 57200, 18029, 70257) c5(o); #c1(HIBADH) c2(NP_689953) c3(4973) c4(31087, 44144, 57201, 18030, 70258) c5(et, SP, cO); #c1(HIBCH) c2(NP_055177) c3(4974) c4(31088, 44145, 57202, 18031, 70259) c5(blr, ake, dA); #c1(HIC1) c2(NP_001091672) c3(4975) c4(31089, 44146, 57203, 18032, 70260) c5(fr, A, aw, b, ji, X, jq, dB, jH, jV, kY, O, Dd, U, hP, e, y, d, jT, Tq, h, f, F, q, vQ, bu, Be, bh, cl, B, pt, fv, av, ZU, u, iT, R, qL, V, cV, lb, YR, jG, gm, fO, gv, W, T, bt, oM, J, ad, bq, Lt, DP, TY, QJ, hX, Tv, mb, aAV, Nq, jR, by, ag, Ns, fP, bis, Q, re); #c1(HIC2) c2(NP_055909) c3(4976) c4(31090, 44147, 57204, 18033, 70261) c5(m, mx, ahi); #c1(HID1) c2(NP_085133) c3(4977) c4(31091, 44148, 57205, 18034, 70262) c5(jw, Ap, u, y, b); #c1(HIF1A) c2(NP_001230013) c3(4978) c4(31092, 44149, 57206, 18035, 70263) c5(avO, dx, by, ml, aw, Io, aD, aiu, Vz, vB, HG, w, tH, cO, bf, O, Mn, e, bEx, aDo, dv, LL, iR, pq, wL, eQ, iT, azu, ji, blx, ia, nB, wC, jC, du, bla, rR, g, mz, sE, BQ, cB, ado, aC, sH, Dt, gJ, jE, bp, avk, wM, cV, x, fx, jT, vG, gg, dH, apG, wh, fy, qt, CB, sg, Yw, Nv, bte, blv, ag, mx, qP, bk, i, fN, bq, aA, jl, bT, Dr, wa, id, Kt, fO, iF, cY, iP, eu, jd, rd, kB, ma, kY, IW, GV, bw, U, Co, y, tp, co, pB, ave, ip, yE, ml, f, cT, bu, gX, B, cs, fB, av, JD, bm, fY, yJ, em, IT, AU, V, ok, hf, Bs, v, afn, gv, IR, Ih, YS, buO, xd, uu, VP, cy, iA, pi, fJ, fU, JY, gW, aH, aJV, anG, uJ, vZ, eA, P, fw, cK, kJ, gA, yM, cf, zS, iu, ap, b, aE, Qt, vY, oi, ic, Fr, IO, ey, bah, gF, Mr, aDf, hh, jh, bh, aiT, MX, re, hV, q, jV, nF, pn, mL, dQ, ff, hb, Yr, ar, jG, HL, u, dh, fh, yG, pS, fs, I, qL, bAC, aza, gL, ad, wF, IX, IJ, sf, Yi, aZ, fH, ct, aeC, Mw, et, jU, aeo, Kc, fv, nV, Eu, ig, fD, ch, aFa, iY, Du, gC, sh, gd, agf, Cv, IS, OI, zJ, I, ds, Mp, af, bL, blo, A, d, iL, k, fr, pR, BY, og, avn, jR, JC, blu, wf, sx, yw, aW, oy, RX, Ez, LS, il, hP, h, F, akl, cU, tF, ik, oJ, pN, Jk, fP, aV, HI, aAq, ax, gO, nQ, uD, Be, sj, dB, J, W, dU, jo, T, blt, fi, Oi, aX, di, ft, fM, aM, blw, mb, hq, yC, aGB, bFf, zM, j, Af, E, rw, bh, X, at, ja, iE, gl); #c1(HIF1AN) c2(NP_060372) c3(4979) c4(31093, 44150, 57207, 18036, 70264) c5(A, dn, py, dB, w, T, i, l, at, o); #c1(HIF3A) c2(NP_690007) c3(4980) c4(31094, 44151, 57208, 18037, 70265) c5(f, dB, q, eu, bm, iE); #c1(HIGD1A) c2(NP_001093138) c3(4981) c4(31095, 44152, 57209, 18038, 70266) c5(re, f, fl, iT); #c1(HIGD1C) c2(NP_001103089) c3(4982) c4(31096, 44153, 57210, 18039, 70267) c5(I); #c1(HIGD2A) c2(NP_620175) c3(4983) c4(31097, 44154, 57211, 18040, 70268) c5(bm); #c1(HILPDA) c2(NP_001092256) c3(4984) c4(31098, 44155, 57212, 18041, 70269) c5(yK, V, b, fN, re, dB, w, T, so, fD, U, bly, pR, iT, ff); #c1(HINFP) c2(NP_001230188) c3(4985) c4(31099, 44156, 57213, 18042, 70270) c5(A, aKV); #c1(HINT1) c2(NP_005331) c3(4986) c4(31100, 44157, 57214, 18043, 70271) c5(bhn, bm, GL, aq, q, xo, bu, cb, cH, n, iL, gE, oD, by, aqp); #c1(HINT2) c2(NP_15982) c3(4987) c4(31101, 44158, 57215, 18044, 70272) c5(g, o, eu); #c1(HIP1) c2(NP_001230127) c3(4988) c4(31102, 44159, 57216, 18045, 70273) c5(A, aw, b, hS, m, nU, q, B, cs, fy, u, si, bK, blz, gm, cz, ad, T, rT, x, jT, hX); #c1(HIP1R) c2(NP_003950) c3(4989) c4(31103, 44160, 57217, 18046, 70274) c5(GJ, b, byU, oB, ak, ns, cT, nm, nt, nq, nr, nn, no, np, bj); #c1(HIPK1) c2(XP_011539282) c3(4990) c4(31104, 44161, 57218, 18047, 70275) c5(U, f, V, b); #c1(HIPK2) c2(NP_001106710) c3(4991) c4(31105, 44162, 57219, 18048, 70276) c5(hV, b, k, X, gw, HG, U, y, h, f, q, ra, RF, cs, pB, av, Hs, u, n, V, I, cV, Ib, J, ad, P, et, et, Bi, nV, fl, ci); #c1(HIPK3) c2(NP_001265092) c3(4992) c4(31106, 44163, 57220, 18049, 70277) c5(do, A, Iv, I); #c1(HIRA) c2(NP_003316) c3(4993) c4(31107, 44164, 57221, 18050, 70278) c5(l, bwl, MP, K, afb, gF); #c1 (HIRIP3) c2(NP_003600) c3(4994) c4(31108, 44165, 57222, 18051, 70279) c5(cz); #c1(HIST1H1A) c2(NP_005316) c3(4995) c4(31109, 44166, 57223, 18052, 70280) c5(bIA); #c1(HIST1H1B) c2(NP_005313) c3(4996) c4(31110, 44167, 57224, 18053, 70281) c5(m, C, gE); #c1(HIST1H1C) c2(NP_005310) c3(4997) c4(31111, 44168, 57225, 18054, 70282) c5(bj, h, u, J); #c1 (HIST1H1D) c2(NP_005311) c3(4998) c4(31112, 44169, 57226, 18055, 70283) c5(xr); #c1(HIST1H1E) c2(NP_005312) c3(4999) c4(31113, 44170, 57227, 18056, 70284) c5(rb); #c1(HIST1H1T) c2(NP_005314) c3(5000) c4(31114, 44171, 57228, 18057, 70285) c5(oy, J); #c1 (HIST1H2AE) c2(NP_066390) c3(5001) c4(31115, 44172, 57229, 18058, 70286) c5(cT); #c1(HIST1H2AH) c2(NP_542163) c3(5002) c4(31116, 44173, 57230, 18059, 70287) c5(LR); #c1(HIST1H2BG) c2(NP_003509) c3(5003) c4(31117, 44174, 57231, 18060, 70288) c5(A); #c1(HIST1H2BH) c2(NP_003515) c3(5004) c4(31118, 44175, 57232, 18061, 70289) c5(bb); #c1(HIST1H2BM)

c2(NP_003512) c3(5005) c4(31119, 44176, 57233, 18062, 70290) c5(jh, u, y); #c1(HIST1H3G) c2(NP_003525) c3(5006) c4(31120, 44177, 57234, 18063, 70291) c5(w, O); #c1(HIST1H4D) c2(NP_003530) c3(5007) c4(31121, 44178, 57235, 18064, 70292) c5(d, jh, fU, aX, V, b, m, e, g, j, fp, rO, jG, fy, Qx, O); #c1(HIST3H3) c2(NP_003484) c3(5008) c4(31122, 44179, 57236, 18065, 70293) c5(nU, A, dA); #c1(HIVEP1) c2(XP_011512855) c3(5009) c4(31123, 44180, 57237, 18066, 70294) c5(Ge, A, bb, b, Gf, xl, u, y); #c1(HIVEP2) c2(NP_006725) c3(5010) c4(31124, 44181, 57238, 18067, 70295) c5(bj, at, u, y); #c1(HJURP) c2(NP_001269891) c3(5011) c4(31125, 44182, 57239, 18068, 70296) c5(fl, u, y); #c1(HK1) c2(NP_000179) c3(5012) c4(31126, 44183, 57240, 18069, 70297) c5(IJ, B, b, w, yn, bID, A, O, qZ, qf, co, aX, ae, bIC, f, jV, bu, mg, zb, fy, bIB, g, fs, l, bK, nW, be, VX, by, bp, pq, ch, AC, aU, aA, at, eG); #c1(HK2) c2(NP_000180) c3(5013) c4(31127, 44184, 57241, 18070, 70298) c5(A, aw, b, X, gG, dB, w, cO, bf, BQ, y, co, aX, bw, ja, B, q, O, cs, lg, av, u, g, mz, ez, l, cV, bp, ad, T, x, gF, aM, anG, bm, ag, Ez, aA, at); #c1(HK3) c2(NP_002106) c3(5014) c4(31128, 44185, 57242, 18071, 70299) c5(h, jV, z); #c1(HKDC1) c2(NP_079406) c3(5015) c4(31129, 44186, 57243, 18072, 70300) c5(co, b, cV); #c1(HLA-A) c2(NP_001229687) c3(5016) c4(31130, 44187, 57244, 18073, 70301) c5(en, aHH, dB, aPi, hM, aEK, e, gM, dl, zb, fe, aC, Xn, ft, pq, jE, aei, DO, ag, axC, fD, X, arQ, eu, ig, bIG, bw, vl, kV, yX, aZX, ps, Dq, bIQ, FG, fy, bIJ, Bm, is, fi, V, ae, nl, cd, bAH, jC, J, fJ, pk, xe, wl, TA, aFl, ck, aM, HQ, bIS, tg, aos, aE, da, il, Mi, gL, ad, bIF, rB, eV, axA, mA, fr, Jo, gn, gN, jc, C, iL, gE, PI, bIT, jQ, m, xT, ox, qB, Jk, wF, bdj, be, bd, bIU, bIN, Jh, fP, hz, aDQ, iU, bW, O, bQ, AX, aoQ, Zv, yO, gm, bp, auf, x, aCP, fp, Lz, BX, fc, bT, sU, bP, fl, Ps, mk, ix, ur, U, co, bIP, bu, aaZ, iJ, yV, gv, akT, ny, Hh, qH, nb, aUZ, WH, qz, IS, d, bb, jd, vj, q, zm, bGE, o, kF, LR, rw, aZ, bll, jH, rQ, bBt, EI, aaM, OI, fl, TQ, lk, pD, pw, aI, aW, bbE, azx, cB, aq, ax, T, ll, nk, eD, iB, bM, JH, Zq, Ka, iq, fR, bIR, bIL, bsI, aDx, fH, g, fO, vM, gg, aDJ, rS, bY, cT, rn, EO, bla, cY, jz, bBu, bf, bab, rN, Ei, RD, B, iv, OA, iT, aVi, wA, gC, JY, iz, aNw, iu, ach, b, awg, bIH, bIM, re, as, wp, ir, Dg, cz, jr, et, jM, hU, Ck, acF, WP, IA, aMI, XI, mW, aZS, lv, eM, abe, gT, ik, dl, bFX, UR, aX, qT, Rd, ajv, abf, gu, Yv, Ez, at, eG, pV, bx, aGV, gE, aiW, eC, Zs, sJ, w, cO, yi, wk, aXC, cy, t, bsr, gI, sH, tz, gY, od, qt, jT, dH, xO, i, bIO, Kt, Kc, IW, y, lw, Em, cs, bm, aem, aCK, aDY, wu, dP, aDL, oj, gA, lm, apD, kE, anb, yU, ic, Df, jD, yK, bIE, es, se, ar, atT, jG, u, nj, sQ, l, qA, by, G, aFj, lo, vw, yG, eQ, aDT, CV, bsk, azt, A, OB, Sc, c, jl, fq, h, F, M, aV, jZ, aFc, fU, cV, hZ, GB, P, bIK, j, BL, sK, bwW, QJ, bh, mo, oT); #c1(HLA-B) c2(NP_005505) c3(5017) c4(31131, 44188, 57245, 18074, 70302) c5(jl, by, en, pV, aZ, WH, ig, qE, aiW, iU, JH, Ka, eW, sJ, w, hM, aEK, cO, aw, fR, bu, bIL, e, O, gM, aXC, gC, cy, b, t, AX, aDx, ps, bsr, Li, aHH, bh, gP, aMq, se, et, azx, Zv, gl, wk, TP, g, og, aCP, jH, aC, cu, ft, afh, yO, gm, tz, gY, Lz, yi, xO, aPi, aVi, vM, aZS, fx, jT, gg, pq, aDJ, LW, azW, BX, aJI, aei, ax, bY, rS, cT, axC, avb, i, dn, aFc, bT, rn, sU, bP, rN, id, gE, Kt, fO, cY, Df, jz, vl, mk, fU, bCB, bIG, cA, bw, U, y, V, bIR, BL, aZX, eD, Dq, f, IW, cs, pf, bIQ, bO, B, iv, av, CX, bIJ, iT, acF, arM, d, Zs, yV, ae, eE, bx, nl, cd, IR, akT, ix, bAH, ny, wA, Hh, qH, aCK, pk, nb, sK, aMQ, iz, xS, Oa, aUZ, oj, gA, bsl, T, wl, bIY, iu, re, ap, aFl, asL, ach, bW, kE, uS, zH, qz, bla, m, fl, yU, ic, FG, aMI, ey, jQ, IS, aYA, HQ, yK, dl, aem, lz, aiT, vj, Tp, bIE, q, jD, bIS, X, lm, ar, tg, as, bf, yW, qT, u, aE, ri, cl, da, PJ, bU, Jo, sQ, I, im, ir, Dg, LR, gL, cz, bIX, bIF, rw, pD, rB, jr, vw, jM, bll, afj, jG, bIW, yG, bJa, Kc, ao, rQ, eV, hS, fD, aos, eQ, bIV, mA, aDT, EI, aaM, Bm, OI, fl, Mp, bp, alg, Ku, azt, A, vp, OB, gU, fr, lk, gn, gN, Rd, axA, aJm, Iv, iL, eM, PI, al, xe, yw, aW, lo, c, MT, bIZ, abe, il, aQk, fq, h, ox, aWi, M, ik, Em, qB, Jk, fP, bFX, aV, jZ, NO, Ps, ht, hW, cV, be, dB, J, dt, bIU, P, ti, bIK, II, hM, aX, Pk, aM, nk, bwW, acg, ajv, gu, j, jh, iB, XO, at, eG, rr, hz); #c1(HLA-C) c2(NP_001229971) c3(5018) c4(31132, 44189, 57246, 18075, 70303) c5(bJg, pV, lo, bx, qE, dB, bJf, Ka, Zs, sJ, w, aEK, et, aw, fR, pf, e, O, gM, jI, cy, t, AX, dl, gP, IV, Zv, gl, n, g, og, aC, sH, gm, fO, gY, vM, aCP, jT, aMw, azW, rS, bm, bY, aFX, axC, iT, fD, aA, bJb, rn, Dr, Kt, X, Df, Kc, mk, ix, bf, cA, bw, vl, yi, Dq, jC, bu, bIQ, iv, pP, uO, V, nl, byO, gv, bAH, ny, aGa, Hh, aZD, aCK, bJc, pk, nb, xe, oj, gA, lm, iu, aG, b, qz, yU, ic, awg, z, eV, HQ, d, aem, re, hV, q, dW, jD, se, tg, as, bJd, u, nj, da, I, im, ht, gL, cz, bIF, vS, mW, rB, auA, bll, jG, JH, bJa, jH, nV, ig, eQ, gC, Bm, fl, azt, aMI, iL, gU, Ik, gn, gN, bJe, gE, PI, al, Bz, m, bIZ, abe, VD, h, ox, M, ik, aE, qB, Jk, fP, bFX, aV, jZ, Ps, qJ, hW, cV, J, bIU, P, bIK, II, aX, by, aM, nk, eG, byr, gu, j, aBz, iB, bh, at, T); #c1(HLA-DMA) c2(NP_006111) c3(5019) c4(31133, 44190, 57247, 18076, 70304) c5(fl, b, qd, sJ, SB, bf, ey, jD, O, m, Pk, fm, cl, aV, iR, gl, da, bJh, I, aC, wE, j, gv, alf, P, ei, aM, mz, bh); #c1(HLA-DMB) c2(NP_002109) c3(5020) c4(31134, 44191, 57248, 18077, 70305) c5(fl, gd, X, sJ, bf, ey, m, fm, aV, gl, da, bJh, I, aC, wE, j, ei, alf, P, Jc, Pk, aM, mz, aE); #c1(HLA-DOA) c2(NP_002110) c3(5021) c4(31135, 44192, 57249, 18078, 70306) c5(da, id, pV, hW, b, X, dB, ig, xO, bCB, iL, z, aw, re, yw, y, m, aX, fq, h, cs, bu, Em, Dd, aMq, qB, bf, av, aV, u, aE, iT, arM, nI, yV, aC, afh, fO, by, ti, cy, fx, afj, yW, aM, LW, aMQ, bY, cT, bO, i, iB, iu, bT, lv); #c1(HLA-DOB) c2(NP_002111) c3(5022) c4(31136, 44193, 57250, 18079, 70307) c5(da, m, fO, ix, Bm, u, aE, y); #c1(HLA-DPA1) c2(NP_001229454) c3(5023) c4(31137, 44194, 57251, 18080, 70308) c5(hV, vk, Xl, tN, adJ, iL, cK, m, aX, gB, jZ, nI, yV, I, Dg, sH, be, Xn, j, P, T, bAH, cy, et, dH, akT, aE); #c1(HLA-DPB1) c2(NP_002112) c3(5024) c4(31138, 44195, 57252, 18081, 70309) c5(mI, JH, aZ, iU, Zs, sJ, w, bf, Na, kE, cy, b, t, AX, aDx, yh, dl, fH, jM, biz, oN, aC, Xn, bEk, aea, JT, vM, fx, jT, dH, aZS, fc, bY, uc, cT, axC, i, bT, fl, fO, bJk, ig, ix, ur, IW, bJj, vl, kV, m, rY, fm, Dq, eV, iv, gg, pP, bIJ, iT, cj, yV, nl, gv, aR, bAH, wA, cl, fJ, aUZ, oj, iu, ci, ach, adJ, rD, uS, qz, tN, NU, z, aYA, bb, aDr, re, q, oO, jG, sK, u, bzf, da, Dg, TK, vk, nd, as, G, rB, jr, JI, jH, hX, aE, ws, cK, qd, XI, D, iL, gE, wf, aHd, bJi, qs, aso, aX, aCU, h, ox, M, n, lo, aV, jZ, NO, Ps, ax, Eg, Hh, be, J, W, P, T, j, pw, aM, nk, ii, LQ, Jh, gu, fP, iB, bh, eG, oT); #c1(HLA-DQA1) c2(NP_002113) c3(5025) c4(31139, 44196, 57253, 18082, 70310) c5(dx, by, ml, pV, Ny, iU, sA, eC, sJ, bn, aEK, vk, fR, eD, e, gM, cy, Pn, JI, dl, do, mR, qM, iz, bze, jH, Ib, yL, du, Xn, bpw, gY, JT, vM, jT, kN, awY, dH, Iq, QJ, aei, bm, bY, aFX, Hf, aEL, fc, axC, bk, fD, bq, Jn, bT, rn, gE, X, aHb, bJI, ig, bf, Lr, sN, Jo, y, yV, co, BL, fm, Dg, bu, vo, mm, pP, bIJ, V, jh, yY, nI, cd, akT, Jc, bAH, bt, gC, qH, JY, pk, wu, P, xe, aDL, oj, gA, ji, iu, Dg, ach, afE, tN, yU, sU, z, IS, eV, HQ, d, eE, wZ, aem, sH, bIM, re, hV, bIE, q, jV, ar, ff, tg, yW, u, aE, da, Id, aDu, sQ, I, adJ, kt, gL, gn, rB, JJ, et, Wz, Kc, wV, jM, mA, gl, wP, Bm, bHr, cK, Xm, HD, Ik, XI, gN, di, iL, eM, wf, PI, al, bj, vH, aX, fq, M, aC, hN, azx, qB, aYC, aV, jZ, Yb, ax, adK, m, be, xS, J, axl, T, j, pw, Pk, aM, nk, ce, Jh, tA, gu, fP, iB, bh, eG); #c1(HLA-DQA2) c2(NP_064440) c3(5026) c4(31140, 44197, 57254, 18083, 70311) c5(ml, pV, lk, bJI, ig, afE, nl, z, bf, al, y, jh, jT, aX, bIM, bJm, re, bu, cd, do, bn, ar, aE, JI, qB, kN, aV, u, jZ, iT, bk, da, ld, pw, ax, adK, yV, I, Iq, aC, yY, be, JY, by, JT, Jc, bAH, bt, ji, cy, qH, Wz, awY, aM, eC, pk, wu, ce, fc, Jh, QJ, Hf, m, j, Bm, iB, bh, iu); #c1(HLA-DQB1) c2(NP_001230890) c3(5027) c4(31141, 44198, 57255, 18084, 70312) c5(dx, by, ml, pV, aZ, WH, qE, oz, iU, aE, Ka, eC, aHc, sJ, aaY, hM, aEK, Eh, aw, fR, yi, wk, aDx, O, gM, M, cy, bJu, bJm, t, AX, bJo, yh, Pn, iT, dl, azc, bh, mR, gM, aMq, Dc, IV, Zv, bze, TP, g, mz, bJr, Fx, bzf, mm, aC, yL, du, Xn, bpw, avb, dB, bv, xO, e, vM, adJ, aCP, fx, jT, gg, dH, ws, LW, qt, gC, sS, aei, bm, pq, DO, aV, Hf, aEL, iV, cT, NU, bk, i, bJn, bT, rn, bP, id, gE, Kt, fO, kN, X, aHb, Lz, bY, Kc, ig, fU, ur, bCB, bIG, Lr, vl, sN, y, V, m, Jk, BL, fm, bJt, aZX, ml, axC, bu, aaZ, fD, cs, vo, oD, av, pP, bIJ, aFZ, wP, arM, yV, ae, jh, bx, nl, cd, gv, bJq, akT, ix, bAH, ar, Hh, bd, qH, aRS, rS, aCK, en, pk, wu, eF, dP, aMQ, iz, er, P, dY, aDL, Yb, gA, T, apD, iu, fW, Dg, aFl, vf, ach, afE, b, ami, Pv, qz, ajW, bg, wn, tN, fl, yU, ic, DX, z, hr, aMI, re, aGX, vk, HQ, d, eE, wZ, aem, sH, fv, jd, vj, hV, q, jD, bIS, NJ, se, bJp, ff, tg, fG, bf, yW, JY, u, dh, da, aDu, I, im, ir, kt, gL, gn, nd, bIF, jG, aFj, rB, JJ, bll, et, bJs, jU, yG, jH, wV, jM, eV, uc, Bu, Ck, mA, xU, na, kC, bO, Ny, Bm, bHr, bg, aZU, cK, Iv, gD, vp, akn, aDI, aeS, HD, lk, XI, gN, Rd, di, tA, iL, eM, wf, Pl, al, yw, aW, vH, aX, or, oj, bn, fq, h, do, lr, Em, qB, aYC, fP, alb, IV, jZ, CH, NO, Ps, ax, ez, mD, Jl, be, xS, J, ei, bIU, axl, ti, bIK, II, bM, jl, Jc, Pk, gl, aM, eJ, nk, ce, bnn, bIV, ck, MU, Jh, MP, ajv, vW, j, aBz, iB, tk, bX, at, eG, Dq, hz, as); #c1(HLA-DQB2) c2(NP_001185787) c3(5028) c4(31142, 44199, 57256, 18085, 70313) c5(ml, aw, qE, oz, iU, eC, bJo, sJ, Eh, bf, yi, wk, e, cy, bJm, AX, aDx, yh, Pn, JI, azc, mR, bze, TP, mz, bJr, aC, xO, Lz, akn, aHc, sS, DO, bY, Hf, aEL, cT, bk, mD, bT, bP, fl, Kt, ig, ix, vl, sN, y, ml, bu, kN, iT, yV, bJg, Jc, bAH, aRS, JY, pk, dP, dY, fG, oj, aDI, iu, WH, afE, b, ami, tN, NU, hr, d, jh, fv, jd, re, g, NJ, se, bJp, ar, yW, u, aE, da, l, im, ir, j, by, aFj, lo, bJs, mA, xU, bJt, aZU, aMI, iL, Pl, al, lr, m, aX, fq, ox, aV, IV, jZ, Yb, NO, ax, ez, ei, P, do, II, aM, ce, Jh, Rd, ajv, fP, iB, bM, at, eG, hz); #c1(HLA-DRA) c2(NP_061984) c3(5029) c4(31143, 44200, 57257, 18086, 70314) c5(pM, fl, Xl, wn, sJ, bj, HQ, m, cy, q, dl, aV, aE, o, V, I, aC, sX, Xn, j, P, ti, aFj, jH, fy, ig, MP, Bm, iB, Im); #c1(HLA-DRB1) c2(NP_001230894) c3(5030) c4(31144, 44201, 57258, 18087, 70315) c5(ml, dB, aPi, lp, aHc, en, hM, aEK, JH, bu, e, gM, jD, Pn, dl, mR, zb, TP, bJr, aC, Xn, bpw, ME, aye, Vv, JN, kN, awY, pq, Iq, azW, aJI, aei, Di, axC, fD, acM, bq, aA, Dr, mZ, wJ, bJh, X, jj, ig, bIG, Lr, vl, rY, fm, DG, aZX, ps, Dq, eX, vo, av, bIJ, bJx, aBv, V, ae, nl, cd, IR, bAH, J, fJ, pk, anB, dY, xe, abs, wl, ap, afE, bJw, tB, Hh, aMI, aGX, LP, HQ, jh, vC, ajW, bIS, tg, bJE, aos, dh, qM, da, adK, RK, oK, gL, bIF, rB, fH, iw, wV, nV, awH, mA, zX, CL, bHr, BK, zD, gD, Jo, gn, gN, bci, C, iL, gE, Pl, jw, bIT, jQ, m, xT, bs, or, aQk, tL, aDQ, bK, qB, Jk, aeS, NO, Ps, be, bd, bIU, axl, Pk, bJP, bnn, mb, fP, tk, aiX, hz, dx, dM, vk, ox, iU, Pf, bf, eP, O, bQ, AX, yh, aMw, IV, Zv, og, du, yO, gm, sV, vx, aCP, ahX, aZS, aZg, bJB, sN, Yb, bT, sU, bP, fl, mk, ix, ur, aTF, bJD, co, BL, aoR, f, uB, aaZ, ky, UM, aFZ, wP, vi, yV, NZ, gv, akT, ny, cl, qH, qD, nb, eF, aUZ, hr, aln, WH, aJm, Pv, qz, atU, wn, z, hr, IS, aYA, d, bb, eA, jd, vj, q, CO, zm, ff, yW, gT, o, ld, kF, kt, LR, aZ, bll, apl, jU, gU, bJC, aAs, uc, xU, EI, gd, aaM, Xm, Jh, gd, HD, Ik, eO, al, Ld, bJi, bbE, bJz, bn, jk, aWi, hN, azx, bJy, ax, ez, aMH, gV, dt, T, II, bi, ya, by, nk, ii, vW, iB, bM, rr, IJ, aw, lo, dN, oz, DT, Ka, eW, aaY, Eh, avb, fR, bIR, eD, bJR, bJu, aDx, bJJ, eE, aMq, aD, kX, g, Ph, jH, bJF, po, fO, Qw, vM, FG, OR, rS, bY, cT, rn, wK, asm, bJA, jz, aer, ws, vp, bah, NW, Ei, RD, na, ml, B, iv, bv, oD, gg, iT, rN, wA, gC, JY, aum, iz, aYE, uK, iu, aFo, ach, bW, b, ami, bg, tN, NU, DX, wZ, aem, aiT, zc, re, hV, do, NJ, aFr, ri, wp, ir, Dg, cz, nd, IX, IJ, JJ, et, bJs, Lt, cW, jM, hU, acN, bJH, ex, kC, IS, Bm, D, Pb, bJM, XI, mW, axA, eM, wf, qs, sG, ik, aW, bzq, bFX, yd, bJK, ei, bJG, ti, aea, bJQ, bJO, jl, aM, ale, Rd, tA, at, eG, pV, bx, qE, aE, eC, Zs, sJ, w, cO, yi, wk, Na, aXC, cy, t, aZv, bsr, aVV, azc, blz, gl, Fx, UQ, sH, tz, gY, Lz, xO, qt, jT, dH, alb, jZ, aFX, Hf, aeR, fc, bJn, Jn, id, Kt, aHb, Kc, hS, IW, Co, y, awl, vQ, Em, aFL, mm, brt, bm, pr, bJN, Jc, cK, aCK, wu, dP, aLL, er, aDL, oj, gA, lm, apD, ci, vf, aOR, yU, ic, ey, eV, lz, zJ, iW, bIE, jV, acO, se, ar, atT, jG, u, nj, wR, PJ, sQ, I, im, TK, bJL, G, aFj, aYz, vw, Wz, yG, eQ, bwW, ov, bJt, azt, bL, A, OB, di, bJv, c, aX, fq, h, M, n, aV, aiU, aFc, fU, Eg, GB, P, IC, bIK, j, XO, pw, gF, ge, aGc, acF, bIV, ck, MU, qJ, bJI, bh, aT, LQ, oT); #c1(HLA-DRB3) c2(NP_072049) c3(5031) c4(31145, 44202, 57259, 18088, 70316) c5(bg, ig, sJ, DX, gE, Eh, O, m, qs, Ei, DG, do, aaZ, Em, tg, jG, aos, aE, g, ax, be, cd, bIU, P, dH, jH, bY, gA, bh, aA, iu); #c1(HLA-DRB4) c2(NP_068818) c3(5032) c4(31146, 44203, 57260, 18089, 70317) c5(dx, IJ, ml, pV, aGV, oz, iU, jw, eC, aHc, sJ, w, hC, Eh, aw, Kc, bu, ps, e, O, gM, fm, bQ, cy, b, bbl, t, AX, bJq, Li, do, Pv, Dd, jM, blz, gl, TP, mz, fe, jH, aC, bK, afh, aB, gm, avb, ft, Lz, aZS, jT, bJT, dH, xO, azW, OR, bJB, UR, mB, Fr, bY, sN, hX, cT, axC, pv, i, aKG, jC, jI, aRQ, bT, fl, fO, X, bJV, wy, bJI, ig, fU, bIG, bkc, U, kV, y, V, bC, co, bIP, RD, pp, bJn, f, vQ, pf, aFL, cs, av, iT, d, yV, ae, nl, cd, gv, dv, aR, bt, aZA, wA, cl, pi, en, du, wp, dP, P, xe, Xn, oj, og, bkt, tl, lm, qB, aln, ach, hV, uS, ami, aF, MU, bg, tN, DX, z, kF, IO, jD, HQ, yK, Ap, re, gz, q, ff, tg, as, bf, yW, u, aE, da, bU, bbv, Zz, l, im, ir, Dg, j, cz, nd, IJ, jG, jr, bll, et, JI, JH, yG, yi, iw, afj, aos, eQ, mA, gC, ix, Bm, bbA, zD, Pb, k, fr, HD, gE, bJS, XI, mW, bJW, IE, pw, di, C, iL, eM, PI, al, vl, m, bbE, bdr, il, h, F, akl, M, ik, ol, aV, aq, jZ, Yb, ax, ez, cV, yO, be, dB, J, dt, bIU, jo, ti, T, II, aX, Pk, aM, nk, ce, iu, Jh, G, ajv, by, aYl, fP, bJU, aBz, iB, bh, at, eG); #c1(HLA-DRB5) c2(NP_002116) c3(5033) c4(31147, 44204, 57261, 18090, 70318) c5(ach, en, aw, b, Pv, oz, jz, XI, Ka, bg, mk, sJ, aaY, iL, z, bf, al, xe, bj, vl, O, V, ml, m, wZ, yi, cy, pp, re, cd, do, aFr, jQ, zb, tg, zQ, aV, aE, iT, TP, da, bJr, ax, yV, ae, jH, aC, Xn, jG, dB, gm, j, iU, bIU, P, ll, cl, by, et, Jl, dH, Kc, yG, nk, dP, ig, fc, MU, Jh, er, bY, mA, sS, aeR, oj, NU, bJU, Yb, bJn, gE, iu, bT, bAH); #c1(HLA-E) c2(NP_005507) c3(5034) c4(31148, 44205, 57262, 18091, 70319) c5(dx, by, mI, pV, F, aiW, iU, ns, Ty, sJ, nm, nt, hg, nr, nn, aw, no, np, eD, fx, xl, fJ, fl, dv, cy, aAo, bbl, t, e, iT, do, Em, mR, cl, aMq, Dc, fH, jG, du, gl, TP, cW, oz, bfU, Pw, C, sH, afh, yO, gm, fO, ft, bzB, Lz, yi, xO, sK, cV, oD, x, qt, bJY, jT, zQ, dH, aUO, LW, aZS, gC, wi, bJB, LR, sS, DO, bY, baC, tO, fc, IN, w, bk, i, dc, hM, aA, jl, hx, rn, nq, mZ, rN, id, Kt, X, dE, jz, eu, awV, oH, mk, fU, bCB, axH, vp, bw, U, Jo, fR, cM, V, m, co, rY, pp, ps, DM, f, axC, cT, vQ, bu, pw, aaZ, aFL, B, cs, cz, UM, av, fy, bm, Mn, Bm, arM, aBv, bKb, yV, ae, jh, yY, nl, bcL, pr, ix, bAH, bt, bq, iy, k, pi, rS, PJ, d, en, xe, pk, wu, dP, aMQ, iz, Oa, P, nJ, vl, alh, gA, tl, abE, lm, iu, bX, TA, aln, fn, WH, ck, b, dB, ak, qz, bg, tN, BL, aAb, aMI, zL, re, IS, eV, TH, yK, ec, zJ, vC, oB, asx, g, jV, ap, kr, dQ, bJX, as, ar, yW, qT, u, aE, ff, da, ld, axE, fs, VD, im, adJ, Dg, awD, bJZ, gL, ad, cO, G, jG, lo, HE, aeC, aCT, afj, JI, JH, bgu, bJI, jM, hU, ig, fD, iR, Yb, mA, xU, aY, kC, bO, fl, zO, CV, I, cK, WP, Ku, azt, bL, bzi, A, bf, xu, JS, fr, Mj, lk, Xl, mW, Rd, O, aGY, Jc, dY, iL, gE, Pl, al, bul, hP, JK, bT, jx, c, bKa, xT, abe, l, lq, lv, fq, h, ox, yw, M, aC, jQ, y, cB, gg, fP, aV, jZ, iq, jH, Ps, ax, qB, Eg, Xn, bkK, be, wE, J, asM, dt, bR, jo, ti, T, ll, qP, aX, gF, Pk, aM, DG, Jh, bV, QJ, aCO, j, IC, iB, od, at, Dq); #c1(HLA-F) c2(NP_001091948) c3(5035) c4(31149, 44206, 57263, 18092, 70320) c5(yK, jh, aOB, aX, b, m, re, yO, vQ, ix, P, ck, T, i, jr, od, fx, aV); #c1(HLA-G) c2(NP_002118) c3(5036) c4(31150, 44207, 57264, 18093, 70321) c5(aw, Gm, dB, sJ, w, e, O, cy, bsr, mR, fH, Zv, gD, ha, og, aC, sH, cs, fO, gm, bp, Yl, od, x, fx, jT, dH, qt, fc, tO, cT, axC, i, X, Kc, mk, ix, iG, VG, U, y, yV, co, f, vQ, bu, Em, iv, av, iT, V, ae, Cq, jG, fJ, P, dY, gA, JO, iu, ck, b, ic, d, re, g, ar, aJ, HE, iR, aE, da, tg, il, gL, ad, pF, lo, cW, jH, jM, ig, u, eQ, Ck, mA, gd, C, g, k, pR, Ik, Iv, iL, gE, Zz, m, aX, h, ox, ik, aV, cV, Be, J, ei, jo, ti, T, ll, jl, Pk, QN, fP, iB, eG); #c1(HLCS) c2(XP_005261010) c3(5037) c4(31151, 44208, 57265, 18094, 70322) c5(Ad, aq, Ck, awx, kB, od, PZ, u, y, pq); #c1(HLF) c2(NP_002117) c3(5038) c4(31152, 44209, 57266, 18095, 70323) c5(wa, bb, jE, b, t, q, pD, J, ag, G, D, jB, oO, bm); #c1(HLTF) c2(NP_003062) c3(5039) c4(31153, 44210, 57267, 18096, 70324) c5(d, by, fl, V, b, re, Ll, bu, W, T, ff, cs, x, ct, U, ad, e, iT); #c1(HLX) c2(NP_068777) c3(5040) c4(31154, 44211, 57268, 18097, 70325) c5(oy, m, cy, b, t, h, wN, J, M, G, iv, jG, iu, qe); #c1(HMI3) c2(NP_110416) c3(5041) c4(31155, 44212, 57269, 18098, 70326) c5(ae, yN, cy, b, l, yh, eu, ad, P, od, cs, o); #c1(HMB0X1) c2(NP_001129198) c3(5042) c4(31156, 44213, 57270, 18099, 70327) c5(Ib); #c1(HMBS) c2(NP_000181) c3(5043) c4(31157, 44214, 57271, 18100, 70328) c5(bKd, aBy, RI, z, bKc, ai, y, it, bd, f, q, jn, zb, jG, DY, u, cc, em, bm, BC, v, gv, dt, Rk, od, vw, cK, J, jT, ac, sK, W, wV, fy, AW, Y, ch, tW, bqe, wP, cH, OL, bh, OR); #c1(HMCN1) c2(NP_114141) c3(5044) c4(31158, 44215, 57272, 18101, 70329) c5(dx, bb, sX, ZP, du, Fg, aW); #c1(HMG20A) c2(NP_001291433) c3(5045) c4(31159, 44216, 57273, 18102, 70330) c5(aA, I); #c1(HMG20B) c2(NP_006330) c3(5046) c4(31160, 44217, 57274, 18103, 70331) c5(O); #c1(HMGA1) c2(NP_665912) c3(5047) c4(31161, 44218, 57275, 18104, 70332) c5(hV, aw, jT, b, Yq, X, jz, dB, jf, jQ, w, jR, kY, O, bf, U, azn, A, ey, y, jx, d, co, ave, Dx, Qm, re, f, q, yE, e, wV, ar, B, wP, cs, fv, av, fy, u, iT, oJ, iF, V, I, cV, Be, v, bp, J, W, qO, P, nV, T, eX, iD, fx, ad, bbB, fp, aM, wh, qp, QN, iK, hX, in, ag, sf, i, eG, ib); #c1(HMGA2) c2(NP_001287847) c3(5048) c4(31162, 44219, 57276, 18105, 70333) c5(jp, B, qP, fR, pz, bKi, O, t, e, Me, cl, n, g, qY, aow, bp, Jj, fx, jT, fp, amq, wh, ag, cT, w, i, aA, ib, Dr, is, X, kY, bo, bw, U, FA, y, co, yE, f, N, bu, aKF, DP, cs, av, fy, pP, cj, iF, V, bKh, in, ci, ap, OG, ck, kE, b, QB, bKf, QR, aiR, d, ZB, hV, q, ra, ar, jG, u, nj, I, ad, aHG, aHE, iD, asG, iO, aeC, et, bwZ, nV, Ho, agQ, hT, bwv, agf, fg, QP, A, pF, jc, jx, bKg, QV, aX, Bi, F, oJ, cB, cV, J, agh, W, P, T, by, qp, G, bbB, sf, aKM, bKe, eG); #c1(HMGB1) c2(XP_005266425) c3(5049) c4(31163, 44220, 57277, 18106, 70334) c5(dx, en, aw, dN, w, cO, bf, O, RR, dv, cy, kJ, t, AX, cl, gl, g, aC, Gd, du, Ej, bp, ft, x, jT, gg, dH, bk, bq, jl, ib, id, X, iP, aGq, kB, aFm, iG, IW, ajw, bw, U, Co, y, co, BL, awA, f, bu, B, cs, av, fy, V, cd, IR, jG, pi, JY, uJ, fw, vH, bn, bW, b, zH, aF, jL, aO, jh, bb, yQ, q, ar, as, u, dh, o, fh, im, Mi, aiU, gL, ad, IX, vS, lo, et, jH, hS, iR, eQ, hT, ex, gd, OI, xa, brw, A, iL, fr, pR, lk, gn, mW, ea, di, Iv, hA, Bz, m, LS, awz, kn, wG, h, aBd, iZ, aV, jZ, ax, an, be, Fs, J, P, T, aX, by, fM, aM, bIV, Ic, G, tA, fP, atR, at, gf); #c1(HMGB2) c2(NP_001124161) c3(5050) c4(31164, 44221, 57278, 18107, 70335) c5(jT, ax, b, am, NT, f, q, J, IR, wn, og, w, bo, ji, U, re, aA, V); #c1(HMGB3) c2(NP_001288157) c3(5051) c4(31165, 44222, 57279, 18108, 70336) c5(fy, u, y, b, J); #c1(HMGCR) c2(NP_000850) c3(5052) c4(31166, 44223, 57280, 18109, 70337) c5(dx, bm, id, b, fr, dD, eR, eH, di, IW, bf, U, Xv, fD, y, bKj, qs, bQ, bb, ae, f, q, dW, cs, oD, tU, u, o, ma, kF, V, I, aC, bFW, du, ad, fK, Fy, dv, eX, PT, ft, aM, ch, Ox, i, l, bq, aA, at, ap); #c1(HMGCS1) c2(NP_002121) c3(5053) c4(31167, 44224, 57281, 18110, 70338) c5(jl, ch, q, aA, bm, o); #c1(HMGN1) c2(NP_004956) c3(5054) c4(31168, 44225, 57282, 18111, 70339) c5(ih, m, lb, aq, jV, cz, IR, IX, Gs, acw, Co, u, y); #c1(HMGN4) c2(NP_006344) c3(5055) c4(31169, 44226, 57283, 18112, 70340) c5(fl, b); #c1 (HMGN5) c2(NP_110390) c3(5056) c4(31170, 44227, 57284, 18113, 70341) c5(A, lu, b, Bc, pR, B, ft, fr, O, i, fT, u, fx, y); #c1(HMGXB3) c2(NP_055798) c3(5057) c4(31171, 44228, 57285, 18114, 70342) c5(bj, cl); #c1 (HMGXB4) c2(NP_001003681) c3(5058) c4(31172, 44229, 57286, 18115, 70343) c5(ak, ns, nm, nt, ng, nr, nn, no, np); #c1(HMHA1) c2(NP_001245257) c3(5059) c4(31173, 44230, 57287, 18116, 70344) c5(aC, gl, b, gn); #c1(HMMR) c2(NP_001136028) c3(5060) c4(31174, 44231, 57288, 18117, 70345) c5(by, A, b, k, w, JE, U, Uq, fx, y, hh, jT, h, B, e, bu, fv, O, cs, jG, u, d, JI, kF, V, gm, fO, J, qO, G, T, iD, iA, ad, ac, ag, cT, fl, i); #c1(HMOX1) c2(NP_002124) c3(5061) c4(31175, 44232, 57289, 18118, 70346) c5(dx, gK, en, pV, dN, bx, dD, gG, dB, aE, aN, eH, eW, w, cO, aw, VS, aHp, e, O, gO, vr, it, dv, cy, LN, t, AX, wv, bKm, gP, fH, yG, ha, xc, aC, sH, du, fO, bp, gY, m, cV, x, fx, jT, dL, hj, mO, dH, fy, qt, dS, bm, mE, ag, xr, bk, i, dc, bq, aA, bP, id, gE, X, bKn, iP, jz, eu, Kc, mk, ma, acu, bf, Fh, bw, U, io, cM, rN, ed, co, gd, f, zh, cs, bu, tv, bKk, ky, B, qw, iv, bv, av, brt, pP, fY, IT, AO, V, ae, jh, Bs, v, cd, gv, IR, eX, bt, akX, cK, pi, fJ, JY, aH, dO, aaa, uJ, aMQ, P, dY, Le, vH, ji, fD, aG, vl, bn, bW, b, fN, aF, vh, qz, gF, aaO, vY, au, z, ey, bFU, ya, aO, d, eE, bb, bjQ, j, q, ap, mL, ar, ff, Nf, jG, xd, u, dh, o, fh, da, sz, adK, YL, I, Mi, LR, dk, gL, ad, IX, G, rw, aZ, et, jU, Ha, jH, ao, eV, pS, hX, ch, DR, HN, vT, ex, aY, ix, IS, fl, I, aU, wR, aVh, bL, A, iL, jR, IW, et, ds, fw, rj, eO, al, bj, vl, jQ, bKl, qs, LS, il, ty, kn, wG, h, xJ, F, Aq, tF, eN, ik, y, gg, fP, aV, ax, si, gB, Ea, sB, J, fl, W, jo, T, ll, aX, di, by, fM, aM, tf, lc, auy, Af, fq, bh, at, gf); #c1(HMOX2) c2(NP_001120676) c3(5062) c4(31176, 44233, 57290, 18119, 70347) c5(dx, aO, o, du, w, tF, dZ, vZ, dV, di, gf, aW, aG); #c1(HMP19) c2(NP_057064) c3(5063) c4(31177, 44234, 57291, 18120, 70348) c5(aoc, at, aal); #c1(HMSD) c2(NP_001116838) c3(5064) c4(31178, 44235, 57292, 18121, 70349) c5(jp, aeC, cM); #c1(HMX1) c2(NP_061815) c3(5065) c4(31179, 44236, 57293, 18122, 70350) c5(bKo, kD, AP); #c1(HN1) c2(NP_001002032) c3(5066) c4(31180, 44237, 57294, 18123, 70351) c5(A, B, P, ar, al, ap); #c1(HN1L) c2(NP_653171) c3(5067) c4(31181, 44238, 57295, 18124, 70352) c5(ap); #c1 (HNF1A) c2(NP_000536) c3(5068) c4(31182, 44239, 57296, 18125, 70353) c5(dx, bL, dM, td, b, iF, dD, gw, dB, HD, oH, MG, w, di, sU, iL, bw, bf, U, Hi, ey, bKq, dv, bb, or, bqT, IP, q, bu, bKp, cs, hV, yW, bm, bze, o, fk, mz, jB, V, I, bKs, bKr, du, fO, bKu, dK, ad, W, T, eX, mD, x, cy, gF, by, et, hN, aM, nV, dS, fN, mB, cf, mA, aE, bKt, ag, fD, bq, sc, Lj, aA, at, pR, ap); #c1(HNF1B) c2(NP_000449) c3(5069) c4(31183, 44240, 57297, 18126, 70354) c5(bP, nX, A, IO, b, mz, X, vD, VP, dB, bKz, aFq, x, bKw, aBx, ob, bf, jw, gO, dl, byj, l, et, aoW, q, bKv, bKy, aKF, uz, vo, afA, av, aM, sh, aE, aKM, ali, asd, xc, alL, bfV, LR, cU, azo, dt, sV, Nz, rQ, T, ff, bKx, iA, cz, amT, aMx, P, W, nV, mB, vU, jo, B, so, fD, aA, zg); #c1(HNF4A) c2(NP_000448) c3(5070) c4(31184, 44241, 57298, 18127, 70355) c5(dx, B, dB, bKB, mC, bf, O, cU, dv, gB, aKH, bKA, bKp, acy, bze, mz, bpX, jH, du, bp, ft, Kh, fx, hR, jE, M, mB, os, i, pt, aA, bT, X, wy, hS, bAz, U, y, awl, f, bu, cs, av, fy, bm, em, jB, V, gv, Fy, eX, mD, iA, W, cf, iZ, jR, aSm, An, b, gz, QY, au, ey, fD, jh, q, ar, ff, yW, u, aE, o, I, ad, et, et, TW, jU, P, iw, hX, ch, mA, mv, A, bAk, k, fr, HD, di, iL, yw, aX, or, h, az, hN, jZ, aat, cV, dt, jo, T, fO, gF, by, aM, Y, vU, fP, bh, eN, bca); #c1(HNF4G) c2(NP_004124) c3(5071) c4(31185, 44242, 57299, 18128, 70356) c5(jH, bb, dA, bf, bw, Fq, aM); #c1(HNMT) c2(NP_001019245) c3(5072) c4(31186, 44243, 57300, 18129, 70357) c5(b, Kc, DL, bj, y, gM, cy, sG, fq, DM, uB, aV, u, wK, V, I, ti, aCE, qH, jH, xM, ag, DI, GJ); #c1(HNRNPAO) c2(NP_006796) c3(5073) c4(31187, 44244, 57301, 18130, 70358) c5(by, aw, bu); #c1 (HNRNPA1) c2(NP_002127) c3(5074) c4(31188, 44245, 57302, 18131, 70359) c5(A, bS, b, jE, w, lv, bZ, ai, U, Ag, Dg, f, q, kz, ff, iv, oD, jG, alb, bm, o, apz, V, cs, Fs, v, gL, J, jo, T, fO, aj, ad, aO, fy, rS, P, Af, bKD, bKC); #c1 (HNRNPA2B1) c2(NP_002128) c3(5075) c4(31189, 44246, 57303, 18132, 70360) c5(A, b, u, w, C, y, co, pw, kJ, f, q, bu, oD, fy, bm, o, apz, g, aC, jE, bp, by, JY, aO, ch, aq, ag, bKE); #c1(HNRNPA3) c2(XP_005246437) c3(5076) c4(31190, 44247, 57304, 18133, 70361) c5(bxC, nP); #c1(HNRNPAB) c2(NP_004490) c3(5077) c4(31191, 44248, 57305, 18134, 70362) c5(aHc, fy, Af); #c1(HNRNPC) c2(XP_011535013) c3(5078) c4(31192, 44249, 57306, 18135, 70363) c5(m, jE, co, b, cV, aC, el, f, jz, q, fl, aHc, P, A, T, B, Qt, fy, bm, jQ); #c1(HNRNPD) c2(NP_001003810) c3(5079) c4(31193, 44250, 57307, 18136, 70364) c5(d, m, aX, b, Pv, hV, q, fD, gE, ji, fy, e); #c1(HNRNPDL) c2(NP_001193929) c3(5080) c4(31194, 44251, 57308, 18137, 70365) c5(m, jE, co, kG, b, cV, aC, bm, el, B, jz, q, fl, aHc, P, A, T, Qt, fy, u, jQ); #c1(HNRNPF) c2(NP_001091676) c3(5081) c4(31195, 44252, 57309, 18138, 70366) c5(bxC, cs, q, ad); #c1 (HNRNPH1) c2(NP_005511) c3(5082) c4(31196, 44253, 57310, 18139, 70367) c5(ao, A, bS, b, el, xQ, aWt); #c1 (HNRNPH2) c2(NP_001027565) c3(5083) c4(31197, 44254, 57311, 18140, 70368) c5(ao, bS, b, el, xQ, aWt); #c1(HNRNPK) c2(NP_112553) c3(5084) c4(31198, 44255, 57312, 18141, 70369) c5(d, A, aw, b, h, B, q, fO, ag, T, aX, U, u, e, y); #c1(HNRNPL) c2(NP_001524) c3(5085) c4(31199, 44256, 57313, 18142, 70370) c5(u, bu); #c1 (HNRNPM) c2(NP_005959) c3(5086) c4(31200, 44257, 57314, 18143, 70371) c5(b); #c1(HNRNPR) c2(NP_001284549) c3(5087) c4(31201, 44258, 57315, 18144, 70372) c5(kz, u); #c1(HNRNPU) c2(NP_004492) c3(5088) c4(31202, 44259, 57316, 18145, 70373) c5(jK, V, b, ag, Be, bj, q, qL, T, zO, O, u, y); #c1(HNRNPUL1) c2(NP_008971) c3(5089) c4(31203, 44260, 57317, 18146, 70374) c5(bq, at, eX, eR); #c1(HOGA1) c2(NP_001128142) c3(5090) c4(31204, 44261, 57318, 18147, 70375) c5(bpR, MR); #c1(HOMER1) c2(NP_001264006) c3(5091) c4(31205, 44262, 57319, 18148, 70376) c5(b, aY, nU, cz, Js, dd, GN, dc, cA, Gj, bj, cM); #c1(HOMER2) c2(NP_004830) c3(5092) c4(31206, 44263, 57320, 18149, 70377) c5(A, b, cV, B, afn, Wj, T, Dj, iJ, dd, yA, xw); #c1(HOMER3) c2(NP_001139193) c3(5093) c4(31207, 44264, 57321, 18150, 70378) c5(rb); #c1(HOMEZ) c2(NP_065885) c3(5094) c4(31208, 44265, 57322, 18151, 70379) c5(at); #c1(HOOK2) c2(NP_001093646) c3(5095) c4(31209, 44266, 57323, 18152, 70380) c5(jh, A, il, ez, b, X, B, lg, ik, bf, av, u, y, aM); #c1(HOOK3) c2(NP_115786) c3(5096) c4(31210, 44267, 57324, 18153, 70381) c5(kF); #c1(HOPX) c2(NP_001138931) c3(5097) c4(31211, 44268, 57325, 18154, 70382) c5(b, mk, w, di, cO, bf, e, O, d, jh, co, hV, F, bu, aBE, fU, hf, by, IC, od, aM, qt, og, ji, T, ap); #c1 (HORMAD2) c2(NP_689723) c3(5098) c4(31212, 44269, 57326, 18155, 70383) c5(fP, co, fl); #c1(HOXA10) c2(NP_061824) c3(5099) c4(31213, 44270, 57327, 18156, 70384) c5(ml, alg, b, X, iP, w, PM, et, e, O, zY, y, d, M, bQ, aAo, bbB, Bc, h, anM, N, bu, cU, ar, oJ, UF, av, u, Yj, kF, bfV, J, by, aHG, T, bKF, Qj, iA, jG, wh, VG, G, nJ, yy, jd, fg, l, eG); #c1(HOXA11) c2(NP_005514) c3(5100) c4(31214, 44271, 57328, 18157, 70385) c5(alg, b, X, w, lu, VG, apg, d, M, atj, aX, Bc, t, h, e, ND, ar, n, iv, UF, av, fy, Yj, J, bKH, aHG, co, bKG, bKF, iA, et, jG, G, bbB, I, pJ, eG); #c1(HOXA13) c2(XP_011513646) c3(5101) c4(31215, 44272, 57329, 18158, 70386) c5(jh, b, bKJ, bfV, sm, jE, h, ahS, q, arm, l, cT, n, aHO, alg, UF, PH, bm, jG, bKI); #c1(HOXA1) c2(NP_005513) c3(5102) c4(31216, 44273, 57330, 18159, 70387) c5(alg, b, bKK, iP, xw, hP, fx, y, d, co, aX, Dx, re, nU, q, jV, e, ar, HE, u, iT, fU, arP, bKL, cz, T, cr, J, Mw, AP, aNc, rQ, na, i, l, ji, anK); #c1(HOXA2) c2(NP_006726) c3(5103) c4(31217, 44274, 57331, 18160, 70388) c5(Yj, d, e, bKM, bu); #c1(HOXA3) c2(XP_005249788) c3(5104) c4(31218, 44275, 57332, 18161, 70389) c5(cr, alg, jd, bvP, K, l, AP, O); #c1(HOXA4) c2(NP_002132) c3(5105) c4(31219, 44276, 57333, 18162, 70390) c5(alg, b, X, h, jG, J, cT, T, l, ar, av, PH); #c1 (HOXA5) c2(NP_061975) c3(5106) c4(31220, 44277, 57334, 18163, 70391) c5(Yj, d, wh, co, alg, b, X, F, h, wN, J, jR, T, oJ, l, jG, fy, u, e, y); #c1(HOXA6) c2(NP_076919) c3(5107) c4(31221, 44278, 57335, 18164, 70392) c5(l, Bz, alg, b); #c1(HOXA7) c2(NP_008827) c3(5108) c4(31222, 44279, 57336, 18165, 70393) c5(d, wV, alg, wP, X, h, iP, J, M, jd, sf, T, Ca, l, ar, av, u, e, y); #c1(HOXA9) c2(NP_689952) c3(5109) c4(31223, 44280, 57337, 18166, 70394) c5(Yj, A, aw, alg, b, X, iP, w, iL, O, oU, y, d, co, aX, jd, t, h, f, N, q, jV, e, M, ar, B, iv, av, fy, u, dh, n, g, gG, lb, J, j, hi, P, T, jG, pb, G, cT, fg, pl, l, ci); #c1(HOXB13) c2(NP_006352) c3(5110) c4(31224, 44281, 57338, 18167, 70395) c5(A, aw, V, b, X, jq, B, dB, ad, mk, y, bKN, cs, iA, aX, av, bFf, u, U, Up); #c1(HOXB1) c2(NP_002135) c3(5111) c4(31225, 44282, 57339, 18168, 70396) c5(EM, rQ, u, h, dB, cz, ag, jo, bKP, bKO, pK, bKQ, AP, fp, y, anK); #c1(HOXB2) c2(NP_002136) c3(5112) c4(31226, 44283, 57340, 18169, 70397) c5(EM, MI, pK, X, h, dB, jV, ag, jo, ar, i, fx, u, fp, y); #c1(HOXB3) c2(XP_005257339) c3(5113) c4(31227, 44284, 57341, 18170, 70398) c5(EM, V, h, wN, J, dB, ag, jo, pK, ji, U, fp); #c1(HOXB4) c2(NP_076920) c3(5114) c4(31228, 44285, 57342, 18171, 70399) c5(mZ, EM, Ba, pp, b, hX, h, J, dB, mk, jo, fe, Em, tl, eM, aV, fp, pK); #c1(HOXB5) c2(NP_002138) c3(5115) c4(31229, 44286, 57343, 18172, 70400) c5(EM, pK, b, h, dB, fp, jo, i, aA, fx); #c1(HOXB6) c2(XP_005257340) c3(5116) c4(31230, 44287, 57344, 18173, 70401) c5(EM, V, X, h, dB, fp, jo, cl, pK, U, PH); #c1(HOXB7) c2(NP_004493) c3(5117) c4(31231, 44288, 57345, 18174, 70402) c5(pK, b, EM, ahS, dB, w, aES, et, U, e, y, d, aX, kJ, h, ar, fv, av, fy, u, iT, V, J, fO, jo, fp, os, ag, cT, IN, ji, re); #c1(HOXB8) c2(NP_076921) c3(5118) c4(31232, 44289, 57346, 18175, 70403) c5(h, dB, fp, jo, pK, qu, EM); #c1(HOXB9) c2(NP_076922) c3(5119) c4(31233, 44290, 57347, 18176, 70404) c5(fi, EM, iP, V, b, h, hV, q, dB, jo, og, pK, fH, U, u, fp, y, fJ); #c1(HOXC10) c2(NP_059105) c3(5120) c4(31234, 44291, 57348, 18177, 70405) c5(d, re, J, iT, u, e, y); #c1(HOXC11) c2(NP_055027) c3(5121) c4(31235, 44292, 57349, 18178, 70406) c5(aX, b, cV, h, ie, J, u, y); #c1(HOXC12) c2(NP_776272) c3(5122) c4(31236, 44293, 57350, 18179, 70407) c5(Dd); #c1(HOXC13) c2(NP_059106) c3(5123) c4(31237, 44294, 57351, 18180, 70408) c5(bKR, Yj, h, Dd, b); #c1(HOXC4) c2(NP_705897) c3(5124) c4(31238, 44295, 57352, 18181, 70409) c5(kM, J, jV, ag, Dd, ic); #c1(HOXC5) c2(NP_061826) c3(5125) c4(31239, 44296, 57353, 18182, 70410) c5(jT, Cq, ie, gm, J, Dd, hR); #c1(HOXC6) c2(NP_004494) c3(5126) c4(31240, 44297, 57354, 18183, 70411) c5(A, cV, Cq, B, J, Dd, Yv, jT); #c1(HOXC8) c2(NP_073149) c3(5127) c4(31241, 44298, 57355, 18184, 70412) c5(A, aw, bfV, b, kJ, re, B, T, iT, hb, Dd, u, y); #c1(HOXC9) c2(NP_008828) c3(5128) c4(31242, 44299, 57356, 18185, 70413) c5(Dd, u, y, cV); #c1(HOXD10) c2(NP_002139) c3(5129) c4(31243, 44300, 57357, 18186, 70414) c5(Yj, jT, bBi, b, cG, X, F, q, bKS, bu, Ak, aga, T, O, i, aC, av, by, u, y); #c1(HOXD11) c2(NP_067015) c3(5130) c4(31244, 44301, 57358, 18187, 70415) c5(Yj, atj, am, X, u, h, F, cz, aC, aMp, bKF, et); #c1(HOXD12) c2(NP_067016) c3(5131) c4(31245, 44302, 57359, 18188, 70416) c5(Ak, Yj, atj, aX, cz); #c1(HOXD13) c2(NP_000514) c3(5132) c4(31246, 44303, 57360, 18189, 70417) c5(IY, bKT, abu, bKU, k, Ak, xK, aHO, brC, y, bji, b, atj, sm, h, bKW, n, bKV, iv, PH, u, zW, o, bKI, Yj, bKX, aC, J, cz, bKY, jG, aPc, arJ, ih, ag, eN, ci); #c1(HOXD1) c2(NP_078777) c3(5133) c4(31247, 44304, 57361, 18190, 70418) c5(X, Yj); #c1(HOXD3) c2(XP_006712540) c3(5134) c4(31248, 44305, 57362, 18191, 70419) c5(Yj, aHA, co, aX, b, lb, B, J, jV, X, A, arP, aw); #c1(HOXD4) c2(NP_055436) c3(5135) c4(31249, 44306, 57363, 18192, 70420) c5(Yj, b, cV, t, ie, G, fp); #c1(HOXD8) c2(NP_001186675) c3(5136) c4(31250, 44307, 57364, 18193, 70421) c5(Yj, aE, aHO, cV); #c1(HOXD9) c2(NP_055028) c3(5137) c4(31251, 44308, 57365, 18194, 70422) c5(g, Yj, aX, b, cV, aC, re, gG, w, O, e, iT, d); #c1(HP1BP3) c2(XP_011539836) c3(5138) c4(31252, 44309, 57366, 18195, 70423) c5(aqV); #c1(HPCAL1) c2(XP_011508650) c3(5139) c4(31253, 44310, 57367, 18196, 70424) c5(qf, di, b, cV); #c1(HPD) c2(NP_001165464) c3(5140) c4(31254, 44311, 57368, 18197, 70425) c5(bLa, en, b, LX, iU, eR, Ak, A, bKZ, et, B, hb, bm, zW, dj, bM, wd, jE, LW, LY, Ri, ag, LZ, bh, ap); #c1(HPGD) c2(NP_000851) c3(5141) c4(31255, 44312, 57369, 18198, 70426) c5(avO, A, b, aBT, eu, w, IW, U, AK, hP, y, co, kn, pz, q, bu, ar, cs, u, o, bLc, bm, V, bLb, gG, sH, bp, ad, W, T, x, ct, by, ao, nV, aBU, tO, Eo, eG); #c1(HPGDS) c2(NP_055300) c3(5142) c4(31256, 44313, 57370, 18199, 70427) c5(dx, by, ak, pV, bx, sd, Zy, bLe, dB, aN, w, et, aw, O, aoK, e, xl, cp, M, bLd, JN, cy, am, t, aZB, eE, jU, ju, aD, fH, Hs, biz, gl, rR, g, JP, fe, aC, du, is, aWN, fO, ft, fx, hR, wh, QJ, qt, bm, ie, bY, Hf, ag, cT, bBL, i, pt, aA, GJ, bT, GD, gk, gE, bS, X, wy, ix, bf, U, y, yt, co, js, cX, fF, f, cs, bu, gX, B, iv, av, fy, QD, iT, bk, cj, hh, V, IT, gv, gF, dv, bt, Qt, Fr, yA, YU, JY, aKy, dP, py, er, P, fw, uK, cz, tl, ji, apU, fD, ci, ap, ck, Pg, wn, m, id, ic, z, AK, Bb, yK, jh, b, hb, jd, re, hV, g, es, vu, ar, aZD, bcs, n, jG, aM, u, aE, o, ff, da, NT, l, qL, j, ad, qO, G, pD, aZ, jM, Be, Lt, jH, ao, nV, iR, eQ, ale, Dj, ex, gd, bg, l, aU, ph, as, IA, A, d, pF, k, fr, Lv, pR, UA, mW, bFP, NA, jc, di, C, iL, eM, al, jR, hP, yw, aW, c, qs, Ez, aX, il, aCU, bj, h, F, cU, ik, oJ, cB, qB, aV, aq, pE, fU, hW, ez, cV, an, fJ, J, asM, W, jo, ti, T, Oi, jl, ya, Pk, qe, bFQ, jT, Y, hq, fP, E, fq, bh, at, eG, gf, iE, rZ); #c1(HP) c2(NP_001119574) c3(5143) c4(31257, 44314, 57371, 18200, 70428) c5(dx, gK, dM, aw, dN, hY, dB, sA, eH, en, cO, bf, O, e, xl, gO, dv, aBi, b, gB, cl, kX, bLg, aC, sH, du, yO, bp, bLi, Ka, hj, pq, qt, dS, fN, ag, w, bk, fz, dc, bq, aA, afd, hP, id, td, ig, bW, Fh, bw, qG, cM, ip, ml, f, bu, B, av, bm, CG, d, qw, fD, ae, NZ, gv, aVe, cy, aBw, dO, aY, vH, wX, ap, xm, bLh, vY, yU, sU, eV, yK, lz, re, q, aHu, as, yW, u, aE, o, wY, da, kF, yZ, l, kt, j, by, xk, vS, lo, et, jG, jU, hS, ch, xN, Ck, mA, uH, gd, aG, Bm, uE, QU, bL, A, mz, nl, tR, bFP, cA, di, iL, gE, wf, al, hP, bLf, aW, c, qs, aX, GW, bj, zn, F, y, jZ, dj, ma, m, an, be, J, P, T, ll, jl, aM, bLj, nk, OA, Ic, fP, avx, bh, aT, at, eG, gl); #c1(HPN) c2(NP_892028) c3(5144) c4(31258, 44315, 57372, 18201, 70429) c5(A, b, X, Qf, B, q, cd, dB, ep, T, sF, iL, Fr, av, bm, R); #c1(HPR) c2(NP_066275) c3(5145) c4(31259, 44316, 57373, 18202, 70430) c5(B, b, X, w, A, bLf, y, GW, t, h, f, q, cU, fx, O, av, u, fU, Gl, ae, cV, J, Yl, G, iA, bLk, bm, i); #c1(HPRT1) c2(NP_000185) c3(5146) c4(31260, 44317, 57374, 18203, 70431) c5(mZ, A, zr, b, nX, agH, ie, aYW, HJ, CQ, Hr, zm, agJ, jV, fR, G, lk, y, c, co, aX, ob, ni, t, f, N, q, Pn, aC, pn, DZ, B, iv, av, aV, u, aE, bLI, aYh, ae, cV, lb, bK, aQu, J, j, ad, dt, ME, T, bp, oM, x, BL, jT, bLm, cq, iw, fy, cs, fc, ch, amJ, bm, DO, vc, Dj, Le, Ot, fP, la, aff, Sd, gw, pt, fO); #c1(HPS1) c2(NP_000186) c3(5147) c4(31261, 44318, 57375, 18204, 70432) c5(IY, ic, U, bb, IZ, XQ, q, XM, TW, bm, o, fh, V, p, XS, bq, cl, dL, gg, jU, eN, Lc, XL, aX, fN, XP, XO, at, ap); #c1(HPS3) c2(NP_115759) c3(5148) c4(31262, 44319, 57376, 18205, 70433) c5(IY, XS, bLn, IZ); #c1(HPS4) c2(NP_071364) c3(5149) c4(31263, 44320, 57377, 18206, 70434) c5(IY, IZ, XS, bLo, cl, gg, eN, jU); #c1(HPS5) c2(NP_852608) c3(5150) c4(31264, 44321, 57378, 18207, 70435) c5(IY, bLp, XS); #c1(HPS6) c2(NP_079023) c3(5151) c4(31265, 44322, 57379, 18208, 70436) c5(XS, bLg); #c1(HPSE2) c2(NP_001159716) c3(5152) c4(31266, 44323, 57380, 18209, 70437) c5(id, aw, b, qz, A, bgd, sU, bf, e, d, awa, bb, sG, h, F, Dd, ZU, arQ, bEz, fO, G, T, aM, oL, mA, cT, vK, bq, at); #c1(HPSE) c2(NP_001092010) c3(5153) c4(31267, 44324, 57381, 18210, 70438) c5(dx, gK, B, aw, gG, dB, eC, w, bLr, cO, bf, e, O, cp, dv, b, t, dl, cl, Hs, n, g, aC, du, bp, ft, od, fx, Bi, jE, qt, aEs, ie, ag, qP, vK, i, vJ, bq, aA, Dr, GD, id, iF, cY, arQ, eu, iG, bw, U, y, tp, co, rY, pp, mI, f, bu, Em, cs, av, fy, bm, iT, yJ, RJ, jB, V, jh, cd, bd, Qt, iA, bLs, dO, QG, jR, ji, pT, aF, fl, sU, d, eE, bb, hV, q, X, ar, fv, jG, u, aE, o, da, fs, il, qL, UG, ad, G, oi, et, nV, ZL, af, bL, A, k, fr, gn, iL, VG, hP, aX, I, sG, h, F, ik, rR, bLt, apx, cV, Fs, J, P, T, fO, fi, by, iv, aM, qp, ip, mb, fP, hz, Ez, at, eG, ja, iE); #c1(HPX) c2(XP_005252940) c3(5154) c4(31268, 44325, 57382, 18211, 70439) c5(c, A, cT, l, bm, be, q, bd, dl, bLu, mx, bLv, vw, zE, Ur, bjQ, eV, y); #c1(HRAS) c2(NP_001123914) c3(5155) c4(31269, 44326, 57383, 18212, 70440) c5(by, f, aw, bx, Zy, aE, eC, aJT, w, bLw, adr, e, O, zi, b, iR, aJP, Xi, cl, EM, oP, g, fe, jH, cs, fO, aow, bp, azo, zU, x, fx, jT, kl, mO, Bi, lp, wh, apK, DO, OJ, ag, bLy, i, aA, bLA, Dr, sa, kM, QF, X, jj, eu, wy, bw, U, Oh, y, co, pw, pp, wP, ak, bLx, bu, an, B, iv, iJ, oD, av, fy, bm, iT, cj, fi, V, bku, qq, n, hi, ny, auN, iA, hV, dt, gt, aoy, QG, jR, tl, qh, iu, aBF, ck, xm, AA, ic, azn, gF, d, Ag, yQ, bsQ, mF, re, nU, q, ra, ar, VM, as, aYK, jG, u, aqS, kP, fs, jE, il, gL, ad, aen, cW, iw, wV, nV, ch, xN, aoA, Dj, Sk, zZ, cX, yA, KG, A, k, fr, Rd, aMP, BY, gE, wf, hP, Ld, aX, I, bn, h, F, gT, cU, oJ, cB, QJ, fU, cV, aMH, aMK, J, W, T, II, Xj, nP, cz, VF, QK, st, QN, bLz, MP, ci, j, Af, ja, rb); #c1(HRASLS) c2(NP_065119) c3(5156) c4(31270, 44327, 57384, 18213, 70441) c5(dx, SA, A, dS, du, eR, bN, dv, di, B, bt, bu, at); #c1(HRC) c2(NP_002143) c3(5157) c4(31271, 44328, 57385, 18214, 70442) c5(ml, l, f, dt, jo, mR, ff, cO, bf, oh, O, aM); #c1(HRG) c2(NP_000403) c3(5158) c4(31272, 44329, 57386, 18215, 70443) c5(b, aE, w, e, O, d, f, sZ, DZ, y, u, g, bLB, be, dt, Ql, tj, pi, bLC, ag, vP, bg); #c1(HRH1) c2(NP_001091683) c3(5159) c4(31273, 44330, 57387, 18216, 70444) c5(dx, Kc, dv, bb, dP, du, cy, aOQ, aM, JE, X, bf, at, bj, ap); #c1(HRH2) c2(NP_001124527) c3(5160) c4(31274, 44331, 57388, 18217, 70445) c5(QD, dv, aX, fz, aJA, atr, bu, aOQ, bv, vZ, bt, x, by, iR, oP); #c1(HRH3) c2(NP_009163) c3(5161) c4(31275, 44332, 57389, 18218, 70446) c5(dk, ma, cy, eA, Bs, GS, eB, MO, NJ, do, ky, aA, T, di, ey, oN); #c1(HRH4) c2(NP_001137300) c3(5162) c4(31276, 44333, 57390, 18219, 70447) c5(da, dt, V, m, aC, fq, be, bu, aOQ, T, x, ar, by); #c1(HR) c2(NP_005135) c3(5163) c4(31277, 44334, 57391, 18220, 70448) c5(bwW, bLF, bwX, bLE, bLD, bed, alb); #c1(HRK) c2(NP_003797) c3(5164) c4(31278, 44335, 57392, 18221, 70449) c5(jT, A, jl, V, b, k, B, iX, J, bu, w, by); #c1(HRNR) c2(NP_001009931) c3(5165) c4(31279, 44336, 57393, 18222, 70450) c5(b, Be, fq, y, u, O); #c1(HRSP12) c2(NP_005827) c3(5166) c4(31280, 44337, 57394, 18223, 70451) c5(gK, bn, gt, kJ, B, eo, acE, A); #c1(HSIBP3) c2(NP_071905) c3(5167) c4(31281, 44338, 57395, 18224, 70452) c5(bLG, xM, aNc, byU, GJ, bj); #c1(HS3ST1) c2(NP_005105) c3(5168) c4(31282, 44339, 57396, 18225, 70453) c5(b, ag, di, fl, bq, cp); #c1(HS3ST2)

c2(NP_006034) c3(5169) c4(31283, 44340, 57397, 18226, 70454) c5(d, jT, co, V, b, h, Rd, gL, e, iT, U, fy, u, re, y); #c1(HS3ST3A1) c2(NP_006033) c3(5170) c4(31284, 44341, 57398, 18227, 70455) c5(oy, m, ao, GF, fl); #c1 (HS3ST3B1) c2(NP_006032) c3(5171) c4(31285, 44342, 57399, 18228, 70456) c5(ag, eG, ll, z); #c1(HS3ST4) c2(NP_006031) c3(5172) c4(31286, 44343, 57400, 18229, 70457) c5(cy, xq, bb, cO); #c1(HS3ST5) c2(NP_705840) c3(5173) c4(31287, 44344, 57401, 18230, 70458) c5(aX); #c1(HS3ST6) c2(NP_001009606) c3(5174) c4(31288, 44345, 57402, 18231, 70459) c5(fl); #c1(HS6ST1) c2(NP_004798) c3(5175) c4(31289, 44346, 57403, 18232, 70460) c5(LR, bLH); #c1(HS6ST2) c2(NP_001070656) c3(5176) c4(31290, 44347, 57404, 18233, 70461) c5(LR, u, oK, y); #c1(HS6ST3) c2(NP_703157) c3(5177) c4(31291, 44348, 57405, 18234, 70462) c5(td, wf, bf, aA, Wp, aM); #c1(HSBP1) c2(NP_001528) c3(5178) c4(31292, 44349, 57406, 18235, 70463) c5(HO, f, u); #c1(HSD11B1) c2(NP_001193670) c3(5179) c4(31293, 44350, 57407, 18236, 70464) c5(eX, vg, b, em, fr, aOv, mk, di, tG, vO, U, ey, cM, cp, bQ, bLJ, bLL, f, vN, bLK, y, aRY, tU, u, o, bLI, kF, V, I, aUV, ft, cx, gL, vF, W, vc, Hq, rd, are, cz, iz, eH, mz, dS, aY, ch, nc, OW, ex, iF, fD, dc, gj, aA, at, bca, ap); #c1(HSD11B1L) c2(NP_001254797) c3(5180) c4(31294, 44351, 57408, 18237, 70465) c5(A, T, B); #c1(HSD11B2) c2(NP_000187) c3(5181) c4(31295, 44352, 57409, 18238, 70466) c5(bP, eX, aiF, X, dB, aOv, di, bf, U, ft, y, bLN, qs, bLO, cy, f, q, fr, DZ, cs, TW, TC, u, aE, iF, XQ, vO, V, jH, aC, sH, be, gJ, J, bd, W, aPG, bQ, od, agm, uw, jl, ad, et, aM, bLL, bLM, Fu, gf, ih, yE, gA, Bm, fD, bq, bh, aA, OS, eG, DR, ap); #c1(HSD17B10) c2(NP_001032900) c3(5182) c4(31296, 44353, 57410, 18239, 70467) c5(f, l, fr, bK, nz, nU, bLQ, aqo, aN, v, ji, aq, bLP, gF, xJ, aK, o); #c1 (HSD17B11) c2(NP_057329) c3(5183) c4(31297, 44354, 57411, 18240, 70468) c5(A, B); #c1(HSD17B12) c2(NP_057226) c3(5184) c4(31298, 44355, 57412, 18241, 70469) c5(b, cV, X, hT, F, qL, do, ky, bq, T, av, u, y); #c1(HSD17B13) c2(NP_001129702) c3(5185) c4(31299, 44356, 57413, 18242, 70470) c5(A, wp, b, qL, eG, B, J, afJ, agm, bQ, od, aA, qO, PT, av, UR, u, PH, y); #c1 (HSD17B14) c2(NP_057330) c3(5186) c4(31300, 44357, 57414, 18243, 70471) c5(bq); #c1(HSD17B1) c2(NP_000404) c3(5187) c4(31301, 44358, 57415, 18244, 70472) c5(A, b, X, ck, aoi, Lr, U, y, bQ, jl, B, PA, bu, cU, PT, av, u, fi, kF, V, by, qO, od, iA, Lt, agm, i, l, eG); #c1(HSD17B2) c2(NP_002144) c3(5188) c4(31302, 44359, 57416, 18245, 70473) c5(gK, by, ml, X, A, U, y, bQ, jl, B, bu, cU, oJ, cs, av, u, kF, V, cz, qO, iA, ad, wh, nc, agm, i, l, eG); #c1(HSD17B3) c2(NP_000188) c3(5189) c4(31303, 44360, 57417, 18246, 70474) c5(A, V, I, afg, aga, B, cz, afJ, do, Gl, PH, UZ, u, UP); #c1(HSD17B4) c2(NP_000405) c3(5190) c4(31304, 44361, 57418, 18247, 70475) c5(A, X, nf, bLR, jw, ck, di, O, bf, ey, iA, dl, cp, ey, jT, hi, qc, oB, f, cU, fx, B, aV, u, aE, Ps, nl, yR, l, cJ, be, cz, bLS, mY, Ap, Lt, aM, aQI, UH, xO, ex, ih, aeP, Lr, i, fl, l, aA, iu, rn); #c1(HSD17B6) c2(XP_006719735) c3(5191) c4(31305, 44362, 57419, 18248, 70476) c5(ake, gK, lb, SC, adn, b, cE, AA, A, ak, z, bf, em, bF, bD, y, gO, d, WO, co, cy, SS, GP, ni, fq, oF, f, e, bu, cU, Vr, mg, B, cs, oD, aM, u, g, sz, cf, kF, fC, awV, afh, v, bp, cz, dt, bQ, bt, iA, by, afj, qT, pQ, nR, anG, aY, aq, hT, PY, bk, fD, HV, zg, avN); #c1(HSD17B7) c2(NP_001291441) c3(5192) c4(31306, 44363, 57420, 18249, 70477) c5(A, iq, b, X, nf, di, bf, U, y, bQ, B, Kg, cU, qL, oJ, cs, PT, av, u, o, Hl, kF, V, wp, Be, J, gL, vF, W, afJ, T, Jj, iA, ad, PH, aM, wh, UR, yE, agm, gO, PS, od, aA, eG); #c1(HSD17B8) c2(NP_055049) c3(5193) c4(31307, 44364, 57421, 18250, 70478) c5(m, u); #c1(HSD3B1)

c2(XP_011539616) c3(5194) c4(31308, 44365, 57422, 18251, 70479) c5(A, di, fx, oy, Ag, qs, jl, B, cU, aJ, PT, PH, u, wR, kF, l, cx, afJ, bkt, od, iA, aUd, i, aUt, I, T, eG); #c1(HSD3B7) c2(NP_001136250) c3(5195) c4(31309, 44366, 57423, 18252, 70480) c5(bLT, aFq); #c1(HSDL1) c2(NP_001139523) c3(5196) c4(31310, 44367, 57424, 18253, 70481) c5(bfe); #c1(HSDL2) c2(NP_001182751) c3(5197) c4(31311, 44368, 57425, 18254, 70482) c5(Ns, bm, Ng); #c1(HSF1) c2(NP_005517) c3(5198) c4(31312, 44369, 57426, 18255, 70483) c5(A, aw, b, X, aE, EM, gG, KN, bn, bf, O, hP, e, y, d, co, aX, Ec, h, f, q, bu, cU, B, cB, av, fy, u, ff, lr, zj, v, jo, T, iD, x, Fr, iA, jT, aM, ao, bm, PY, ag, aT, re, ap); #c1(HSF2) c2(NP_001129036) c3(5199) c4(31313, 44370, 57427, 18256, 70484) c5(aKH, wn, f, jH); #c1(HSF4) c2(NP_001035757) c3(5200) c4(31314, 44371, 57428, 18257, 70485) c5(aWN, gE, bwl, bLW, nU, P, iL, bLV, al, bLU, IA); #c1(HSF5) c2(NP_001073908) c3(5201) c4(31315, 44372, 57429, 18258, 70486) c5(aX); #c1 (HSFY2) c2(NP_001001877) c3(5202) c4(31316, 44373, 57430, 18259, 70487) c5(pM, wn, UW, am); #c1(HSH2D) c2(NP_001278203) c3(5203) c4(31317, 44374, 57431, 18260, 70488) c5(Uf, gz, jT, Ui); #c1(HSP90AA1) c2(NP_001017963) c3(5204) c4(31318, 44375, 57432, 18261, 70489) c5(dx, B, aw, dN, sE, w, eD, e, O, vr, dv, cy, DB, mR, cl, kX, gl, g, fe, bMb, du, bp, ft, x, fx, jT, FG, jE, M, qt, awz, KN, ag, cT, bk, i, dc, pt, bT, Dr, Kt, X, jz, mk, Ni, yn, cA, bw, U, aTF, cM, co, awA, yX, f, cs, bu, iv, av, fy, bm, iT, V, ae, v, bt, cl, azC, bLY, aY, er, P, nJ, alB, SW, oM, b, MS, Ey, oR, jC, ey, d, Fp, re, hV, q, Kz, ar, ff, hb, jG, u, dh, o, aAf, kF, il, bLX, KL, ad, da, jU, yG, jH, nV, kB, ch, HN, aE, fl, bLZ, y, bL, A, qd, fr, adK, mW, ot, eg, lv, hP, Pm, Ic, m, aX, Qm, h, cU, ik, bMa, cB, jQ, Yb, fU, NX, cV, be, J, dt, jo, T, fO, ji, by, fM, iK, Y, Ec, fP); #c1(HSP90AB1) c2(NP_001258898) c3(5205) c4(31319, 44376, 57433, 18262, 70490) c5(Dr, A, aw, b, bn, oR, y, tp, co, cy, h, f, q, cM, iv, u, cc, og, m, J, fO, P, fM, aY, ag, dc, hd); #c1 (HSP90B1) c2(NP_003290) c3(5206) c4(31320, 44377, 57434, 18263, 70491) c5(ak, aw, b, fr, aGv, gG, bg, bru, BY, A, iL, aAb, bMc, O, e, y, d, m, co, aX, kJ, amo, re, gz, g, bu, gX, mL, ar, O, u, dh, iT, Zz, cV, aC, be, gL, ft, sf, T, fO, aGU, by, fp, jH, jT, hU, f, py, er, ag, fP, Mp); #c1(HSPA12A) c2(NP_079291) c3(5207) c4(31321, 44378, 57435, 18264, 70492) c5(cA, IV); #c1(HSPA12B) c2(NP_443202) c3(5208) c4(31322, 44379, 57436, 18265, 70493) c5(aF, cy, ap); #c1(HSPA13) c2(NP_008879) c3(5209) c4(31323, 44380, 57437, 18266, 70494) c5(aA, bu); #c1(HSPA14) c2(NP_001265134) c3(5210) c4(31324, 44381, 57438, 18267, 70495) c5(azt, dx, by, f, aED, b, cE, X, Pv, Of, nl, avv, mk, aDu, qX, tG, Io, bf, vl, A, kE, Fp, dv, AX, DB, bu, aC, ar, B, aBl, av, aM, aq, bMd, ax, vg, cV, bx, du, fO, v, gL, bN, vc, aE, T, II, bt, fx, k, bMe, yW, be, dH, jH, xU, aEL, gd, I, aPd, aA, at); #c1(HSPA1A) c2(NP_005336) c3(5211) c4(31325, 44382, 57439, 18268, 70496) c5(dx, B, pV, ud, dB, vB, sJ, w, cO, bf, O, gM, dv, cy, b, ju, ha, Fx, aC, sH, du, gJ, fO, vc, x, fx, jT, fc, bMf, qP, i, aA, rn, bP, aHb, mk, cA, y, co, f, vQ, bu, xb, fy, azi, em, yV, ae, nl, v, Dp, bt, uu, bb, qH, aH, fw, add, Im, iu, vL, ap, bn, am, aF, vY, tt, tG, z, BQ, aO, aYB, q, aM, u, nj, o, sz, kF, l, ir, qA, gL, by, jH, aWN, ig, Dg, HN, dh, ih, gd, bL, A, vZ, vg, fs, bj, m, gs, bJz, aX, wG, wr, qr, aE, qB, aV, fU, tP, cV, J, P, T, HL, Ic, fP, at, gf); #c1(HSPA1L) c2(NP_005518) c3(5212) c4(31326, 44383, 57440, 18269, 70497) c5(lc, vg, b, gU, ud, vB, mk, sJ, A, hM, vQ, tG, cA, bj, y, cp, gM, m, qs, co, bb, sr, wr, f, q, qr, bu, B, sX, u, jZ, tP, l, Ea, aC, qA, sH, nl, J, gL, vc, lm, jT, eF, bMg, bMf, P, aE, di, at, rn); #c1(HSPA2) c2(NP_068814) c3(5213) c4(31327, 44384, 57441, 18270, 70498) c5(dx, f, b, aF, dB, gN, vY, A, vZ, cO, bf, y, m, co, bb, am, bn, wG, gz, bu, B, ju, kN, fy, u, gl, o, nl, l, ir, du, IT, by, dv, x, qH, aM, jH, jT, aE, fP, lm, aA, at, iu); #c1(HSPA4) c2(NP_002145) c3(5214) c4(31328, 44385, 57442, 18271, 70499) c5(dx, en, pV, dB, sJ, w, cO, bf, ajf, e, O, dv, cy, t, DB, mR, Pv, fH, bze, R, g, fe, aC, du, gJ, aWN, fO, ft, vc, od, aDE, fx, jT, xx, gg, aml, f, aaz, bm, fc, cT, xb, pv, bk, i, bq, bP, id, X, iP, eu, mk, ix, kY, cA, U, xU, y, uD, co, ak, aDD, cs, bu, Db, cc, B, iv, Qw, av, fy, pP, iT, be, V, ae, beW, v, LG, bt, uu, cl, qH, fJ, W, eF, PY, fw, add, gA, lm, iu, Dg, aG, adJ, b, aF, bg, KN, zj, fl, tG, aO, d, Fp, bb, re, q, mL, sR, n, jG, u, dh, o, sz, aDu, l, ir, Mi, LR, KL, gL, ad, G, aGn, rO, xv, jH, ao, aEs, HN, eo, na, dn, fl, l, di, brU, BK, bL, A, eZ, fr, Kz, adK, ds, xa, vg, bj, m, qs, lE, aX, h, aE, cB, qB, fP, aV, aPl, ma, si, tP, cV, xf, sB, J, dt, P, T, ll, ji, Bb, by, aM, eJ, qp, ii, Jh, ME, j, at, eG, gf); #c1 (HSPA4L) c2(NP_055093) c3(5215) c4(31329, 44386, 57443, 18272, 70500) c5(f, J, cp); #c1(HSPA5) c2(NP_005338) c3(5216) c4(31330, 44387, 57444, 18273, 70501) c5(f, aw, gG, dB, w, bf, e, O, JF, cc, gm, bp, ft, od, x, jT, dL, jE, fN, ag, i, aA, cY, fU, bw, U, kV, y, co, amo, ak, bKv, bu, alY, B, cs, oD, fy, bm, fY, nl, V, ok, adC, v, gv, eX, iA, JY, gA, ahU, b, bMh, bg, ey, d, jh, hV, q, X, ar, jG, u, dh, o, fs, l, qL, ad, G, vw, JH, nV, iR, aE, fl, akX, oC, A, k, fr, lk, xf, HS, iL, bj, Ir, aX, aGp, F, cU, yd, ma, cV, aMH, J, W, T, fO, by, aM, iB, bh, at); #c1(HSPA6) c2(NP_002146) c3(5217) c4(31331, 44388, 57445, 18274, 70502) c5(bL, A, vg, b, f, cT, gL, mk, vc, B, tG); #c1(HSPA8) c2(NP_006588) c3(5218) c4(31332, 44389, 57446, 18275, 70503) c5(bP, B, b, A, di, bV, iL, O, kV, e, y, d, co, aX, bj, f, bu, ar, xl, cs, bBM, u, o, fh, em, aC, sX, BT, fO, gL, ad, T, eX, akX, x, cy, jG, en, aH, HN, in, aNw, bk, fD, fl, bM, at); #c1(HSPA9) c2(NP_004125) c3(5219) c4(31333, 44390, 57447, 18276, 70504) c5(by, A, aw, b, dB, xa, Lq, U, bj, h, f, N, q, bu, M, ky, B, Lf, bK, n, bm, o, fh, V, ae, cV, kt, cs, hv, v, dt, P, T, Nh, aXL, J, ad, jE, gs, he, at, ci, rn); #c1(HSPB1) c2(NP_001531) c3(5220) c4(31334, 44391, 57448, 18277, 70505) c5(dx, B, dB, aN, w, cO, bf, aK, e, O, dv, cy, b, t, jM, aC, bK, du, bp, ft, od, x, fx, jT, bMk, OA, ami, bMi, ag, cT, qP, i, aXi, bq, bsZ, cG, Zx, wy, U, aWu, y, co, sT, f, bu, cs, fB, av, fy, bm, V, v, bQ, alM, bt, jC, JY, kW, py, PY, fw, ji, ap, ck, am, dk, z, jy, d, bb, cN, bCK, q, X, ar, as, sK, u, brV, kF, Mi, KL, gL, ad, G, aZE, an, PL, DR, dh, gd, dn, Mp, A, fr, pR, bgW, fs, asN, aX, h, F, bMj, aoY, RQ, awo, aV, ma, cV, an, sB, J, P, bkt, T, fO, by, ac, aM, Y, xx, cH, uG, at, ja); #c1(HSPB2) c2(NP_001532) c3(5221) c4(31335, 44392, 57449, 18278, 70506) c5(dx, B, aN, w, bf, aK, e, O, dv, cy, dl, jM, aC, bK, bgW, fO, ft, od, fx, jT, xx, aml, bMi, ag, cT, qP, i, aXi, bq, bsZ, cG, Zx, wy, U, aWu, y, co, sT, f, bu, cs, av, V, v, bQ, bt, jC, JY, py, fw, ov, ap, ck, b, jy, d, jh, bb, kW, q, X, ar, as, u, brV, kF, Mi, KL, ad, aZE, ao, DR, HN, dh, gd, dn, A, fr, pR, fs, asN, aX, h, F, aoY, RQ, aV, du, cV, an, sB, J, bkt, T, by, aM, Y, cH, uG, at); #c1(HSPB3) c2(NP_006299) c3(5222) c4(31336, 44393, 57450, 18279, 70507) c5(dx, ml, aN, w, bf, aK, e, O, cU, dv, cy, AX, kz, jM, aC, bK, du, fO, ft, od, fx, jT, xx, gg, pq, aml, bMi, ag, cT, qP, i, aXi, aZA, aA, bsZ, cG, Zx, wy, rd, O, aWu, bF, y, co, sT, f, bu, B, cs, av, fy, be, V, ae, v, gv, bQ, bt, bq, jC, iA, JY, en, py, fw, ap, ake, ck, b, m, rV, jy, eV, Mr, d, bb, kW, q, X, ar, qu, HE, u, brV, kF, il, Mi, KL, ad, as, aZE, ao, DR, dh, gd, dn, A, fr, pR, bgW, gE, fs, asN, aX, I, h, F, aoY, Vr, ik, RQ, cV, an, hZ, sB, J, bkt, T, ll, by, aM, Y, UE, cH, bMl, uG, bh, at); #c1(HSPB6) c2(NP_653218) c3(5223) c4(31337, 44394, 57451, 18280, 70508) c5(hR, f, q, aN, ds, gP, mR, akK, dh, at); #c1(HSPB7) c2(XP_011539551) c3(5224) c4(31338, 44395, 57452, 18281, 70509) c5(c, ml, b, dB, xh, mR, cO); #c1(HSPB8) c2(NP_055180) c3(5225) c4(31339, 44396, 57453, 18282, 70510) c5(A, aw, b, cG, aN, AA, w, y, jT, aX, cN, f, bu, aKH, kz, B, KL, OA, u, brV, o, aC, bK, v, J, ny, bb, by, bMk, jG, ac, aL, ao, bMi, BX, Y, hX, bMm, ip, cH, i, l, al, anx, aaA, bMn); #c1(HSPB9) c2(NP_149971) c3(5226) c4(31340, 44397, 57454, 18283, 70511) c5(ck); #c1(HSPBAP1) c2(NP_078886) c3(5227) c4(31341, 44398, 57455, 18284, 70512) c5(hS, f); #c1 (HSPBP1) c2(NP_001123578) c3(5228) c4(31342, 44399, 57456, 18285, 70513) c5(g, aC, bp); #c1(HSPD1) c2(NP_002147) c3(5229) c4(31343, 44400, 57457, 18286, 70514) c5(dx, B, blZ, bx, gG, dB, bf, dv, AX, DB, dl, Pv, aFn, aC, du, fO, bN, fl, fx, oh, su, dH, gs, bm, bMo, aEL, cT, dh, bk, bq, aA, bT, cE, X, aHb, aFy, ig, ix, afo, vl, xU, BL, yX, fF, f, bu, Us, av, aOS, is, nl, lT, cd, v, bMq, bt, cK, ack, abs, ap, ago, kE, b, aF, Of, A, ey, Fp, k, q, ar, aBl, sR, sK, aEG, bMd, o, aDu, sX, gL, by, lo, bMe, jH, bMs, ch, eo, gd, Bm, VT, l, azt, bMr, aED, sO, jc, di, qX, iL, eO, bMp, F, aE, aq, aFc, ax, cV, sj, be, P, T, ll, aM, aDy, aPd, at, vt, gl); #c1(HSPE1) c2(NP_002148) c3(5230) c4(31344, 44401, 57458, 18287, 70515) c5(zM, m, b, X, bJF, YA, f, q, cK, bN, aEL, P, T, Bm, abs, vp, av, bm, iA); #c1(HSPG2) c2(NP_001278789) c3(5231) c4(31345, 44402, 57459, 18288, 70516) c5(dx, B, eH, cO, yi, blL, anW, b, XZ, aPs, sH, du, aB, jE, tO, ag, cT, eT, aA, aaA, ald, Dr, asf, eu, kB, sF, vl, y, bhG, co, ps, f, e, cs, vo, av, bm, jB, wB, cd, zS, xm, LX, d, q, jV, Um, as, u, aE, o, dG, fs, il, bmJ, by, et, nV, bMt, ch, xN, HV, de, lb, A, EN, NA, di, C, iL, al, U, c, abe, l, Bi, ik, hW, P, aX, AP, rM, apR, ID, aLp, at, rb); #c1(HSPH1) c2(NP_001273432) c3(5232) c4(31346, 44403, 57460, 18289, 70517) c5(jl, V, b, dA, dB, f, HN, gm, q, ag, P, U, jT, pp); #c1(HTATIP2) c2(NP_001091990) c3(5233) c4(31347, 44404, 57461, 18290, 70518) c5(B, aw, b, A, U, e, y, d, co, aX, pp, kJ, f, q, bu, ar, aV, u, fU, V, bp, W, P, T, fy, ag, ji); #c1(HTN1) c2(NP_002150) c3(5234) c4(31348, 44405, 57462, 18291, 70519) c5(jh, acS, J, cz, M, acR); #c1(HTN3) c2(NP_000191) c3(5235) c4(31349, 44406, 57463, 18292, 70520) c5(dx, b, eW, vl, y, dv, S, bu, M, nl, u, ae, kt, du, J, W, T, Jj, aX, yE, i, bHl, aT); #c1(HTR1A) c2(NP_000515) c3(5236) c4(31350, 44407, 57464, 18293, 70521) c5(de, ux, abu, wZ, tR, Ey, qa, hex, ak, bMu, cA, If, al, gZ, bj, aaf, cM, m, la, o, sG, fq, wr, f, fa, aqD, dl, vu, ik, aW, aUb, qA, ar, DY, aE, tQ, zb, dj, ali, hW, aqz, bK, Gu, nu, xJ, cz, Rj, Ql, aqL, Wi, bu, wW, to, Fp, aY, iZ, cG, ih, ape, bMw, oN, dc, dd, aqV, bMv, wX, RB); #c1(HTR1B) c2(NP_000854) c3(5237) c4(31351, 44408, 57465, 18294, 70522) c5(jJ, f, aw, vd, GF, tR, bMx, dd, ak, lW, cA, wX, A, iA, cM, TC, bhZ, sG, ayB, wr, aqs, akl, oE, cU, do, vu, zM, qu, Gj, dh, aXy, dj, hW, cV, dc, nu, cx, cz, IR, IX, xq, T, Gl, rV, mQ, jv, vv, rQ, aqw, aY, iZ, aQM, cC, ih, aaf, IS, aop, i, Gu, l, di, aA, jP, rr, RB); #c1(HTR1E) c2(XP_011534092) c3(5238) c4(31352, 44409, 57466, 18295, 70523) c5(sG, bq, wZ, cM); #c1(HTR1F) c2(NP_000857) c3(5239) c4(31353, 44410, 57467, 18296, 70524) c5(o, ak, sG, HV, bBG, ns, nm, nt, nq, nr, nn, no, np, cM); #c1(HTR2A) c2(NP_000612) c3(5240) c4(31354, 44411, 57468, 18297, 70525) c5(f, lK, Hv, aDe, aN, ns, nm, dd, nq, nr, nn, bf, no, np, aK, e, bhZ, jv, hH, dl, do, zb, kX, aqQ, HX, aC, sH, od, Gl, bMA, hR, Ew, bMB, ro, akn, dS, tO, bk, dc, nt, aA, aUr, azR, id, Jy, cO, hS, mA, wX, cA, lf, cM, TC, bhG, rr, ak, aUi, ky, tQ, QD, em, nu, bMF, lM, v, cx, lh, eX, bq, cy, zf, gv, lb, ack, sK, aY, bcK, bMy, tl, jP, ap, bME, bn, GL, jJ, rV, ey, gZ, aO, bMD, d, wZ, bb, vf, vu, qu, DY, u, bop, aVS, da, l, Jt, j, cz, pB, Ql, rQ, ch, tW, he, ih, aaf, o, dn, HV, l, aaT, bMC, aDF, de, oC, tR, EE, di, bj, Wi, qs, Wj, ob, sG, fq, wr, aqs, aeY, oE, tF, iZ, y, cB, CH, dj, hW, cV, bMz, ll, mQ, vv, aM, to, at, Fp, xM, tA, vW, aal, jN, bh, RB); #c1(HTR2B) c2(NP_000858) c3(5241) c4(31355, 44412, 57469, 18298, 70526) c5(b, vd, cO, di, lW, Co, wZ, sG, rr, vf, q, gP, lV, lR, lX, xd, nk, mA, vW, lS, bh, aA); #c1(HTR2C) c2(NP_001243689) c3(5242) c4(31356, 44413, 57470, 18299, 70527) c5(bME, de, ak, jJ, dj, tR, ns, nm, nt, nq, nr, nn, cA, bf, no, xw, bj, cM, bMD, wZ, np, bhQ, he, sG, wr, f, bBG, bMG, oE, bMl, vu, bMJ, Gj, ov, tQ, zb, Gl, o, hW, aqQ, l, cV, dc, nu, cx, sG, wX, eX, iy, gF, cz, lV, aM, Ew, rQ, gt, aY, nc, iZ, tA, bcK, ih, aaf, vf, bLI, rv, HV, aaT, aA, bMH, ap); #c1(HTR3A) c2(NP_000860) c3(5243) c4(31357, 44414, 57471, 18300, 70528) c5(ak, b, GL, jJ, ns, nm, nt, nq, nr, nn, cA, wX, no, np, bcl, Ag, wZ, qc, rr, f, gA, jV, vu, cM, gu, u, zb, dj, Gr, hW, aqQ, lb, dc, nu, cz, xq, iN, rV, akn, aY, nc, ih, sG, bMK, Gu, jP); #c1(HTR3B) c2(NP_006019) c3(5244) c4(31358, 44415, 57472, 18301, 70529) c5(jJ, ns, nm, nt, nq, nr, nn, cA, no, np, bcl, Ag, wZ, ak, cM, oD, Gj, u, zb, Yk, dj, Gr, hW, aqQ, aY, gA, dc, jP); #c1(HTR3C) c2(NP_570126) c3(5245) c4(31359, 44416, 57473, 18302, 70530) c5(b, cz, gA, qu, rV, u); #c1(HTR3D) c2(NP_001138615) c3(5246) c4(31360, 44417, 57474, 18303, 70531) c5(qu, Ag, gA, u, rV); #c1(HTR3E) c2(NP_001243542) c3(5247) c4(31361, 44418, 57475, 18304, 70532) c5(Ag, rr, gA, gu, rV, u); #c1(HTR4) c2(NP_000861) c3(5248) c4(31362, 44419, 57476, 18305, 70533) c5(m, dj, hR, bb, b, Jr, sX, tW, f, wZ, Jq, cz, W, sG, aer, ak, aZ, cO, l, DF, rr); #c1(HTR5A) c2(NP_076917) c3(5249) c4(31363, 44420, 57477, 18306, 70534) c5(dj, ak, hW, sG, f, wZ, cz, Gl, cA, cM); #c1(HTR7) c2(NP_000863) c3(5250) c4(31364, 44421, 57478, 18307, 70535) c5(ak, jj, jJ, ld, ns, nm, nt, nq, nr, nn, no, np, aaf, cM, wZ, sG, rr, f, oD, oN, hW, bK, xJ, cz, T, Gl, aY, aQh, ih, eB, dc, bEZ, bML); #c1(HTRA1) c2(NP_002766) c3(5251) c4(31365, 44422, 57479, 18308, 70536) c5(dx, aw, b, X, Of, UA, bMM, wf, GV, bj, fx, y, jh, agM, aX, aSQ, f, nv, bu, cU, aW, av, u, o, be, E, l, aC, bK, sH, du, bp, by, Fo, iA, iP, Uy, eQ, aJy, bMN, xU, agN, dX, i, aco, ji); #c1(HTRA2) c2(NP_037379) c3(5252) c4(31366, 44423, 57480, 18309, 70537) c5(b, X, dB, dk, vZ, bj, aX, f, cU, kz, sR, cs, fH, av, si, v, bMO, T, Nh, x, iA, ad, fJ, ao, xM, zX); #c1(HTRA3) c2(NP_001284488) c3(5253) c4(31367, 44424, 57481, 18310, 70538) c5(co, b, X, f, bp, cU, Ca, av, iA); #c1(HTRA4) c2(NP_710159) c3(5254) c4(31368, 44425, 57482, 18311, 70539) c5(gA, eQ); #c1(HTT) c2(NP_002102) c3(5255) c4(31369, 44426, 57483, 18312, 70540) c5(ux, A, lr, bS, b, Kz, oH, cO, cA, si, xw, kV, LP, aKE, bfJ, gZ, S, bj, cz, f, HW, mL, afl, cM, KL, RA, fH, nR, u, dh, o, zb, Hl, ma, hW, afx, bK, bmp, v, dt, qu, Ql, Re, cV, mD, ew, rV, J, hR, fJ, hX, xM, ih, bMP, zp, bMQ, ahm, y, ap); #c1(HUNK) c2(NP_055401) c3(5256) c4(31370, 44427, 57484, 18313, 70541) c5(RD, l, cV, ar, ah, qB, u); #c1(HUS1B) c2(NP_683762) c3(5257) c4(31371, 44428, 57485, 18314, 70542) c5(cV); #c1(HUS1) c2(NP_004498) c3(5258) c4(31372, 44429, 57486, 18315, 70543) c5(ao, og, T, i, l, u, ac); #c1(HUWE1) c2(XP_005262022) c3(5259) c4(31373, 44430, 57487, 18316, 70544) c5(nz, nU, po, dB, P, ll, bLP, bMR, ff); #c1(HVCNI) c2(XP_011537150) c3(5260) c4(31374, 44431, 57488, 18317, 70545) c5(fr, vp); #c1(HYAL1) c2(NP_149349) c3(5261) c4(31375, 44432, 57489, 18318, 70546) c5(A, aw, b, X, fU, IW, e, O, hh, B, F, cU, y, bMS, av, u, d, ax, LG, bp, T, fx, JN, dH, i); #c1(HYAL2) c2(XP_005265582) c3(5262) c4(31376, 44433, 57490, 18319, 70547) c5(b, eu, w, lW, Co, e, O, hh, co, jl, js, cU, DZ, y, bMS, ar, u, d, fU, gm, bp, lX, jT, DO); #c1(HYAL3) c2(NP_001186959) c3(5263) c4(31377, 44434, 57491, 18320, 70548) c5(cU, iA, fU, O, b); #c1(HYAL4) c2(XP_011514292) c3(5264) c4(31378, 44435, 57492, 18321, 70549) c5(hh, Ug); #c1(HYDIN) c2(NP_001185471) c3(5265) c4(31379, 44436, 57493, 18322, 70550) c5(MW, Pu, vt, bMT, cz); #c1(HYKK) c2(NP_001013641) c3(5266) c4(31380, 44437, 57494, 18323, 70551) c5(co, bp, bMV, l, ji, bMU); #c1(HYLS1) c2(NP_659451) c3(5267) c4(31381, 44438, 57495, 18324, 70552) c5(bMW, VP, aw, beu); #c1(HYOU1) c2(NP_001124463) c3(5268) c4(31382, 44439, 57496, 18325, 70553) c5(A, l, b, f, by, nM, w, B, bf, vw, akX, aA, at, dh, O, aM); #c1(HYPM) c2(NP_036406) c3(5269) c4(31383, 44440, 57497, 18326, 70554) c5(ao); #c1(IAPP) c2(NP_000406) c3(5270) c4(31384, 44441, 57498, 18327, 70555) c5(bm, by, A, aw, jT, b, iF, cY, ey, Id, hS, w, di, kY, z, mL, U, aK, LP, y, MT, co, aX, eA, bll, E, h, f, F, q, apw, bu, M, kz, fx, B, cs, fB, bf, fy, u, aE, iT, n, mz, be, V, l, fJ, LR, BC, cx, fO, gm, T, eq, fH, J, nP, akK, aA, aM, VF, jE, qp, iK, wn, ch, eQ, vU, PY, mA, eo, ag, cT, oi, ZL, i, mD, aT, fD, re); #c1(IARS2) c2(NP_060530) c3(5271) c4(31385, 44442, 57499, 18328, 70556) c5(ake, f, fl, l, sK); #c1(IARS) c2(NP_038203) c3(5272) c4(31386, 44443, 57500, 18329, 70557) c5(A, b, jz, lv, aM, bf, y, jQ, bQ, f, q, B, hb, sK, u, em, l, T, ll, DP, wV, bm, QG, wP, aA, Nu); #c1(IBA57) c2(NP_001010867) c3(5273) c4(31387, 44444, 57501, 18330, 70558) c5(oD, aA, hT, bMX); #c1(IBSP) c2(NP_004958) c3(5274) c4(31388, 44445, 57502, 18331, 70559) c5(A, b, arB, X, BY, fx, y, cp, d, it, co, aX, zJ, re, B, e, ar, O, hb, av, fy, u, jZ, iT, bwk, aC, fO, T, fT, kJ, ag, i, aG); #c1(IBTK) c2(NP_056340) c3(5275) c4(31389, 44446, 57503, 18332, 70560) c5(at); #c1(ICA1) c2(NP_001263407) c3(5276) c4(31390, 44447, 57504, 18333, 70561) c5(m, A, bMY, yV, cV, aC, er, fP, B, qB, bf, aV, iu, aE, aM); #c1(ICAM1) c2(NP_000192) c3(5277) c4(31391, 44448, 57505, 18334, 70562) c5(dx, by, en, pV, dN, sd, dD, wN, DT, aE, aN, eW, sJ, w, il, vl, aw, gE, eD, fx, O, cp, dv, cy, Ob, t, pq, aDx, e, jG, iT, Li, asA, aOR, bw, jC, Hs, RQ, g, mz, og, aC, nl, sH, du, gm, fO, aMr, xO, ra, BW, x, gt, agg, Ka, gg, dH, jE, aFN, gs, BX, dS, yw, DO, mE, we, fc, cT, oi, wU, dh, i, dc, vJ, bq, aA, jl, bT, rn, sU, bP, mZ, wa, id, td, bNc, zu, cY, EB, iP, jz, jf, Kc, kB, aFm, dV, iG, vp, GV, Iw, U, aEl, cM, V, gB, co, BL, px, pp, ag, ml, f, cs, bu, xb, dZ, ky, B, Bs, jD, av, fy, bm, fY, bNb, bNa, d, jB, GS, azd, yV, ae, eE, yY, Fv, v, gv, WM, aDl, eX, bt, iy, fU, wR, aH, wu, fD, aY, vZ, aGx, jo, fw, vH, TQ, tl, ji, iu, bwi, EG, aG, aaW, afE, ny, b, zH, aF, anb, atU, eR, aDA, A, yU, ic, aaG, z, ey, re, eV, aO, yK, dl, aem, bb, aW, Lq, vj, hV, q, jV, ap, X, dQ, ac, p, sR, ar, yW, sK, u, nj, ri, ff, da, PJ, MO, Zz, l, im, kt, anZ, bJZ, pk, gL, ad, BZ, G, dy, rw, Fk, Aj, et, Jl, jU, P, jH, ao, nV, hU, ig, iC, ch, DR, kg, dr, gd, ix, fl, o, aqq, l, aU, yA, fh, cK, y, Pp, bL, bMZ, bf, k, fr, eO, gn, pD, axA, di, lv, iL, DM, wf, PL, ajT, ft, aDt, eb, jQ, bk, m, aX, or, aQk, wG, h, aBx, n, VS, M, bn, ik, sb, cB, qB, Dj, fP, aV, jZ, Yb, Hl, wF, ma, bwj, apx, cV, hZ, xf, be, dB, J, Oc, gC, axl, ti, T, ll, aFt, pw, nP, gY, fz, qe, aM, j, jT, nk, ip, LQ, Jh, Ic, Dl, auy, fq, gj, bh, at, eG, gf, rZ); #c1(ICAM2) c2(NP_001093259) c3(5278) c4(31392, 44449, 57506, 18335, 70563) c5(d, jH, b, cd, bu, ag, P, Cz, fO, XO, by, e); #c1(ICAM3) c2(NP_002153) c3(5279) c4(31393, 44450, 57507, 18336, 70564) c5(sQ, il, aC, re, yh, P, ik, gE, jT, bT, iT); #c1(ICAM4) c2(NP_001034221) c3(5280) c4(31394, 44451, 57508, 18337, 70565) c5(m, A, gt, l, B, fO, tQ, gE, bNd, u, y); #c1(ICAM5) c2(NP_003250) c3(5281) c4(31395, 44452, 57509, 18338, 70566) c5(d, m, A, ip, b, B, fO, T, rb, gE, u, e, y); #c1(ICE1) c2(NP_056140) c3(5282) c4(31396, 44453, 57510, 18339, 70567) c5(at, di); #c1(ICE2) c2(NP_001263314) c3(5283) c4(31397, 44454, 57511, 18340, 70568) c5(dd); #c1(ICK) c2(NP_057597) c3(5284) c4(31398, 44455, 57512, 18341, 70569) c5(aw, b, MS, w, lv, bNe, O, co, aX, kJ, l, t, h, f, cs, u, g, fO, ad, P, jT, Ut, G, ag, cT, fl, alQ); #c1(ICMT) c2(XP_011539442) c3(5285) c4(31399, 44456, 57513, 18342, 70570) c5(lJ, fl, b, kJ, fr, eX, ft); #c1(ICOS) c2(NP_036224) c3(5286) c4(31400, 44457, 57514, 18343, 70571) c5(dx, WH, td, b, qz, eu, mW, ig, xD, Dy, lS, aW, m, jl, dv, aX, kn, fq, re, aEq, dl, y, zQ, aV, u, gl, aFM, cW, du, yV, aC, awD, jU, gL, CM, ti, ll, cy, JN, ac, pb, jT, nk, ii, dP, sS, aei, aE, abN, Ot, cT, bNf, gO, iB, gE, iu, bT, rn, Jo); #c1(ICOSLG) c2(NP_001269979) c3(5287) c4(31401, 44458, 57515, 18344, 70572) c5(WH, Kt, ig, NH, Pl, O, cy, aX, DG, h, bu, do, aaZ, fP, aE, aC, J, by, BL, gY, jH, NG, sS, pH); #c1(ID1) c2(NP_002156) c3(5288) c4(31402, 44459, 57516, 18345, 70573) c5(B, b, X, A, di, lW, bw, fx, y, d, gB, co, aX, fv, re, hV, e, jV, bu, ik, O, hb, ar, av, fy, u, Ox, iT, da, eg, I, Be, J, fO, by, T, nP, et, gg, yG, nV, ch, ag, Af, i, ji, at, iu, rb); #c1(ID2) c2(NP_002157) c3(5289) c4(31403, 44460, 57517, 18346, 70574) c5(bP, gK, A, iq, b, X, eH, mk, di, wf, uy, e, O, d, h, gz, q, jV, B, cB, cs, fH, av, Qx, Pz, cV, gm, bp, T, fO, fJ, tf, aE, fD); #c1(ID4) c2(NP_001537) c3(5290) c4(31404, 44461, 57518, 18347, 70575) c5(g, A, aw, b, X, mk, w, U, e, y, cp, oy, Ag, ave, t, h, B, bu, ar, O, av, u, Qx, yJ, d, V, J, by, da, T, fx, jT, bNg, cT, Af, i); #c1(IDE) c2(NP_001159418) c3(5291) c4(31405, 44462, 57519, 18348, 70576) c5(gk, X, aN, di, bf, ey, bj, bQ, aK, eX, aE, o, mz, kF, I, cV, gF, aT, aM, tW, mA, aA); #c1(IDH1) c2(NP_001269315) c3(5292) c4(31406, 44463, 57520, 18349, 70577) c5(aw, auQ, gG, Vz, HG, w, pz, O, ajF, t, dl, blx, g, og, cs, po, bp, ME, Lw, jT, aHi, jE, fy, auk, os, qP, bkQ, Dr, bNi, hS, bw, U, FA, y, ajx, ps, f, N, iv, bdd, bm, em, V, hf, WL, YE, bNh, auK, bzM, jR, gR, ci, pv, b, jq, ic, Mr, hV, q, jV, ra, OC, ar, RF, jG, u, fs, bEg, ad, G, Ut, WZ, jH, nV, anG, kB, yC, bdc, Ol, aJR, A, k, fr, gw, JG, bNj, QV, aX, h, rc, Ug, M, n, fP, hW, Fs, J, P, T, jl, fT, pF, bEy, auy, ja); #c1(IDH2) c2(NP_001276839) c3(5293) c4(31407, 44464, 57521, 18350, 70578) c5(dx, hV, aw, b, k, fr, Hk, gw, Vz, pz, HG, kB, FA, w, ic, JG, cK, ot, ps, fT, xl, cp, M, dv, aX, aJB, t, h, f, N, q, jV, dl, Mr, mR, O, blx, iv, ar, jG, bdd, bm, n, g, em, gG, aRV, hf, nW, du, Fs, J, bp, pF, ME, alT, T, bEg, Lw, YE, jT, Ut, jE, nV, anG, auk, bdc, G, os, qP, fP, bdb, Ol, pv, ci, ap); #c1(IDH3B) c2(NP_001245313) c3(5294) c4(31408, 44465, 57522, 18351, 70579) c5(nW, bu, bNk); #c1(IDNK) c2(NP_001001551) c3(5295) c4(31409, 44466, 57523, 18352, 70580) c5(di); #c1(IDO1) c2(NP_002155) c3(5296) c4(31410, 44467, 57524, 18353, 70581) c5(en, b, X, dB, eW, IC, gE, al, gZ, cM, hh, jh, co, jl, qc, h, f, q, y, cs, hV, av, aV, u, fY, ff, aPQ, aC, Dg, sH, v, gL, ad, jo, bkt, aDU, bt, jC, xx, jU, jH, nV, bJC, aY, eQ, Oa, P, xU, fP, dc, eG, bT); #c1(IDO2) c2(NP_919270) c3(5297) c4(31411, 44468, 57525, 18354, 70582) c5(bw, dB, BQ, b, ag); #c1(IDS) c2(NP_000193) c3(5298) c4(31412, 44469, 57526, 18355, 70583) c5(Fp, gZ, aw, xk, aei, bmJ, agP, gw, LG, ajW, dt, adp, xP, dZ, dV, bNl, KK, dR, u, y, kA); #c1(IDUA) c2(NP_000194) c3(5299) c4(31413, 44470, 57527, 18356, 70584) c5(bL, nU, bNm, b, Rr, sl, aCb, w, wf, aX, kJ, f, F, bu, DZ, mg, u, o, aLt, em, si, IU, LG, by, dt, hR, pq, MW, hT, aaS, kA, atg); #c1(IER2) c2(NP_004898) c3(5300) c4(31414, 44471, 57528, 18357, 70585) c5(b); #c1(IER3) c2(NP_003888) c3(5301) c4(31415, 44472, 57529, 18358, 70586) c5(b, eu, mW, mk, ix, di, bw, U, O, m, t, f, aDD, jV, bu, y, aV, bm, gl, n, da, Pz, V, J, gL, by, fO, jU, JY, jE, u, fG, ag, fP); #c1(IER3IP1) c2(NP_057181) c3(5302) c4(31416, 44473, 57530, 18359, 70587) c5(mB, f, hS, bNo, bf, bNn, aM); #c1(IER5) c2(NP_057629) c3(5303) c4(31417, 44474, 57531, 18360, 70588) c5(oy, bkb, h); #c1(IFFO1) c2(NP_001034759) c3(5304) c4(31418, 44475, 57532, 18361, 70589) c5(X, av); #c1(IFFO2) c2(XP_011538932) c3(5305) c4(31419, 44476, 57533, 18362, 70590) c5(bb); #c1(IFI6) c2(NP_001193496) c3(5306) c4(31420, 44477, 57534, 18363, 70591) c5(A, b, fr, mW, kB, e, y, d, m, B, F, M, X, aV, u, gl, fe, gL, ft, bcL, P, T, ll, nP, fl, Jc); #c1(IFI27) c2(NP_001275885) c3(5307) c4(31421, 44478, 57535, 18364, 70592) c5(dx, en, aw, gG, dB, w, e, O, yg, dv, iy, og, du, gm, fO, gY, fx, jT, wh, yE, cT, i, bT, X, iP, jz, Ku, iG, U, y, co, ag, DM, f, N, bu, B, cs, av, fy, bm, iT, iF, jB, V, qq, Qz, ad, aEw, Hh, d, dY, b, aF, hh, jh, apl, re, hV, q, DC, dQ, jG, u, o, da, by, et, aoO, nV, fg, bL, A, k, gn, EN, jR, iL, gE, jw, al, jQ, aX, h, F, cU, n, cB, cV, J, W, P, T, aDA, Ap, fM, E, Oi); #c1(IFI30) c2(NP_006323) c3(5308) c4(31422, 44479, 57536, 18365, 70593) c5(aX, h, eX, gv, bcW, tl, bh, gj, bf, ey, aM, aA, ap); #c1(IFI35) c2(NP_005524) c3(5309) c4(31423, 44480, 57537, 18366, 70594) c5(X, aC, en, aeq, ll); #c1(IFI44) c2(XP_011538818) c3(5310) c4(31424, 44481, 57538, 18367, 70595) c5(wV, en, aw, bo, b, ck, DM, B, eu, wP, P, kz, aJ, VT, aC, al, gE, A, ac); #c1(IFIH1) c2(NP_071451) c3(5311) c4(31425, 44482, 57539, 18368, 70596) c5(EO, en, b, oz, aMr, mW, IE, w, di, cl, bf, U, xe, lS, bNp, m, aX, Jo, f, q, cy, eE, dQ, aE, gB, dH, gl, da, lk, aBz, l, aC, Dg, gL, pF, P, aFj, EQ, BL, ajd, aM, aV, ig, iz, rq, nj, bNq, iu, ll); #c1(IFIT1) c2(NP_001257858) c3(5312) c4(31426, 44483, 57540, 18369, 70597) c5(m, en, BL, b, k, X, Xu, Bu, gL, ll, bq, eG); #c1(IFIT2) c2(NP_001538) c3(5313) c4(31427, 44484, 57541, 18370, 70598) c5(d, en, aX, aiW, gL, T, ll, dQ, U, e); #c1(IFIT3) c2(NP_001276687) c3(5314) c4(31428, 44485, 57542, 18371, 70599) c5(iw, en, m, aq, v, J, Fo, od, u); #c1(IFIT5) c2(NP_036552) c3(5315) c4(31429, 44486, 57543, 18372, 70600) c5(en); #c1(IFITM1) c2(NP_003632) c3(5316) c4(31430, 44487, 57544, 18373, 70601) c5(V, b, X, Tw, bu, ik, gE, ar, U, by); #c1(IFITM2) c2(NP_006426) c3(5317) c4(31431, 44488, 57545, 18374, 70602) c5(X, cs); #c1(IFITM3) c2(NP_066362) c3(5318) c4(31432, 44489, 57546, 18375, 70603) c5(jH, en, aX, aeq, b, ad, W, gd, vm, ll, cs, x); #c1(IFITM5) c2(NP_001020466) c3(5319) c4(31433, 44490, 57547, 18376, 70604) c5(zF, bNr, bNs, zw); #c1(IFNA10) c2(NP_002162) c3(5320) c4(31434, 44491, 57548, 18377, 70605) c5(aX, ic, vQ, sN); #c1(IFNA13) c2(NP_008831) c3(5321) c4(31435, 44492, 57549, 18378, 70606) c5(avO, dx, f, aw, aZ, WH, aiW, dB, aE, lp, aDg, sJ, w, bkJ, pV, OH, e, O, vr, dv, cy, ajF, apd, t, AX, aDx, aD, et, kX, jC, gl, awq, sE, aC, bxO, du, fO, gm, bp, ft, od, cV, fx, JN, dL, pq, jE, xO, bdW, eW, aei, fN, sS, DO, bY, bkk, fc, cT, oi, pv, bk, i, dc, pt, aA, rn, EO, Kt, pD, fi, X, ie, asL, iP, jz, eu, bNv, ig, ix, NH, iG, bf, U, xw, cM, co, rY, px, yX, ps, DM, hg, N, cs, vQ, bu, gX, B, iv, pH, av, fy, bm, iF, nl, V, ae, Cq, NZ, gv, lR, hi, bt, rT, gX, cl, en, bkR, dP, aY, kJ, Oa, jo, dY, zT, tl, oM, apD, Dg, bNt, bP, OG, kE, b, ag, DJ, m, bNu, z, gZ, fD, d, jh, fv, hV, g, Pc, dQ, RF, atT, ar, yW, aM, u, dh, ff, da, PJ, sQ, Fr, kt, aiU, BT, hv, j, ad, IX, G, jG, EQ, bNy, bc, jf, ajd, Ut, jU, yG, P, jH, nV, VQ, asm, bzf, sj, lS, Bm, Ol, fl, pz, zD, aKO, A, Pb, pF, fr, lk, mW, EN, BY, C, iL, gE, bNx, al, vl, jQ, c, xT, aX, lW, h, F, M, aEU, y, qB, aV, aq, jZ, Yb, fU, oS, hZ, bNw, be, J, dU, aoN, IC, T, ll, BL, by, ac, qT, VF, jT, eN, aeq, NG, zM, Dl, E, iB, bh, bNz, at, BW, Dg); #c1(IFNA14) c2(NP_002163) c3(5322) c4(31436, 44493, 57550, 18379, 70607) c5(cy, DM, J, vQ, Dl, ic, aX); #c1(IFNA16) c2(NP_002164) c3(5323) c4(31437, 44494, 57551, 18380, 70608) c5(aX, ic); #c1(IFNA17) c2(NP_067091) c3(5324) c4(31438, 44495, 57552, 18381, 70609) c5(b, X, bkJ, sJ, w, ic, iG, gE, e, d, jh, aX, re, ar, RF, av, aV, iT, iF, m, bp, ll, fx, jG, cW, bkR, sN, oi); #c1(IFNA1) c2(NP_076918) c3(5325) c4(31439, 44496, 57553, 18382, 70610) c5(avO, gK, f, pV, aZ, WH, aiW, dB, aE, lp, aDg, sJ, w, de, bkJ, aw, OH, e, O, vr, dv, cy, ajF, apd, t, AX, aDx, aD, et, kX, jC, gl, awq, sE, aC, bxO, du, fO, gm, bp, ft, od, cV, fx, JN, dL, pq, jE, xO, bdW, eW, aei, fN, sS, DO, bY, bkk, fc, cT, oi, pv, bk, i, dc, pt, aA, rn, EO, Kt, jz, fi, X, ie, asL, iP, bNB, eu, bNv, ig, Fr, ix, NH, iG, bf, bw, U, xw, cM, co, rY, px, yX, ps, DM, hg, N, cs, vQ, bu, gX, B, iv, pH, av, fy, bm, iF, nl, V, ae, Cq, NZ, gv, lR, hi, bt, rT, gX, cl, en, bkR, dP, aY, kJ, Oa, jo, dY, zT, tl, rr, oM, apD, fD, Dg, bNt, bP, OG, kE, b, ag, m, bNu, ic, z, gZ, jD, d, jh, fv, hV, q, Pc, dQ, RF, atT, ar, yW, aM, u, dh, ff, da, PJ, sQ, ac, kt, aiU, BT, hv, gL, ad, IX, G, jG, EQ, bNy, bc, jf, ajd, Ut, jU, yG, P, jH, nV, VQ, asm, pD, bzf, sj, lS, Bm, Ol, fl, pz, zD, aKO, A, Pb, pF, fr, lk, gn, mW, EN, BY, C, iL, gE, bNx, al, vl, jQ, c, xT, aX, lW, h, F, M, aEU, y, qB, bNA, aV, aq, jZ, Yb, fU, oS, hZ, bNw, be, J, dU, aoN, IC, T, ll, BL, by, aJN, qT, VF, jT, eN, aeq, NG, zM, Dl, j, E, iB, bh, bNz, at, BW, Dg); #c1(IFNA21) c2(NP_002166) c3(5326) c4(31440, 44497, 57554, 18383, 70611) c5(do, aX, ic, gE); #c1(IFNA2) c2(NP_000596) c3(5327) c4(31441, 44498, 57555, 18384, 70612) c5(avO, gK, aw, dB, aDg, sJ, w, cO, pz, e, cy, Vx, kX, gJ, bp, cV, fx, pq, fN, oi, i, dc, aZA, fO, vi, X, bkJ, jz, ve, mk, iG, lW, bw, Ei, ml, B, apf, vQ, iv, av, iF, ae, bND, bew, bNC, gv, hi, bq, bNE, fJ, aH, bkR, dY, iu, pv, afE, b, aF, qz, bNu, ic, z, HQ, d, jh, jd, re, q, ar, RF, jG, iR, aE, qy, pF, vS, fH, iw, nV, hU, VQ, Ck, ih, fg, aU, aKO, A, EN, C, iL, gE, al, hP, jQ, m, aX, fq, hN, n, jZ, si, oS, bd, P, ll, jl, hW, qT, VF, Dl, E, bh, bpe, DM); #c1(IFNA4) c2(NP_066546) c3(5328) c4(31442, 44499, 57556, 18385, 70613) c5(al, vQ, gL); #c1(IFNA5) c2(NP_002160) c3(5329) c4(31443, 44500, 57557, 18386, 70614) c5(m, aX, DM, q, vQ, lp, ic, gE, aDA, bw, bm, jZ); #c1(IFNA6) c2(NP_066282) c3(5330) c4(31444, 44501, 57558, 18387, 70615) c5(en, cy, DM, vQ, Dl, ic, gE, aX, al); #c1(IFNA7) c2(NP_066401) c3(5331) c4(31445, 44502, 57559, 18388, 70616) c5(vQ); #c1(IFNA8) c2(NP_002161) c3(5332) c4(31446, 44503, 57560, 18389, 70617) c5(cy, DM, vQ, Dl, ic, aX, pq); #c1(IFNAR1) c2(NP_000620) c3(5333) c4(31447, 44504, 57561, 18390, 70618) c5(en, bNE, mW, jf, amt, eW, j, iL, gE, bw, al, OH, U, cM, m, Ei, cy, ag, adR, bNG, AX, f, adO, q, Jq, bu, M, hN, adQ, fP, aV, ag, gl, pE, V, ae, cV, hZ, be, fO, gL, by, IR, IX, P, ll, cr, fx, et, iw, aAu, aY, bm, RE, jZ, ih, bdY, Dl, lS, i, dc, bh, eN, DM); #c1(IFNAR2) c2(NP_997467) c3(5334) c4(31448, 44505, 57562, 18391, 70619) c5(dx, eu, pD, DJ, ix, iL, gE, bw, al, Ei, cy, DM, q, M, hN, RQ, Dc, aV, aq, jZ, pE, Dg, du, fO, j, dB, gL, fc, bNH, ag, Dl, i, l, bh, Dq, ll); #c1(IFNB1) c2(NP_002167) c3(5335) c4(31449, 44506, 57563, 18392, 70620) c5(hg, aiW, dB, lp, sJ, w, e, O, cp, cy, t, mR, aEu, g, aC, ol, cs, fO, ME, aiL, jT, fp, sS, fc, ie, qP, agS, aA, EO, mZ, hT, bkw, wK, cY, iP, eu, sl, Ku, bw, U, y, co, BL, pp, Dq, f, vQ, bu, B, iv, av, fy, iT, d, V, ae, alf, aJV, iA, pi, en, jR, oj, bNl, bxn, asL, kE, b, Pv, aOQ, oi, ic, aAb, zL, aO, js, yK, jh, bb, re, q, X, dQ, pB, jG, u, dh, o, jj, sQ, Dg, gL, ad, G, ajd, Ut, aAu, aE, xY, Bm, fl, Lq, A, k, lk, gn, C, iL, gE, al, m, aX, h, cU, RQ, cB, aV, jZ, pE, cV, J, W, dU, P, T, ll, jl, by, qT, aeq, Y, abf); #c1(IFNE) c2(NP_795372) c3(5336) c4(31450, 44507, 57564, 18393, 70621) c5(aX, dA, oH, ic, bb, at, pi, ap); #c1(IFNG) c2(NP_000610) c3(5337) c4(31451, 44508, 57565, 18394, 70622) c5(ml, bOa, dB, aPi, lp, en, aw, OH, aeC, gM, jD, kJ, bJo, dl, CK, kz, cl, TP, aNq, mz, sE, aC, bxO, cs, aAe, aMr, ME, aEY, pq, alt, aei, pS, ie, OJ, ag, axC, pH, bk, fD, acM, aZA, aA, jl, aWj, mZ, X, asL, eu, ig, iG, bNP, bw, vl, cM, DG, yX, bOn, rr, hg, e, av, CX, DL, aFi, aFR, V, ae, Nw, Cq, nl, cd, aDl, ar, jC, J, aRS, fJ, pk, aY, dY, xe, bNO, abs, oM, ij, aG, ck, jJ, vY, bmz, bOb, HQ, aDO, yN, Be, oB, blS, aFA, aE, aAf, Jn, fs, il, gL, ad, aZE, bmy, Jl, ao, NA, mA, CL, VT, axN, bOo, zD, Pp, bOm, fr, bvu, aBs, gN, QV, EN, bhu, fe, C, iL, gE, Pl, jQ, bkK, xT, ajn, aQk, aTe, zv, Jk, aCH, NO, dj, m, an, be, bNQ, arx, bR, jo, IE, ft, aYw, aeq, Jh, lc, bOq, bOi, akm, fP, jh, hz, gl, dx, avb, iU, aWm, bf, aK, O, at, aDi, yh, bNZ, aHC, bOr, aFn, Zv, aoh, du, yO, gm, bp, atU, x, aCP, gs, aZg, sS, fc, sN, bOe, bT, bP, fl, bKn, iP, wF, aGq, mk, ix, Ku, cA, U, yt, amx, co, pw, aoR, f, aDD, fb, bu, tv, aZd, bOg, aLT, aFZ, yV, aSz, NZ, bNY, gv, ny, pt, cl, aZD, bNX, tm, nb, OW, tl, aLP, WH, Pv, bhr, z, zL, d, bOj, MX, qF, q, QE, se, ff, boq, yW, qT, iR, o, bNU, kt, LR, bOl, CM, aDU, aZ, jU, jH, rQ, Eu, asm, ch, xU, El, gd, fl, bNT, aiF, gU, lk, aGY, HS, al, sb, bn, hN, Gw, aq, Ac, ax, E, sj, dt, qt, T, ll, ya, nk, hq, Dl, auy, iB, rw, fG, eX, JH, aiu, DT, Ka, eW, bOd, fR, ps, iy, aDx, aZB, eE, aD, fH, oP, g, ha, baH, bK, nW, iv, fO, vc, Re, vM, fx, FG, Pw, aDb, fy, bOf, bY, cT, aXx, rn, zu, fi, cY, rq, jz, NH, bW, tp, bNL, RD, pp, DM, B, k, aXd, bv, oD, gg, iT, SA, yY, bNR, BV, alf, baA, bxn, bt, aGa, By, aYE, aDE, aNw, Kp, iu, fW, fn, ach, adJ, b, LX, aF, Of, tG, aiE, bOk, wZ, aem, re, gz, bsf, n, blp, Dg, cz, bOp, gn, et, aFC, hU, xL, acN, DR, hT, bOh, ex, bNK, Bm, D, qX, adK, mW, lv, vg, eM, eb, bjC, bNN, VS, ik, da, ti, aDA, aur, aM, NG, Xu, MP, hc, ap, eG, h, gK, pV, Ob, bx, aGV, aN, eC, Zs, sJ, w, bV, cO, yi, hq, dv, cy, t, zH, sL, gl, R, lb, ol, sH, gJ, bEk, Lz, xO, od, bNV, aZS, ca, jT, dH, aDl, LW, i, dc, bsZ, awg, id, axq, Kt, Zx, ma, ER, un, ajP, vQ, Em, WX, bm, cj, iF, jB, agS, dA, wE, afB, Xr, pr, bNM, cK, pi, dP, jR, aDL, alh, lm, apD, ci, kE, bOc, DJ, sU, bNW, ey, eV, aGV, lz, bX, jV, vu, asv, qe, pB, jG, u, nj, PJ, aDu, sQ, l, im, qA, by, BZ, G, aFj, lo, bhT, yG, aAF, yC, kh, CV, l, aCL, azt, bL, A, OB, BY, di, pu, dQ, Bz, bj, qG, bNS, aX, fq, aEz, M, y, bNJ, aV, jZ, pE, fU, qB, cV, hZ, BC, gj, P, lC, j, gF, ac, Lc, zE, bh, LQ, oT); #c1(IFNGR1) c2(NP_000407) c3(5338) c4(31452, 44509, 57566, 18395, 70623) c5(bNY, dx, fl, ER, iL, b, bx, bOy, adK, iU, gN, bk, bhu, sJ, vl, gE, Ir, al, JK, y, aCV, gM, m, cy, ae, sS, fq, DM, bOx, cT, vQ, bu, QE, do, ik, aD, bOw, jG, u, jZ, o, R, kN, il, aC, sH, du, gm, gL, bOl, ij, axl, ti, T, mW, aZ, Oi, by, gl, aDL, tm, eV, bOu, bR, eW, eQ, Ic, rq, P, fP, tO, bOt, bOz, bOs, dh, i, I, bh, at, eG, bX, bOv); #c1(IFNGR2) c2(NP_005525) c3(5339) c4(31453, 44510, 57567, 18396, 70624) c5(dx, iU, sJ, iL, al, e, y, d, m, cy, DM, bu, aE, aD, zQ, aV, u, gl, sH, du, gL, by, ti, aZ, Oi, jl, jG, ac, wV, tm, sS, jZ, lc, rq, tO, wP, Dl, bOs, i, l, bh, at); #c1(IFNK) c2(NP_064509) c3(5340) c4(31454, 44511, 57568, 18397, 70625) c5(m, ao, aX, aeq, aC, re, ic, cO); #c1(IFNL1) c2(NP_742152) c3(5341) c4(31455, 44512, 57569, 18398, 70626) c5(da, cy, aYM, Ob, C, nl, q, gL, aC, fl, ll, iL, gE, aZA, al, bm, rN); #c1(IFNL2) c2(XP_011525058) c3(5342) c4(31456, 44513, 57570, 18399, 70627) c5(cy, z, gL, i, gE, al, iR, fx); #c1(IFNL3) c2(NP_742151) c3(5343) c4(31457, 44514, 57571, 18400, 70628) c5(aw, Kt, vQ, gE, jz, Gl, MP, EN, byQ, iL, z, bf, al, aW, jQ, Xy, aoR, dL, ml, F, q, nv, dl, bcs, aV, jZ, em, l, C, nl, fl, gv, P, ll, bh, cy, ajd, aM, dP, rS, fN, pq, Oa, Ck, dY, fq, aZA, aA, Ku); #c1(IFNW1) c2(NP_002168) c3(5344) c4(31458, 44515, 57572, 18401, 70629) c5(do, aX, ic, aE, gE); #c1(IFRD1) c2(NP_001007246) c3(5345) c4(31459, 44516, 57573, 18402, 70630) c5(fy, yr, T, bk, aZ, cO, at); #c1(IFTI22) c2(NP_001267475) c3(5346) c4(31460, 44517, 57574, 18403, 70631) c5(arD, adG, Al, bOB, bOA, vt, bN, dt, bel, Pu, bvz, et, bhl); #c1(IFT140) c2(NP_055529) c3(5347) c4(31461, 44518, 57575, 18404, 70632) c5(et, nR, bjg, Ff); #c1(IFT172) c2(NP_056477) c3(5348) c4(31462, 44519, 57576, 18405, 70633) c5(tq, bjg, jz, lv, bOC, bOD, Cd, jQ); #c1(IFT27) c2(NP_001171172) c3(5349) c4(31463, 44520, 57577, 18406, 70634) c5(ak, TD); #c1(IFT43) c2(NP_001096034) c3(5350) c4(31464, 44521, 57578, 18407, 70635) c5(bOA, oy, bOE); #c1(IFT57) c2(NP_060480) c3(5351) c4(31465, 44522, 57579, 18408, 70636) c5(w, si); #c1(IFT74) c2(NP_001092693) c3(5352) c4(31466, 44523, 57580, 18409, 70637) c5(bq, an); #c1 (IFT80) c2(NP_001177171) c3(5353) c4(31467, 44524, 57581, 18410, 70638) c5(Ff, bjf, bOF, nQ, zW); #c1(IFT88) c2(XP_005266603) c3(5354) c4(31468, 44525, 57582, 18411, 70639) c5(bL, xc, asx, q, zW, Nz, dc, bm, anW); #c1(IGBP1) c2(NP_001542) c3(5355) c4(31469, 44526, 57583, 18412, 70640) c5(bP, aOe, zH, X, sl, dB, aSX, Fh, vp, U, co, aX, aAl, h, GL, q, aOd, bOG, li, bgb, IL, av, aV, u, aE, tQ, qw, V, aC, nl, ZY, bp, pB, ME, fO, Qt, jT, jU, XY, bFm, fc, Ck, aSZ, cT, amu, fP, fl, dR, Dq); #c1(IGDCC3) c2(NP_004875) c3(5356) c4(31470, 44527, 57584, 18413, 70641) c5(u, aw, y); #c1(IGF1) c2(NP_000609) c3(5357) c4(31471, 44528, 57585, 18414, 70642) c5(px, dB, lp, hM, lr, e, cp, nv, kz, mR, gP, RW, mz, aC, bxO, ft, avU, Dz, tO, ag, xr, fD, bq, aA, mZ, avX, em, X, vD, eu, Bd, iG, Ou, Lr, xl, kV, cM, bBZ, bOH, fm, ak, Mp, av, fy, fi, V, ae, jC, fJ, uJ, aY, ji, CA, aG, ck, aGv, jJ, KN, aoi, azn, pl, jh, Bc, Kz, fv, aJ, Km, dh, cl, da, il, bc, gL, ad, asG, ao, nV, aYZ, acw, yA, BK, fr, jR, iL, zK, jw, avW, oE, oJ, zv, bBR, jo, fP, Af, E, gl, dx, r, bf, O, dC, bQ, rh, gB, bOL, rR, du, bp, Ce, QZ, FW, fp, wh, qt, dS, bT, bP, wa, fl, DO, mk, afo, kY, U, OJ, co, f, bu, ky, aee, mc, Ov, gv, cl, aH, Le, bBU, ahU, oi, z, d, bb, jd, PA, q, hV, yW, iR, o, fh, kF, LR, bBf, Ut, bOM, kB, ch, zZ, gd, afD, aiF, k, lk, HS, bw, al, aW, Ll, wN, bOJ, cB, Ry, Xu, cZ, sB, dt, T, at, ii, hq, gf, hg, aw, jt, HC, dM, iy, ago, fH, g, fO, vc, fx, hR, EG, aDb, bOK, cT, xb, aiS, aol, QD, cY, bru, asl, cC, na, ml, B, bOl, aPM, gg, pP, iT, yJ, v, afn, cx, zi, eX, iA, cf, fw, uK, iu, b, bg, Bh, T, re, nU, wp, atr, cz, lJ, auA, et, Ha, US, hU, aJA, Ck, rC, bMr, eO, ds, in, vg, wf, jx, vH, qs, S, Bi, ajo, cU, tF, ik, iK, PT, ZU, GS, Dw, vF, W, jl, aro, fM, aM, acK, Yv, ap, eG, gK, iq, x, sJ, w, cO, gO, dv, Si, zV, Me, bKp, sO, Qx, pN, sH, lj, zU, jT, cq, AA, fQ, yE, i, dc, Kt, bz, OV, xw, y, ip, cc, cs, bm, iF, bBN, ali, Ag, cK, aoy, py, aNp, gA, gO, uh, aDX, kE, apC, ey, aO, es, ar, jG, u, l, by, aoT, Nh, yG, Bu, aE, ue, rv, l, bL, A, aov, UA, sv, di, bbz, hP, aX, ty, h, F, M, Dd, nA, UF, aV, fU, si, apx, cV, adh, aDY, P, j, bh, HK, gF, pF, ac, sK, rM, qp, QN, OA, Oi, LQ, iE, oT); #c1(IGF1R) c2(NP_000866) c3(5358) c4(31472, 44529, 57586, 18415, 70643) c5(dx, B, aw, iD, EM, gG, dB, x, w, cO, eP, adr, e, O, cp, kJ, t, Kg, Me, cl, yG, rR, g, mz, Oe, fe, aeM, aC, sH, du, po, fO, ft, zU, QZ, fx, Kb, pb, wh, qt, os, tO, acw, cT, i, aA, jl, GD, wa, Al, cY, afY, iP, Bg, lW, bw, U, y, co, ip, ag, f, xr, bu, gX, fP, cs, iJ, av, fy, bm, iT, iF, ali, V, jh, n, eX, VP, Hh, iA, Mp, JY, aH, auK, py, QG, aNp, gO, ji, qh, iu, ck, b, bg, Bh, ic, cK, axg, mF, d, Ag, bb, re, hV, q, es, X, ar, ff, Km, fv, u, nj, o, fh, da, jj, kF, jE, il, ad, as, G, aZ, ii, WZ, nV, hX, ch, he, dn, l, bOO, A, pF, fr, pR, qY, og, di, jR, iL, Lr, hP, aW, jx, oy, zM, qs, S, l, bj, h, F, cU, ik, oJ, afp, fM, Ll, fU, cV, an, J, yE, W, jo, T, aX, gF, by, ac, sK, qp, bON, HM, Dt, XH, at); #c1 (IGF2BP1) c2(NP_001153895) c3(5359) c4(31473, 44530, 57587, 18416, 70644) c5(dx, aw, b, cY, y, aX, SS, yN, jd, eX, q, X, cs, u, g, l, du, bp, ad, T, ny, x, jT, qW, jE, BX, bm, ip, od, aA); #c1(IGF2BP2) c2(NP_001007226) c3(5360) c4(31474, 44531, 57588, 18417, 70645) c5(dx, bf, b, bo, w, cO, bw, U, Hi, ey, eX, ky, mm, mz, V, l, du, P, jT, aM, Ah, mA, aA, at, ap); #c1(IGF2BP3) c2(NP_006538) c3(5361) c4(31475, 44532, 57589, 18418, 70646) c5(eX, b, k, fr, oa, dB, Lh, Bg, kY, U, fx, y, d, aX, hV, q, cU, ar, Mr, u, V, l, ft, aoS, afz, T, iA, jT, Mp, ac, pb, qW, hq, os, ag, i, ji, aA); #c1(IGF2) c2(NP_001121070) c3(5362) c4(31476, 44533, 57590, 18419, 70647) c5(dx, by, B, aw, F, gG, dB, aN, mC, w, cO, bf, jq, aeC, O, cU, bQ, b, LN, iR, rh, t, e, bOR, fp, Me, bBT, cl, apC, amq, Qx, oN, R, g, fe, agQ, lU, aC, nl, yL, du, jE, bp, ft, Ce, od, x, fx, jT, dL, gg, pq, wh, fy, iL, VG, bm, azy, tO, ag, xr, pv, i, mD, aA, jl, PR, pF, bOT, wK, X, jj, wy, kB, bru, kY, bo, bw, U, OJ, y, co, yE, fQ, pz, f, UV, vQ, bu, xA, cs, av, JD, pP, iT, bOW, fi, jB, ali, V, ae, jh, cx, gv, dv, eX, bt, Qt, cK, iA, als, aol, JY, ahT, dt, aJX, py, aaf, QG, cf, LT, in, aDL, Bc, gA, wU, ji, ap, ck, am, QB, aGv, LA, bg, Hq, ic, z, ey, mF, d, Ag, MX, re, k, PA, q, ZB, ar, ff, aJ, n, jG, qT, u, dh, o, NT, kF, l, bOP, atr, gL, ad, G, ct, qg, M, bOQ, jH, wV, nV, bOM, aJA, ch, eQ, Dc, mA, aE, wP, fg, Ol, bq, l, BK, KC, A, iG, sO, fr, bOS, gw, di, jR, JC, gE, fs, bj, iK, jx, oy, QV, Ez, aX, il, Ec, jk, h, wN, HB, aOT, gT, Ir, ik, oJ, p, fP, sH, bOV, cV, jd, me, bOU, J, vF, W, P, Ql, T, bh, aHJ, gF, cz, fM, aM, TY, qp, Kj, adu, zU, XH, Lr, PS, Lj, at, iE, oT); #c1(IGF2R) c2(NP_000867) c3(5363) c4(31477, 44534, 57591, 18420, 70648) c5(gG, fk, fr, A, aZ, b, Zx, F, jj, jw, bg, C, awl, bw, U, hP, yw, y, d, Ag, jl, co, aX, ag, bj, vj, f, CR, q, bu, cU, X, ik, B, JC, e, ar, av, Hs, u, aE, o, g, fe, kF, V, I, sH, bc, jE, gL, ft, W, P, nV, T, II, bt, Ez, fy, QJ, mF, Ap, bq, ao, bOY, gt, fD, bm, bOX, tJ, aV, tO, by, gd, cT, i, cB, I, bh, aA, bp, wD); #c1(IGFALS) c2(NP_001139478) c3(5364) c4(31478, 44535, 57592, 18421, 70649) c5(A, bS, aye, aN, bg, afD, bPa, bOZ, Lr, ai, bj, Ag, bb, wQ, f, bLx, beP, Vr, mL, mg, cc, Ue, PT, OA, aaH, o, kz, alX, nl, bBR, yO, v, Zr, P, Ql, rw, aj, QZ, gF, axZ, ao, apR, ck, u, bCb, HN, PY, apA, eo, xr, amk, amb, xM, I, GJ); #c1(IGFBP1) c2(NP_000587) c3(5365) c4(31479, 44536, 57593, 18422, 70650) c5(bP, gK, by, A, pF, mz, X, jJ, mC, fl, hM, dx, z, bf, ey, ft, gF, y, Nf, Ag, dv, jl, ae, fy, Bc, re, B, q, bu, Me, Ex, gP, Xp, bw, PT, av, ZU, u, EX, oJ, RG, fU, kF, V, I, p, sH, du, gJ, wh, fO, gv, W, bPb, G, zU, eX, ar, x, iA, O, fm, FG, aM, cU, aH, qp, ii, sK, VG, bm, eQ, Dd, ag, Bh, o, i, I, bh, aA, at, eG, bT, ap); #c1(IGFBP2) c2(NP_000588) c3(5366) c4(31480, 44537, 57594, 18423, 70651) c5(dx, gK, B, jt, dB, sJ, w, hM, bf, rc, e, O, bQ, LL, Vx, t, dl, cl, g, iv, bp, x, wh, BX, qP, i, mD, aA, mZ, X, jj, cA, Lr, U, y, co, ip, ak, bu, cs, av, fy, jB, V, eX, ny, Fr, iA, du, jR, tl, b, jq, z, d, jd, es, ar, aCv, as, u, aE, o, Zz, I, Mi, by, G, Ut, aCt, ih, th, I, A, k, di, jx, aX, Ec, jk, h, cU, oJ, cB, dj, fU, cV, an, Fs, J, W, T, fO, fT, ad, aM, PS, rb); #c1(IGFBP3) c2(NP_000589) c3(5367) c4(31481, 44538, 57595, 18424, 70652) c5(dx, by, B, aw, dB, Ip, HC, sJ, w, bf, e, O, M, cy, Vx, iR, fP, zV, dl, do, jq, Qx, n, Yj, mz, bxO, du, fO, jE, bp, ft, vc, zU, x, fx, gg, wh, qt, aJA, xr, i, aA, jl, wa, cY, eu, mk, ali, kY, bw, U, y, co, ip, ml, f, bu, cs, av, fy, bm, iT, jB, be, V, ae, jh, cx, eX, Fr, iA, azC, JY, wp, py, kJ, jR, cf, CA, EG, ap, ck, b, ia, tG, z, aoi, pl, d, Ag, bb, re, PA, q, X, ar, ff, hb, Km, atr, sK, u, dh, o, aJ, il, LR, gL, ad, IJ, aoT, Nh, et, kB, ch, iq, yy, I, Mp, BK, g, A, iG, k, fr, pR, vg, asl, m, S, I, anM, F, aBd, cU, tF, ik, oJ, cB, PT, Ry, fU, Be, adh, mc, J, gV, W, jo, T, j, Me, asX, aX, gF, cz, fM, aM, wU, PB, Oi, XH, E, PS, bh, at, eG); #c1(IGFBP4) c2(NP_001543) c3(5368) c4(31482, 44539, 57596, 18425, 70653) c5(A, b, k, X, dB, sJ, w, zK, VG, U, O, aX, B, cU, ar, y, cs, fy, u, o, V, cV, aC, ad, Fr, iA, by, oi); #c1(IGFBP5) c2(NP_000590) c3(5369) c4(31483, 44540, 57597, 18426, 70654) c5(Dr, bL, A, aw, b, X, jq, dB, w, bw, bf, U, e, y, d, co, I, ip, jd, E, re, f, F, q, cU, fr, ar, B, aCv, gg, u, aE, o, V, VD, cV, aC, LR, j, ft, PS, T, eX, ny, iA, fM, aM, nV, BX, iR, eQ, aCt, qP, i, I); #c1(IGFBP6) c2(NP_002169) c3(5370) c4(31484, 44541, 57598, 18427, 70655) c5(A, b, X, dB, z, O, bQ, jd, B, bBT, fv, cl, hb, Mi, fy, u, o, cV, p, cs, ad, iD, azy, cf, i, I, eG); #c1(IGFBP7) c2(NP_001240764) c3(5371) c4(31485, 44542, 57599, 18428, 70656) c5(A, b, fi, cY, ie, dB, bPd, HG, O, w, Iv, iL, cO, bf, U, G, fx, y, oy, bPc, co, aX, ip, t, h, B, F, q, bu, cU, ar, aW, JX, iv, fy, u, e, oJ, d, V, cV, cs, bIU, J, bp, ad, jo, T, ff, iA, by, wh, nV, py, iR, bzM, P, vH, ag, fl, sg, aA, eG, C); #c1(IGFBPL1) c2(NP_001007564) c3(5372) c4(31486, 44543, 57600, 18429, 70657) c5(T, di, u, y, b); #c1(IGFL1) c2(NP_940943) c3(5373) c4(31487, 44544, 57601, 18430, 70658) c5(da, mk); #c1(IGFLR1) c2(NP_078936) c3(5374) c4(31488, 44545, 57602, 18431, 70659) c5(mk); #c1(IG- HMBP2) c2(NP_002171) c3(5375) c4(31489, 44546, 57603, 18432, 70660) c5(apR, Fp, fl, cN, dA, OF, beq, v, apA, u, At, kz, ac, aoo, oD, OA, aPU, y, Y); #c1(IGJ) c2(NP_653247) c3(5376) c4(31490, 44547, 57604, 18433, 70661) c5(fq); #c1(IGLL1) c2(NP_064455) c3(5377) c4(31491, 44548, 57605, 18434, 70662) c5(Zq, bPf, asM, vW, bPe, cT); #c1(IGSF10) c2(NP_849144) c3(5378) c4(31492, 44549, 57606, 18435, 70663) c5(cO); #c1 (IGSF11) c2(NP_001015887) c3(5379) c4(31493, 44550, 57607, 18436, 70664) c5(by, ck, q, b, bu); #c1(IGSF1) c2(NP_001164432) c3(5380) c4(31494, 44551, 57608, 18437, 70665) c5(Am, V, b, ag, Be, Sc, bPg, qL, T, zO, O, brA, u, y); #c1(IGSF5) c2(NP_001073913) c3(5381) c4(31495, 44552, 57609, 18438, 70666) c5(bj, A, bh, at); #c1(IGSF6) c2(NP_005840) c3(5382) c4(31496, 44553, 57610, 18439, 70667) c5(gj); #c1(IGSF8) c2(NP_001193594) c3(5383) c4(31497, 44554, 57611, 18440, 70668) c5(w, A, O, gE); #c1(11111) c2(NP_002172) c3(5384) c4(31498, 44555, 57612, 18441, 70669) c5(apH, wa, AI, b, ahS, Ak, kB, yD, Ni, bw, y, zM, atj, sm, kJ, bu, cs, u, zW, bwH, V, bPi, bpf, ad, dt, ahO, ct, by, atn, fQ, bpb, ag, xr, bPh, eG); #c1(IKBKAP) c2(NP_003631) c3(5385) c4(31499, 44556, 57613, 18442, 70670) c5(ahS, ahV, aFh, aqR, xl, c, cy, pL, DM, DI, mR, qe, av, o, pE, cV, aC, tz, sf, aig, cr, ac, RS, ti); #c1(IKBKB) c2(NP_001177649) c3(5386) c4(31500, 44557, 57614, 18443, 70671) c5(dx, A, b, fN, jz, eu, O, dv, w, di, Iv, gE, U, xw, e, y, cy, d, m, bPj, LL, kJ, DM, hg, q, bu, ar, ff, fy, u, cc, PJ, V, I, aC, du, bp, jo, co, fO, x, aX, jT, dL, jU, jQ, iy, ch, P, fG, gd, DI, CV, vZ, jl, gl); #c1(IKBKE) c2(NP_001180250) c3(5387) c4(31501, 44558, 57615, 18444, 70672) c5(d, m, aeq, b, aC, ajd, tR, e, gL, fH, cA, wX, O, fy, u, fJ, y); #c1(IKBKG) c2(NP_001093326) c3(5388) c4(31502, 44559, 57616, 18445, 70673) c5(dx, bPI, bjA, agH, aHa, mk, ix, agJ, C, vp, VJ, y, zr, bjC, jU, pp, dL, h, f, q, bPo, n, iv, oD, zQ, u, dh, aLt, du, bPn, bPk, J, bp, BV, dt, CM, UT, II, amR, pi, agp, bjF, Ot, bOs, CV, bPm, DM); #c1(IK) c2(NP_006074) c3(5389) c4(31503, 44560, 57617, 18446, 70674) c5(ig, aCr, do, Oj, mU); #c1(IKZF1) c2(NP_001207697) c3(5390) c4(31504, 44561, 57618, 18447, 70675) c5(aw, b, oR, jy, U, Bz, m, t, h, IY, iv, oO, jG, aE, V, J, fO, G, ny, bh, jT, xd, WZ, jH, oQ, hX, fP, gR, pt); #c1(IKZF2) c2(NP_001072994) c3(5391) c4(31505, 44562, 57619, 18448, 70676) c5(oy, t, J, jT, u, y); #c1(IKZF3) c2(NP_001244337) c3(5392) c4(31506, 44563, 57620, 18449, 70677) c5(m, ag, cy, V, hp, aC, t, J, fO, aE, gX, cT, Oi, U, jT, u, bT, y); #c1(IKZF4) c2(NP_071910) c3(5393) c4(31507, 44564, 57621, 18450, 70678) c5(PI, qB, bEk, aE, Qx); #c1(IL10) c2(XP_011507808) c3(5394) c4(31508, 44565, 57622, 18451, 70679) c5(avO, ml, iX, dB, aPi, en, JH, aoK, OH, e, cp, gM, jD, Zq, akv, Pn, nZ, dl, aFA, mR, zR, TP, wc, sE, bPq, aC, bxO, cs, wV, ME, fl, aGJ, JN, pq, azW, aei, bm, hx, acN, ie, tO, ag, axC, pH, bk, fD, acM, bq, aA, bmt, asL, mZ, X, eu, ig, HF, bPG, GV, vl, cM, bBZ, rY, yX, aZX, adr, aoM, aCG, Mp, av, CX, rr, fY, aFi, fi, vR, NW, ae, Cq, nl, bdz, Dp, IR, aDI, fJ, bPM, bPQ, aY, dY, ajM, bNO, abs, Jc, ij, aG, aFI, bn, Dr, jJ, vY, pI, Ag, Xy, bPz, tg, atr, DY, pY, dh, da, Jo, il, NG, sX, RK, gL, ad, bIF, GQ, Za, rB, ao, nV, agQ, pD, mA, zX, yV, CL, VT, vZ, yA, BK, xa, Pp, aED, bOm, vd, iC, gn, gN, NA, bPD, C, iL, gE, jQ, fG, xT, or, aQk, wG, vS, aBa, ox, qB, NO, aPI, dj, Ea, aZd, be, J, asM, bR, axl, My, bJP, pc, bPC, Jh, Ic, asx, Af, jh, atR, Qp, gl, dx, bi, bPH, iU, Ty, bzL, bf, eP, aHp, xl, Wp, azb, AX, yh, bNZ, jm, Pv, IV, Zv, aoh, og, aeM, du, yO, gm, bp, MO, JQ, x, aCP, su, gs, aZg, sS, fc, bPO, bMf, QD, rS, te, bT, bP, fl, Jy, DO, wF, mk, ix, Ku, cA, U, Di, amx, co, BL, sT, aoR, f, aDD, fb, bu, aFZ, aog, Ov, Bs, aSz, NZ, fK, gv, ny, cl, ww, qH, yf, aH, nb, jo,
tl, aLP, apT, WH, bPE, qz, atU, z, zL, IS, aYA, d, bb, eA, MX, PA, q, ff, Dq, ar, yW, qT, rX, o, fh, RG, kF, kt, LR, bPr, bPE, bPy, Fk, ct, wd, Ut, jU, gd, jH, Eu, asm, aDk, ch, ale, xU, aof, Ou, OI, Au, aZU, bPs, Xm, aDj, xu, gU, tR, Rd, ajw, bPx, tA, eO, al, aW, bJz, hN, fP, aq, ax, tp, sj, Oq, T, II, eK, ya, at, ce, bPu, acg, ajD, DI, auy, iB, aDU, bPA, gf, eX, aw, aZ, dN, oz, DT, Ka, eW, ku, bPI, wX, fR, bIL, brX, aDx, eE, aMq, aD, fH, ha, aBs, gG, bK, po, fO, Yl, vc, vM, fx, fy, OR, aaz, bY, aEL, m, cT, pW, rn, aEq, zu, cY, jz, apN, NH, bPL, aqV, aSh, V, bC, pp, hm, DM, B, O, bv, gg, iT, yJ, SA, Gr, rN, FR, bNR, aZz, v, BV, bcL, cd, bt, aGa, By, gC, JY, aum, fw, aYE, uK, zT, aNw, zS, iu, aEg, adJ, bW, b, LX, aF, Ny, tG, bat, wZ, re, hV, aZV, vu, blp, ri, pS, Zz, Dg, ht, UG, fz, bPK, cz, IX, Fo, aGn, qV, et, bPB, axM, hU, xL, aJA, DR, hT, ex, kC, IS, Bm, SS, adK, mW, axA, Iv, vg, eM, xe, aFP, ik, sb, gG, GS, W, ti, xS, ji, aDA, jl, aM, Y, bal, PB, ajv, aPd, ap, eG, aEz, gK, pV, Ob, bx, aiW, aN, Zs, sJ, w, cO, Mn, dv, cy, t, bPP, aLG, sO, Dc, gl, n, bzf, lb, ol, sH, GJ, bPN, gY, xO, bdw, jT, oh, mO, dH, alb, ro, aai, fN, aAd, aFX, i, dc, awg, gk, td, Kt, Zx, bPp, aFy, os, VG, y, ed, ip, un, bPv, vQ, Em, bPJ, kN, aOS, cj, jM, ali, agS, qb, afB, bJN, Io, cK, pi, wu, yN, dP, acF, ne, aDL, gA, TQ, bPt, Im, ci, gz, kE, je, bOc, eR, DJ, id, ic, ey, eV, aO, Fp, xi, Iz, aDO, bX, jV, acO, se, dQ, ac, aRv, jG, u, nj, wR, PJ, bU, sQ, aJ, I, im, bPw, qA, by, BZ, G, nk, aAB, Yz, QN, aos, eQ, rq, he, aE, wP, dn, I, asC, azt, bL, A, Mj, sv, aZZ, di, Vy, pu, bj, aCX, aX, ty, kn, fq, h, F, ID, bNJ, aV, jZ, aSL, ma, hZ, aWg, wE, gj, P, j, HK, pw, qe, SB, zE, MU, Rb, kx, aBz, bHV, bh, azF, Nu, oT); #c1(IL10RA) c2(NP_001549) c3(5395) c4(31509, 44566, 57623, 18452, 70680) c5(bL, fl, aw, tG, P, fO, aF, gE, aFy, Ka, ig, vg, eO, vp, al, jD, m, cy, DM, adK, fY, vR, ae, aC, sH, be, dB, gm, gL, gv, I, vc, II, jl, fx, jT, Ut, jU, cW, jH, nk, iL, mk, vS, tO, DI, fP, Bm, i, bPR, bh, aA, bp, nl); #c1(IL10RB) c2(NP_000619) c3(5396) c4(31510, 44567, 57624, 18453, 70681) c5(tG, iL, z, aFy, mk, xa, vg, gE, bPS, m, cy, DM, q, RQ, aq, jZ, fh, pE, vR, aC, Dg, fO, gm, gL, vc, Jc, II, jU, jH, P, bNH, DI, fP, Bin); #c1(IL11) c2(NP_000632) c3(5397) c4(31511, 44568, 57625, 18454, 70682) c5(dx, by, id, bf, bPH, b, X, Pv, jK, HC, A, NH, ic, z, vp, vl, hP, y, pF, Ei, aX, yE, Bc, AX, B, q, bu, M, fr, ar, Km, fP, av, u, dh, o, be, aC, qC, du, LR, afB, fO, J, aUP, Fo, dv, T, II, aDe, qX, cy, ft, jU, aM, bPT, jH, AI, NG, aei, bm, mb, HP, ag, cT, DI, pH, I, bq, aDF, eG, DM, C); #c1 (IL11RA) c2(NP_001136256) c3(5398) c4(31512, 44569, 57626, 18455, 70683) c5(A, b, X, B, gm, fO, bPU, cT, fl, T, aGn, fH, ar, av, u, fJ, be, NO); #c1(IL12A) c2(NP_000873) c3(5399) c4(31513, 44570, 57627, 18456, 70684) c5(dx, bx, iU, aPi, eW, sJ, bf, O, cy, t, Pn, fH, dH, oP, bK, sH, du, fO, ft, aCP, jT, pq, fc, tO, aEL, cT, axC, i, bT, ig, vl, xw, co, DM, B, bu, gg, bm, iT, ae, v, wA, cl, fJ, xe, Im, iu, WH, b, Pv, sU, bb, re, k, q, ar, tg, u, nj, o, j, by, yG, hT, aE, I, A, eZ, Xd, fr, gn, gN, gX, iL, gE, iy, m, xT, aX, fq, aV, jZ, ma, cV, be, P, T, jl, qp, Xe, Ic, DI, fP, iB); #c1(IL12B) c2(NP_002178) c3(5400) c4(31514, 44571, 57628, 18457, 70685) c5(dx, aw, iU, eW, sJ, aEK, JH, e, O, aFR, aXC, cy, t, Pn, aD, gl, oP, g, JI, aC, sH, du, fO, jT, pg, aoC, aAd, tO, aEL, axC, i, bPV, bq, bT, ig, ix, JE, U, yV, tp, pw, DM, fb, bu, gg, bm, iT, QD, V, ae, nl, bt, wA, cK, P, xe, iu, bPW, b, aF, atU, ey, eV, d, Iz, re, gz, q, dW, jD, se, dQ, ar, u, nj, da, PJ, il, kt, atr, gL, aZ, et, cW, jH, aJA, rq, aE, Bm, I, Mp, TP, OB, gU, In, gN, di, C, iL, gE, al, m, xT, jl, I, fq, IE, ik, Dg, fP, aV, NO, aSL, pE, ht, be, bd, axl, ti, II, qe, DI, bOs, iB, at, hz); #c1(IL12RB1) c2(NP_001276953) c3(5401) c4(31515, 44572, 57629, 18458, 70686) c5(Pp, da, aF, iU, aE, bhu, sJ, gE, xe, m, bbE, IE, cy, ae, apG, t, DM, q, ik, oJ, gl, fh, Zr, vR, sQ, il, aC, sH, fO, Dp, gL, bOI, ti, bPN, aZ, jl, ya, pq, aDI, rq, tO, cT, DI, bOs, Bm, fq, aFc, eG, bT); #c1(IL13) c2(NP_002179)

c3(5402) c4(31516, 44573, 57630, 18459, 70687) c5(dx, IJ, en, aw, Ob, Gm, aDD, sE, DT, aE, aN, gi, eW, sJ, w, bzL, JH, yi, e, O, gM, jT, cy, asy, kJ, aZM, acJ, DB, OM, wF, buX, bbJ, aD, bFq, Hs, blz, TP, g, baH, gG, aAL, sH, du, fO, gm, bp, dB, vc, asz, aDe, aCP, eL, JN, gg, dH, aoC, Tp, bJB, bY, os, ip, aaz, cT, pH, i, bPY, bJn, bT, aFy, fl, kN, X, jz, eu, Kc, mk, HK, ma, NH, bf, bw, U, xw, cM, bBZ, co, rY, aoR, yX, DM, B, zh, bu, bIQ, jS, bv, aei, av, CG, iT, Bm, ali, yV, ae, eE, aSz, nl, IR, I, aDI, aCE, fJ, pk, dP, P, jR, xe, fG, sR, gA, aNw, abs, Jc, aDF, iu, bwi, aEg, ck, anh, kE, b, ag, aF, yh, tG, eV, d, dl, Xy, azF, jd, re, hV, zx, OC, dQ, aJ, Xx, Tr, ar, atr, u, nj, ri, da, I, kt, LR, gL, cz, BZ, IX, IJ, aZ, fH, vw, et, Ut, jU, jH, ao, nV, aAs, xL, Ka, DR, iq, xU, EI, gd, IS, bQa, dn, gl, bQb, y, Iv, A, iL, asx, aoG, IW, gn, gN, di, tA, vg, PI, DK, vl, pp, m, V, o, aX, ajn, aCU, bn, fq, F, aC, jQ, bPZ, Dg, fP, aCH, aDW, aAq, ax, si, hZ, be, Fs, bd, asm, jo, ti, T, II, aDA, jl, bPX, qe, aM, nk, ce, ii, NG, Jh, ajv, fW, by, akm, DI, j, TN, Oi, at, eG, hz, oT); #c1(IL13RA1) c2(NP_001551) c3(5403) c4(31517, 44574, 57631, 18460, 70688) c5(da, ck, cy, b, fq, DM, f, v, j, Ka, DI, fl, Bm, I, jU, O); #c1(IL13RA2) c2(NP_000631) c3(5404) c4(31518, 44575, 57632, 18461, 70689) c5(da, A, anh, b, k, X, iP, DT, Ka, w, iG, O, cy, pp, fq, DM, B, F, av, u, g, sH, j, dB, T, jU, ip, ck, fN, tO, ag, DI, I); #c1(IL15) c2(NP_000576) c3(5405) c4(31519, 44576, 57633, 18462, 70690) c5(dx, B, JH, dB, Ka, sJ, bn, aJE, pz, e, cp, hR, cy, t, Si, yh, dl, cl, JF, gl, jS, ajc, aC, sH, du, fO, ft, vc, x, JN, pq, Pw, aV, bdW, rS, ag, cT, pH, i, aA, eQ, rn, cY, jz, eu, ig, ax, NH, kY, y, co, BL, pp, yX, DM, f, cc, cs, av, fy, bm, aFi, fi, yV, dv, eX, cK, anf, nb, xe, gR, bwi, ap, DB, kE, b, tG, aAb, jy, d, eE, yN, bX, gz, g, X, dQ, oO, Gj, u, aE, da, fs, I, Dc, gL, ad, G, aZ, jU, jH, mk, DR, iq, ix, Bm, fl, I, WP, A, xu, TQ, fr, adK, mW, di, Iv, vg, eM, al, sb, jQ, m, IE, aX, fq, h, bQc, ag, fU, cV, be, J, P, ti, T, II, HK, cz, jT, aeq, NG, Nu, MP, akm, DI, fP, Oi, at, eG, Dg); #c1(IL15RA) c2(NP_001230468) c3(5406) c4(31520, 44577, 57634, 18463, 70691) c5(A, mk, NH, Iv, al, y, cy, or, DM, B, eE, ar, cs, fP, u, da, vR, beW, cx, gm, eX, ny, J, jH, NG, akm, DI, pH, i, I, aA, at); #c1(IL16) c2(NP_001165599) c3(5407) c4(31521, 44578, 57635, 18464, 70692) c5(Dr, A, aw, b, X, gE, jz, dB, w, di, iL, cO, U, oE, sx, vl, y, SV, eE, jT, cy, pp, t, DM, B, yh, q, bu, bQd, re, ff, aD, av, jQ, u, ye, iT, V, m, aC, hZ, sH, yj, fO, hv, gL, J, I, P, bOY, j, aZ, jl, by, jU, jH, pk, aoC, dP, pS, iu, Jh, ie, G, os, jZ, cT, DI, fP, fq, gj, at, eG, bX); #c1(IL17A) c2(NP_002181) c3(5408) c4(31522, 44579, 57636, 18465, 70693) c5(dx, f, pV, Io, Ob, WH, ig, aiu, iU, Ka, aDg, sJ, en, vl, cO, JH, OH, e, O, aDi, dv, cy, aYI, aDw, AX, DB, yh, Pn, iT, aDO, nL, byO, mR, ia, aD, fH, pq, bEx, gl, bQe, baH, sE, qm, aC, jD, du, fO, Ij, bp, ft, fl, aDe, hU, fx, jT, dL, gg, dH, LW, akn, sS, fc, fN, Ox, Pv, sN, IN, w, pH, uO, i, bq, aA, bT, rn, bP, id, X, asL, Kc, mk, ix, NH, Ku, vp, aXg, ex, y, V, ed, co, BL, yX, eD, ajP, hg, aDD, cT, vQ, bu, ky, HQ, cs, av, fy, Zn, aSz, fY, bk, Dp, be, yV, bx, Bs, bNR, CV, v, Zr, Xr, cd, bt, By, cl, gv, bQf, fJ, bPM, aaa, dP, ne, fG, gO, rr, ji, aDF, iu, bX, nl, ap, aEg, aDx, bW, b, LX, aF, HK, z, hr, re, QE, aO, d, eE, gf, bb, eA, pi, bxk, q, jV, zx, CO, Pc, dO, yW, JY, u, dh, fh, zH, PJ, il, bNU, adJ, kt, gL, ad, da, aDv, IJ, ew, mW, Fk, vw, jU, jH, ao, Eu, hS, fD, ch, DR, aCP, iq, xU, gd, ei, gl, I, qX, Pp, bL, uk, bf, qd, fr, In, gn, gN, pw, di, C, iL, zK, xe, sx, U, eb, iy, m, bbE, xT, aX, aCU, fq, Vr, ik, aE, qB, fP, aV, jZ, wF, aMH, sB, arx, W, bR, P, IE, T, II, aDA, eK, by, qe, aM, nk, NG, MU, mb, zM, DI, j, aBz, atR, bh, at, eG, DM, oT); #c1(IL17B) c2(NP_055258) c3(5409) c4(31523, 44580, 57637, 18466, 70694) c5(dx, mZ, pV, b, cG, DT, DJ, ig, y, cp, m, bbE, co, bb, sT, fq, f, dQ, aO, qB, fy, u, dh, o, da, wK, be, dA, aC, du, byO, dv, cy, jH, mk, mb, xU, ag, gl); #c1(IL17C) c2(NP_037410) c3(5410) c4(31524, 44581, 57638, 18467, 70695) c5(WH, MZ, kE, b, X, eu, mW, ig, w, iL, z, bf, y, iy, m, jT, aX, aNq, yN, fq, ak, bu, eE, dQ, O, cs, av, aV, u, gl, jS, da, fi, be, V, cV, aC, aNr, ahB, gm, fO, ad, P, aE, II, Qt, gn, bb, by, jU, aM, jH, fc, jZ, fw, xU, fG, cT, fP, I); #c1(IL17D) c2(NP_612141) c3(5411) c4(31525, 44582, 57639, 18468, 70696) c5(dx, en, axx, sE, iU, bf, OH, dv, cy, Kp, AX, aDx, eE, Em, aD, aC, du, jT, fc, agS, aA, rn, mk, ix, Ku, U, co, pw, sT, pp, yX, f, dZ, B, cs, av, fy, V, aDM, nl, Dp, Zr, byO, pi, iu, bn, b, aF, bX, q, zx, CO, Pc, DY, dh, ri, da, PJ, il, ad, IJ, jU, jH, Eu, xU, gd, I, dV, A, qd, gE, bQg, C, iL, eM, aW, m, bbE, aX, I, kn, fq, h, ik, aE, aV, jZ, aMH, be, J, bR, P, II, eK, aM, fP, atR, bh, oT, gf, gl); #c1(IL17F) c2(XP_011512578) c3(5412) c4(31526, 44583, 57640, 18469, 70697) c5(Pp, en, b, gN, ix, NH, bw, bf, ne, y, m, wZ, co, eK, fq, h, bu, cs, fP, aM, u, da, pw, qO, aC, Dp, j, ad, IJ, aZ, cy, fx, by, bQf, bQh, jU, JY, jH, akn, NG, xU, ag, pH, i, I, bq, iu); #c1(IL17RA) c2(NP_001276834) c3(5413) c4(31527, 44584, 57641, 18470, 70698) c5(bP, Pp, en, fr, sE, A, di, sx, cy, yX, DM, B, hb, fh, aC, Dp, ft, II, bQi, xe, DI, fD, atR); #c1(IL17RB) c2(NP_061195) c3(5414) c4(31528, 44585, 57642, 18471, 70699) c5(aw, b, X, aos, fO, xU, M, cy, av, u, aE, y); #c1(IL17RC) c2(NP_001190192) c3(5415) c4(31529, 44586, 57643, 18472, 70700) c5(A, b, kt, sE, B, hb, aV, aW); #c1(IL17RD) c2(NP_060033) c3(5416) c4(31530, 44587, 57644, 18473, 70701) c5(A, b, B, bQj, agw, T, rb, ac, pq); #c1(IL17RE) c2(NP_001180309) c3(5417) c4(31531, 44588, 57645, 18474, 70702) c5(eV, ae, pg); #c1(IL17REL) c2(NP_001001694) c3(5418) c4(31532, 44589, 57646, 18475, 70703) c5(jH); #c1(IL18BP) c2(NP_001034749) c3(5419) c4(31533, 44590, 57647, 18476, 70704) c5(dx, b, gU, bQk, z, C, gE, dv, cO, Em, mR, aE, av, aV, dh, aC, sH, du, ao, aFa, tO, Af, bq, at); #c1(IL18) c2(NP_001230140) c3(5420) c4(31534, 44591, 57648, 18477, 70705) c5(dx, IJ, B, aw, Io, Ob, bx, bQk, ip, aE, UV, sJ, adJ, aEK, cO, IK, eP, bu, eD, e, bQ, LL, Kp, AX, adl, dl, aQd, fw, et, ik, Hs, gl, oJ, baH, bao, xc, aCP, bsb, aAL, sH, du, gJ, fO, iU, vc, xO, od, gs, hR, oh, CO, dH, wh, aoC, aZn, brt, dS, aei, fN, pq, bY, cK, tO, aEL, fc, cT, dh, dc, aC, bJn, aA, bT, rn, aAp, bP, nX, id, Kt, pD, cY, bmV, Kc, mk, ix, Ku, iG, vp, GV, ai, sN, cM, V, co, rY, pp, DM, f, cs, vQ, pI, Em, JX, iv, av, CX, bm, ye, iT, bk, jM, be, yV, ae, Bs, bd, dv, eV, eX, bt, ar, Hh, qH, pi, anf, pk, dP, py, aY, TP, eA, Oa, P, in, alh, abs, aDI, iu, re, FG, aG, asL, bn, b, zH, aF, gz, eR, dk, au, sU, tG, z, azn, LP, aO, cy, d, jh, bb, Zk, MX, hU, bX, vd, q, ap, Zx, dQ, tg, mR, jG, qT, u, nj, o, fh, da, PJ, pS, kF, I, im, sX, cl, LR, gL, by, BZ, aD, IJ, nk, rw, mW, aZ, mm, Dd, GW, jU, jH, rQ, Eu, ig, DR, xU, ajf, gd, sj, dn, bq, I, Vs, aAr, y, qX, fH, A, bf, iL, gU, xa, gE, gn, gN, IE, di, C, vg, eM, al, hP, U, sb, mE, m, IE, aX, il, fq, h, F, qr, M, vN, bQI, aW, gg, fP, aV, jZ, akn, ax, bQm, cV, fJ, Oq, mc, dB, J, vF, bR, jo, ti, T, II, aDA, jl, gF, ac, aM, jT, at, bnn, Kj, Ic, Fo, ajv, UE, DI, j, X, oT, eG, gf, gl); #c1(IL18R1) c2(NP_003846) c3(5421) c4(31535, 44592, 57649, 18478, 70706) c5(jS, en, aw, zr, b, F, DT, Ka, ig, sJ, w, iL, gE, jy, Bz, G, y, m, co, aX, ae, pp, jd, t, h, N, q, bu, M, aC, sb, aD, fP, gg, aV, u, aE, o, RQ, aEq, pE, vR, I, aAL, Dg, nl, J, gL, eu, IR, IX, P, aAB, fy, cy, Bb, by, pJ, cW, jH, at, dP, fq, ag, DI, IS, Bm, rl, aA, rC, DM, aAp); #c1(IL18RAP) c2(NP_003844) c3(5422) c4(31536, 44593, 57650, 18479, 70707) c5(jH, aEd, cy, py, aC, at, nz, gY, ig, cT, fP, Bm, dH, aE, aO, rC); #c1(IL19) c2(NP_037503) c3(5423) c4(31537, 44594, 57651, 18480, 70708) c5(AI, aF, DJ, mk, iL, gE, adr, e, y, d, m, cy, fq, DM, qL, dQ, u, jZ, da, Be, atr, byO, fO, P, jU, jH, dP, aJA, aE, cT, DI, aC, bX); #c1(IL1A) c2(NP_000566) c3(5424) c4(31538, 44595, 57652, 18481, 70709) c5(en, aDD, dD, dB, aPi, Ip, SB, OH, ra, cp, jD, kJ, dl, nL, bQe, aC, bxO, ft, kN, pq, Iq, tO, ag, axC, bk, fD, acM, bq, yf, aAp, Dr, X, eu, ul, ig, aZO, sF, bw, vl, cM, yX, bIL, rr, eX, e, av, pW, zO, fi, V, ae, nl, cd, J, aRS, fJ, aY, dY, xe, yM, ji, bwi, aG, aFI, ck, aGv, gD, cl, ha, pl, bQg, pi, fv, dh, aNN, fs, sX, gL, ad, awT, rB, aZP, UW, eo, CL, TP, zD, bOm, fr, gN, IE, bQn, C, iL, gE, PI, jQ, m, wG, NO, aAU, dj, Ea, an, be, bd, bR, On, bnn, Ic, fP, gl, amC, jK, vk, alz, apH, sd, iU, sA, bzL, Dy, bf, eP, aK, O, at, bQ, azb, gB, jm, bl, IO, nl, du, gm, gs, aZg, fc, sN, iV, mD, bP, wa, fl, iP, oH, mk, ix, afo, cA, U, yt, amx, co, BL, f, md, bu, bgW, vi, fC, Bs, gv, ny, Hh, qH, aA, br, WH, atU, z, d, bb, eA, q, zx, QE, bQr, ff, ar, yW, o, fh, Id, kF, LR, aZ, jU, jH, ch, xU, zZ, gd, xY, bQt, qd, Ik, qX, bZ, sQ, al, aW, bn, UN, aq, ax, ez, sj, Po, T, II, pz, di, eN, acg, eB, DI, iB, gf, dx, ak, aw, Io, Ka, eW, ps, Ob, BI, ago, eE, fH, oP, aBs, aAL, fO, vc, fx, hR, aml, bY, rJ, cT, xb, bQv, rn, Al, cY, bJA, jz, vp, vV, px, pp, DM, B, k, Us, gg, iT, aEq, SA, rN, v, bt, gC, iA, bQp, fw, zS, iu, abB, adJ, bW, b, zH, aF, tG, bat, re, hV, ajJ, ri, Dg, da, aGn, wx, qV, et, awV, hU, pS, HN, ex, gU, aFi, acb, rC, aMI, mW, og, Iv, vg, iC, adT, eb, sG, HY, iZ, sb, afp, sH, GS, ti, jl, aM, agl, PB, ajv, zM, ap, eG, fn, iq, bsd, bx, aiW, aN, Zs, sJ, w, cO, gO, dv, cy, qc, do, JF, gl, R, aFP, nz, gJ, gY, Lz, jT, oh, CO, dH, aLZ, ata, fN, os, yE, i, dc, ael, id, anY, Kt, Zx, aFy, jf, Kc, hS, IW, VG, rH, y, ed, vQ, LP, cs, zQ, bm, em, fz, IT, cK, bQs, dP, er, Im, aDX, XF, Dm, yU, ic, ey, eV, aO, Fp, ala, dw, bX, iW, se, dQ, bQo, jG, u, nj, PJ, qy, Pz, I, im, awD, by, aAB, Nh, tA, yG, bPT, aE, dn, I, Ku, bL, A, xa, aZZ, D, bj, aX, kn, fq, h, F, qr, aV, ma, si, wE, aDY, gj, P, j, XO, pw, gF, bsc, bQu, zE, wL, bh, aT, LQ, rZ); #c1(IL1B) c2(NP_000567) c3(5425) c4(31539, 44596, 57653, 18482, 70710) c5(ml, bPf, aDD, dD, dB, aPi, Em, en, baB, Ir, rF, OH, ra, cp, vr, LL, aDw, akv, dl, nL, aFA, aQd, zb, bQe, aNq, aC, bxO, jD, ft, IH, bQF, HL, mm, pq, Iq, vz, aei, hx, ie, tO, ag, axC, bk, fD, acM, bq, aA, aAp, GD, X, vD, eu, ig, ali, sF, iG, Ou, GV, bw, vl, cM, Ov, yX, bQN, eD, rr, ak, e, av, fy, MG, pW, zO, is, fi, NW, ae, nl, cd, Dp, hi, ar, aRS, fJ, Vx, xL, aY, dY, xe, HB, yM, ji, rC, bwi, ij, aG, aFI, ck, aGv, dk, byz, cl, ba, pl, HQ, aDO, bQg, bQs, fw, fv, tg, mR, DY, dh, aNN, fs, il, sX, gL, bsc, awT, aFz, rB, an, py, mA, eo, TP, bOo, zD, aED, bOm, vd, fr, fN, iC, gn, gN, IE, bQn, vZ, C, iL, bNx, PI, jQ, m, IE, or, aQk, wG, bQC, RQ, NO, dj, Ea, an, be, J, bR, My, yf, On, ajn, bQA, bnn, Ic, bOq, fP, gl, amC, jK, vk, alz, sd, iU, sA, eH, bzL, Dy, vp, eP, aK, O, bQ, AX, ps, jm, bl, oN, oJ, Oe, IO, aeM, bQI, nl, du, gm, bp, MO, eR, x, aCP, wh, aoC, gs, aZg, dS, bJB, bMf, QD, mE, sN, iV, mD, bQw, bT, bP, wa, fl, QF, iP, mk, ix, afo, cA, Iw, U, amx, bQO, co, BL, f, md, fb, bu, aaZ, bgW, Zn, vi, fC, Bs, fK, gv, ny, Hh, bd, qH, qD, aH, eF, Oa, WH, Pv, qz, atU, wn, bdY, z, AI, bah, aYA, d, bb, atc, eA, MX, q, zx, QE, bQr, sR, bos, dQ, yW, qT, iR, rX, o, fh, Id, kF, kt, LR, Fk, jU, jH, Eu, ch, xU, zZ, gd, xY, bQK, bQv, aFp, bQt, aDj, qd, Ik, bQD, tA, bZ, sQ, al, sb, bn, hN, aq, ax, hW, ez, ww, aZG, T, II, pz, ya, at, hq, UE, DI, iB, gf, RG, dx, hg, aw, aZ, dN, rR, sE, DT, Ka, eW, avb, bIL, Ob, bQG, BI, fn, aDx, eE, bQz, nB, fH, oP, g, aBs, gG, aAL, bK, fO, Ny, vc, Re, fx, hR, aml, akn, TO, bY, rJ, cT, xb, vJ, aZD, rn, nX, aKe, gE, wK, cY, bJA, jz, kB, bf, MU, V, tp, bQL, px, pp, na, DM, B, k, JX, iv, bv, oD, gg, iT, aEq, SA, le, rN, v, BV, eX, bt, qX, gC, hw, JY, bQp, cf, in, zS, iu, abB, adJ, bW, b, zH, aF, Of, tG, bat, re, hV, vu, ajJ, NT, Dg, atr, fz, da, Fo, aGn, qV, et, awV, hU, aaN, aJA, HN, ex, gU, aFi, DD, D, aAr, IA, aMI, adK, mW, Iv, vg, eM, eb, jx, bjC, LS, sG, bj, HY, tF, iZ, ik, aW, afp, Ek, sH, Yb, GS, W, aoN, ti, jl, aM, Y, PB, ajv, zM, aPd, ap, eG, qn, gK, iq, bsd, bx, F, aiW, aN, eC, sJ, w, bmX, bV, cO, aZu, Mn, gO, dv, cy, qc, t, JF, gl, R, bQB, aFP, nz, gJ, bPN, gY, Lz, YY, amT, dH, aLZ, ata, Dc, Ox, os, fc, IN, i, dc, bQE, ael, bsZ, id, td, Kt, oh, kN, aFy, jf, Kc, hS, IW, VG, rH, y, aQr, yE, un, vQ, LP, amZ, bQy, cs, zQ, brt, bm, em, jB, sB, CZ, jh, zl, IT, Io, cK, pi, wu, Bm, er, bPt, Im, EI, aDX, kE, XF, Dm, Ey, yU, ic, anY, ey, gZ, eV, aO, yK, Fp, ala, bQH, lz, ago, bX, iW, jV, se, asv, bQo, atT, jG, u, nj, wR, qy, Pz, I, im, awD, by, BZ, G, nk, aAB, Nh, yG, bPT, eQ, aE, ih, aFk, dn, I, aff, Ku, azt, bL, A, xa, Mj, aZZ, Xh, di, hP, aX, sS, ty, kn, fq, h, xJ, bQJ, qr, M, Vr, eN, n, bNJ, aV, jZ, pE, ma, si, cV, hZ, aWg, wE, aDY, gj, P, j, bh, pw, gF, ad, bQu, SB, jT, qp, zE, LQ, aAx, IJ, bQM, bQx, XO, aT, rZ, Nu, oT); #c1(IL1F10) c2(NP_115945) c3(5426) c4(31540, 44597, 57654, 18483, 70711) c5(bb, aC, nl, ap, jm, bq, at, fh); #c1(IL1R1) c2(XP 011509420) c3(5427) c4(31541, 44598, 57655, 18484, 70712) c5(dx, aw, bPY, eW, sJ, XR, bf, ps, O, cy, DB, dl, jm, bl, fH, dH, aC, sH, du, gm, fO, gY, vc, od, jT, av, pq, BX, tO, axC, bk, i, aA, nX, fl, td, X, Ev, eu, mk, vl, sN, y, aZC, ip, wk, DM, f, bu, gg, pW, fz, ae, nl, gv, pJ, ny, cl, fJ, xe, rr, iu, ap, WH, b, aF, tG, eV, bb, bX, jD, se, atT, jG, u, nj, o, da, kF, I, kt, gL, rB, qV, jH, GM, rX, gd, vZ, rC, GK, MZ, iL, gU, fr, di, vg, wf, al, m, aQk, ik, aE, aV, jZ, be, bd, GB, P, j, XO, ft, aM, nk, Ic, DI, fP, bh, at, eG, gf); #c1(IL1R2) c2(NP_004624) c3(5428) c4(31542, 44599, 57656, 18485, 70713) c5(dx, tG, X, gE, mk, ix, vg, z, vl, m, cy, ty, DM, o, nl, aC, sH, du, gL, vc, fO, jl, jH, nk, agl, kJ, tO, gd, DI, apD, eG, rC); #c1(IL1RAP) c2(NP_001161401) c3(5429) c4(31543, 44600, 57657, 18486, 70714) c5(vg, gU, nz, f, q, gL, h, mk, vc, aE, fv, bp, tG, z, gA, aA, at, eG, ci, bq, n); #c1(IL1RAPL1) c2(XP_005274498) c3(5430) c4(31544, 44601, 57658, 18487, 70715) c5(g, rQ, S, Wk, nz, nU, bCS, tO, bQP, aQj, aX, cz, sH); #c1(IL1RAPL2) c2(NP_059112) c3(5431) c4(31545, 44602, 57659, 18488, 70716) c5(ao, Ik, BL, nz, f, vQ, cz, rQ); #c1(IL1RL1) c2(NP_001269337) c3(5432) c4(31546, 44603, 57660, 18489, 70717) c5(dx, gE, rB, aF, sE, Kc, ig, NH, KF, Fm, axK, dv, S, fq, AX, aDx, aG, M, fv, aYQ, fP, aq, nk, jB, adK, aC, du, J, gL, BZ, ti, fO, aZ, aZU, aDA, cy, jH, at, NG, zZ, cT, pH, bq, bQQ, aA, rC, h, ap); #c1(IL1RL2) c2(NP_003845) c3(5433) c4(31547, 44604, 57661, 18490, 70718) c5(da, cy, ig, cT, rB, bj, rC); #c1(IL1RN) c2(NP_000568) c3(5434) c4(31548, 44605, 57662, 18491, 70719) c5(jp, aPi, JH, rF, OH, e, cp, akv, dl, mR, zb, TP, aC, bLi, bQW, pq, tO, ag, axC, bk, fD, bq, aA, aAp, asL, X, eu, ig, vl, cM, rr, ak, av, CX, pW, is, V, ae, nl, cd, J, aRS, aY, iV, xe, qd, bwi, ap, aFI, bn, dk, byz, ba, jh, pi, aJ, aQd, dh, bQX, da, Vc, gL, rB, eV, UW, bQe, bQU, aED, vd, gN, IE, vZ, iL, gE, PI, m, or, aQk, wG, bQC, RQ, qB, NO, dj, be, bd, bR, On, ajn, bnn, bQT, Ic, fP, gl, amC, vk, alz, iU, bzL, bf, O, bQ, AX, DB, jm, bl, Zv, oJ, azZ, du, gm, bp, x, wh, gs, aZg, dS, fc, bMf, mE, bT, bP, fl, mk, aFm, afo, U, ey, co, f, fb, bu, aDV, gv, pJ, ny, cl, qH, yf, WH, am, atU, z, vn, d, bb, eA, q, QE, boq, qT, rX, o, fh, kF, YL, kt, LR, Ny, jU, jH, xU, gd, bQK, MZ, k, Ik, qX, eO, al, Ir, hN, ax, hW, ez, sj, sB, bQV, T, DI, gj, gf, bQS, dx, eX, aw, aZ, Ka, eW, eD, Vx, BI, aDx, bQz, aD, aBs, aAL, fO, vc, fx, hR, fy, akn, bY, rJ, cT, bQv, rn, bJA, vp, tp, hm, Mn, DM, B, bv, gg, iT, aEq, SA, rN, bt, JY, dO, fw, iu, abB, bW, b, zH, aF, tG, re, TQ, Zz, Dg, atr, KL, cz, IJ, qV, et, hU, aJA, gU, aFi, rC, mW, axA, rj, eb, sG, iZ, ik, W, ti, jl, aM, ale, ajv, zM, aPd, at, eG, h, iq, bx, sJ, w, wk, dv, cy, t, JF, gl, R, UQ, sH, bPN, gY, YY, amT, dH, xO, afE, bQR, yE, IN, vK, i, bQO, aFy, Kc, hS, IW, VG, rH, y, Em, cs, kN, brt, bm, ye, ali, fz, Dp, Io, cK, bQs, aDL, Im, apD, eR, DJ, yU, sU, aTF, jD, aO, Fp, Iz, bX, iW, se, ar, qe, atT, jG, u, nj, PJ, Pz, tg, I, im, qA, by, BZ, G, aAB, tA, yG, eQ, aE, ix, dn, I, A, Mj, di, dQ, bj, aX, ty, fq, adl, aV, jZ, pE, vg, hZ, P, j, XO, ac, jT, zE, bwW, MU, aAx, bh, aT, LQ, oT); #c1(IL20) c2(NP_061194) c3(5435) c4(31549, 44606, 57663, 18492, 70720) c5(dx, pV, DT, aE, DJ, mk, iL, gE, y, cp, m, bbE, co, bb, sT, fq, DM, f, dQ, aO, qB, fy, u, dh, da, wK, be, aC, du, byO, gL, P, dv, cy, jH, aH, jZ, mb, xU, ag, DI, fD, gl); #c1(IL20RA) c2(NP_001265651) c3(5436) c4(31550, 44607, 57664, 18493, 70721) c5(da, aX, aV, u, y); #c1(IL20RB) c2(NP_653318) c3(5437) c4(31551, 44608, 57665, 18494, 70722) c5(da, at, aX, fy); #c1(IL21) c2(NP_068575) c3(5438) c4(31552, 44609, 57666, 18495, 70723) c5(oz, w, bf, bu, O, cy, eE, fH, iz, gl, aNq, aC, gm, fO, jT, dH, jE, fc, cT, X, jz, eu, aGq, ig, y, DM, eV, Em, jS, cs, av, bm, gC, fJ, iy, fw, fG, WH, kE, b, z, hr, IS, jD, HQ, bb, yN, bX, j, dQ, u, aE, da, PJ, I, im, ahB, gL, ad, ajS, jU, jH, xU, I, MZ, Jo, gn, mW, iL, PI, jQ, m, aX, fq, aV, jZ, ax, cV, aNr, Og, II, by, aM, mb, abN, DI, fP); #c1(IL21R) c2(NP_068570) c3(5439) c4(31553, 44610, 57667, 18496, 70724) c5(bQZ, jz, eu, mW, iy, oy, m, bb, fq, eE, jQ, aE, bQY, zQ, aV, gl, aC, bGG, fO, cy, jT, fG, fc, CG, abN, cT, fP); #c1(IL22) c2(NP_065386) c3(5440) c4(31554, 44611, 57668, 18497, 70725) c5(en, pV, sE, w, JH, e, O, cy, AX, aDx, eE, aD, gl, aNq, aC, gm, fO, x, jT, sS, fc, bY, cT, agS, aA, rn, X, eu, mk, ix, Ku, bf, U, y, co, eK, sT, yX, rl, DM, bu, jS, cs, av, fy, bm, uO, V, ae, nl, Dp, Zr, byO, By, iy, pi, fw, fG, iu, WH, bn, kE, b, aF, z, d, bb, yN, bX, q, zx, CO, Pc, dQ, DY, u, dh, ri, da, I, ahB, gL, ad, IJ, jU, jH, ig, xU, gd, I, Pp, MZ, gn, mW, C, iL, gE, oy, m, bbE, aX, kn, fq, aE, qB, aV, jZ, cV, aMH, aNr, be, bR, P, T, II, pw, by, aM, DI, fP, atR, oT); #c1(IL22RA2) c2(NP_443194) c3(5441) c4(31555, 44612, 57669, 18498, 70726) c5(ix, dA); #c1 (IL23A) c2(XP_011536779) c3(5442) c4(31556, 44613, 57670, 18499, 70727) c5(en, JH, sE, Lw, vp, O, cy, yh, Pn, eE, gl, n, aNq, aC, fO, aCP, fx, fp, pq, LW, fc, Ox, ag, aA, bT, rn, mZ, X, jz, eu, aGq, mk, ix, aJE, U, co, yX, f, bu, iv, av, fy, iT, V, ae, nl, v, bt, pi, pJ, bPM, xe, fG, Im, iu, II, b, aF, li, re, q, HE, nj, ri, da, kt, gL, by, Io, jU, jH, ao, kh, xU, gd, I, bf, gn, mW, jc, Iv, iL, gE, aDt, jQ, m, IE, aX, fq, aE, cB, fP, aV, jZ, wF, aNr, be, ei, aoN, T, aox, ej, aM, Y, mb, PB, j, bh); #c1(IL23R) c2(XP_011539091) c3(5443) c4(31557, 44614, 57671, 18500, 70728) c5(JH, sE, iq, aDo, cy, dl, mR, Pv, jM, aC, gY, bRb, bnb, dH, QJ, Lz, ax, xr, bq, rn, X, mk, LK, IW, U, Oh, y, V, DM, bu, iv, zQ, fy, aFZ, aZz, rN, jh, nl, IR, xe, qO, ji, iu, rD, b, ia, Og, hr, HQ, Ag, q, u, nj, o, da, PJ, il, bRa, j, by, jU, jH, ig, Bg, aE, yV, ix, Bm, Mp, xu, qd, gn, axA, di, iL, eM, m, IE, I, h, ik, aV, fU, be, gV, ce, Jh, DI, fP, Oi, at, rr); #c1(IL24) c2(NP_001172085) c3(5444) c4(31558, 44615, 57672, 18501, 70729) c5(jL, da, A, pV, jT, b, cY, gE, aMI, dB, O, m, w, iG, bw, aw, U, re, G, e, y, d, M, byO, IE, aX, kJ, t, h, f, q, bu, eE, X, ar, B, cB, qB, av, fy, u, iT, oP, g, iP, V, cV, aC, zT, cs, J, bp, ad, jo, co, T, oi, cy, by, jG, JY, jH, jE, hX, bm, bX, P, nJ, ag, cT, DI, fP, QP, DM); #c1(IL25) c2(NP_073626) c3(5445) c4(31559, 44616, 57673, 18502, 70730) c5(bP, cy, NG, aos, DT, fP, gd, NH, fD, aDe, aD, pH, fq, u, aE, y, aDF); #c1(IL26) c2(XP_011536870) c3(5446) c4(31560, 44617, 57674, 18503, 70731) c5(jH, by, cy, ae, dA, aC, DM, f, bu, DI, fP, gY, aV, aE); #c1(IL27) c2(NP_663634) c3(5447) c4(31561, 44618, 57675, 18504, 70732) c5(dx, da, en, axx, b, qd, Em, aF, jz, bQg, aE, DJ, A, dV, iL, eM, bf, O, OH, aW, jQ, co, aX, pp, Kp, h, f, q, dZ, ik, y, cs, aD, av, aV, u, jZ, aoc, g, PJ, be, il, jH, aC, aDM, du, gm, gY, dv, II, cy, J, jT, pi, iU, jU, aM, DM, fy, Eu, fc, Bu, B, gd, DI, fP, I, bh, aA, gf, rn, gl); #c1(IL27RA) c2(NP_004834) c3(5448) c4(31562, 44619, 57676, 18505, 70733) c5(dx, be, aX, dv, aC, h, du, gd, DI, T, eM, aD, cy, DM, o); #c1(IL2) c2(NP_000577) c3(5449) c4(31563, 44620, 57677, 18506, 70734) c5(avO, ml, dB, vB, en, bbG, e, aFR, it, kJ, Pn, mR, TP, fe, ajc, aC, aPi, aEY, pq, aei, pS, tO, ag, axC, pH, bk, fD, aCQ, aA, asL, X, eu, ig, iG, bw, vl, cM, yX, rr, jS, av, fy, aFi, fi, vR, V, ae, nl, jC, J, anf, aY, dY, xe, ji, ap, aFI, aKO, azn, atr, dh, da, fs, il, Mi, j, ad, bIF, aFz, WZ, iN, nV, eV, CL, VT, Mp, hd, zD, bRc, pR, gn, gN, IE, C, iL, gE, PI, jw, jQ, m, bxh, oJ, qB, aCH, wF, oS, be, bd, bR, jo, Ap, aJN, VF, Jh, fP, E, hz, gl, dx, jK, vk, awh, iU, aJE, O, kE, yh, bNZ, iz, du, gm, bp, asz, x, wh, Vb, aZg, fc, sN, la, bT, bP, fl, bY, mk, ix, kY, U, apW, co, BL, px, fb, bu, aye, NZ, gv, ny, cl, gH, nb, Oa, rn, tl, WH, qz, z, hr, aYA, d, eA, q, ff, ar, yW, aM, o, aZ, jU, jH, Eu, ch, NG, gd, fl, asx, pD, al, ax, Fs, T, II, bQg, asn, nk, hq, eB, DI, auy, gj, DM, aw, fR, asy, aD, fH, oP, g, ha, bK, fO, vc, BW, fx, rS, hn, baC, cT, aXw, zu, cY, jz, NH, bf, tp, pp, ml, B, iv, bv, gg, iT, aEq, rN, bt, By, aNw, iu, hc, b, zH, aF, jL, wA, tN, tG, aiE, wZ, SI, re, hV, fJ, DC, bCW, Dg, Dc, cz, Fo, et, hU, aJA, hX, gU, Bm, acE, adK, mW, axA, Iv, vg, eM, pA, ik, W, aDA, aX, nP, qT, bmV, Y, bxh, at, h, pV, bx, cv, sJ, w, dv, cy, t, LX, JF, gl, sH, bEk, gY, jT, dH, f, bdW, yE, i, dc, Kt, y, vQ, aXq, Em, cs, kN, bm, dP, fG, fK, Im, bRe, Ey, ey, gZ, jD, Iz, bX, es, se, dQ, jG, u, nj, PJ, I, im, qA, by, BZ, G, aAB, aJD, eQ, rq, aE, I, bL, A, bRd, BY, D, pu, bj, aCX, jl, aGp, fq, ja, F, M, n, bNJ, nA, aV, jZ, aSL, fU, cV, iB, P, gL, pw, ac, qp, aBz, bh, oT, azF); #c1(IL2RA) c2(NP_000408) c3(5450) c4(31564, 44621, 57678, 18507, 70735) c5(hg, JH, Io, Ot, sE, sX, iU, Ip, sJ, w, hM, cO, vk, oU, O, M, cy, aYl, aEU, t, AX, Pn, eE, mR, aD, iz, gl, n, baH, Ad, C, bK, sH, GJ, gm, fO, dB, vc, atU, fy, PZ, jT, gg, dH, xO, Lz, sS, fc, bRg, DO, bY, tO, rS, cT, pH, fD, aC, qD, jl, bT, aEN, bP, zr, kN, X, ie, jz, eu, ag, Kc, mk, fU, NH, bf, bkc, vl, y, rN, yt, co, BL, ip, yX, DM, ak, zh, e, Em, B, iv, av, CX, rr, be, yV, ae, byO, cd, bxn, bxl, bt, qX, gC, qH, anf, JY, dP, P, ne, bH, gj, tl, abs, xS, iu, eL, WH, bxj, bn, bW, b, LX, qz, bhr, oi, oR, tG, aiE, jy, Kt, d, jh, hX, Tp, q, CO, zm, fv, ff, Tr, yW, u, aE, da, PJ, I, im, ER, Dg, gL, aZ, jG, jU, jH, hU, ig, ch, iq, xU, Bm, cK, zD, azt, A, iL, xu, qd, adK, gn, mW, cA, Iv, vg, bRf, PI, al, xe, aW, jQ, m, bxh, aX, vR, kn, fq, h, F, Ir, Vr, RQ, qB, fP, aV, aq, jZ, Yb, pE, ax, cV, aYF, J, bR, jo, T, II, aFt, pw, fM, aM, NG, MP, auZ, DI, j, iB, XO, gl, Dq, oT); #c1(IL2RB) c2(NP_000869) c3(5451) c4(31565, 44622, 57679, 18508, 70736) c5(ak, vg, fO, qd, adK, jz, DT, eR, aN, O, mk, m, adJ, Iv, tG, gE, cA, bf, U, aK, xl, agQ, jh, jv, LS, LI, pp, bj, h, f, N, q, bu, M, jQ, RQ, iv, aV, aE, pE, vR, fs, V, cV, aC, bK, Fs, J, gL, eu, iB, vc, ti, j, aX, by, cy, anf, iG, P, ao, nk, ig, rS, Fy, jR, Xm, gd, DI, fP, zO, fq, aCQ, eG, DM, Dg, zD); #c1(IL2RG) c2(NP_000197) c3(5452) c4(31566, 44623, 57680, 18509, 70737) c5(Zq, X, jz, eu, lv, bRh, jQ, jT, aX, b, pp, DM, jS, cs, av, g, nl, aC, jL, bLV, po, J, P, T, pJ, cy, ad, zQ, Eu, rS, Dc, cT, DI, CV, bCp, bRi); #c1(IL31) c2(XP_011536628) c3(5453) c4(31567, 44624, 57681, 18510, 70738) c5(da, nk, js, hp, fq, buX, eE, mk, fP, cB, asX); #c1(IL31RA) c2(NP_001229565) c3(5454) c4(31568, 44625, 57682, 18511, 70739) c5(co, cV, X, fq, f, dB, bu, jo, w, aA, ff, bRj, aLH, aaK, by, u, av, y, R); #c1(IL32) c2(NP_001012651) c3(5455) c4(31569, 44626, 57683, 18512, 70740) c5(dx, en, bt, b, qd, yh, nl, jc, A, lv, iL, e, y, d, co, aX, yX, kn, B, F, q, bu, aC, ik, n, cs, hV, FG, u, aFc, is, PJ, SA, be, il, bx, du, fO, ad, P, dv, II, aZ, ar, x, by, jG, QN, ok, kh, bkk, fG, ag, w, fP, Bm, gj, ji); #c1(IL33) c2(NP_001186569) c3(5456) c4(31570, 44627, 57684, 18513, 70741) c5(dx, bL, asx, bRm, Fc, mk, ix, NH, C, nl, FG, e, bRk, dv, cy, js, ag, wG, q, ap, eE, fv, jU, aD, fP, aCH, aV, adK, o, da, d, du, jH, aC, LR, gL, I, IJ, II, aZ, aDe, cl, JN, et, yA, be, aOo, aL, xO, dP, NG, aFB, hp, Oa, xe, gd, IN, aDF, pH, agS, fq, bRI, bq, aA, at, oT); #c1(IL34) c2(XP_011521205) c3(5457) c4(31571, 44628, 57685, 18514, 70742) c5(aC, aA, be, kF, zH); #c1(IL36A) c2(NP_055255) c3(5458) c4(31572, 44629, 57686, 18515, 70743) c5(aC, nl, yO); #c1(IL36B) c2(NP_055253) c3(5459) c4(31573, 44630, 57687, 18516, 70744) c5(aC, nl); #c1(IL36G) c2(NP_062564) c3(5460) c4(31574, 44631, 57688, 18517, 70745) c5(aC, nl, fl); #c1(IL36RN) c2(NP_775262) c3(5461) c4(31575, 44632, 57689, 18518, 70746) c5(da, fh, nl, bb, bRn, aC, atr, xe, mk, bg, JH, at, ap); #c1(IL37) c2(NP_055254) c3(5462) c4(31576, 44633, 57690, 18519, 70747) c5(JH, b, Pv, ix, aAb, U, m, co, fq, q, iv, ri, da, pi, aC, nl, wE, ei, et, jH, fP, lm); #c1(IL3) c2(NP_000579) c3(5463) c4(31577, 44634, 57691, 18520, 70748) c5(avO, jK, en, ER, bad, bf, ps, oU, O, cp, cy, kT, t, gP, aD, Kd, jH, aC, sH, fO, ft, fx, jT, pq, ie, tO, cT, pH, i, pt, ael, asm, aiE, jz, eu, Kc, ig, NH, Ei, px, pp, DM, oS, N, ky, iv, bm, cj, vR, CZ, ae, v, dP, gA, gR, oM, iu, eL, pv, vq, b, zH, anb, Em, eV, q, jV, aJ, jG, u, aE, o, da, PJ, wp, pF, G, sf, iw, fD, Y, Ck, fl, I, zD, aKO, A, fr, CE, di, Iv, jQ, aX, h, M, n, cB, cV, be, J, P, ti, ac, aM, NG, mb, ci, DI, fP); #c1(IL3RA) c2(NP_001254642) c3(5464) c4(31578, 44635, 57692, 18521, 70749) c5(sH, wp, Aa, AX, Fm, ie, J, tO, G, gR, t, h); #c1(IL4) c2(NP_000580) c3(5465) c4(31579, 44636, 57693, 18522, 70750) c5(en, iX, Vz, bRu, SB, hM, bbG, bNP, e, gM, jD, kJ, dl, mR, cl, bQe, fe, aC, dB, JN, pq, aei, tO, ag, axC, pH, fD, aCQ, bq, aA, asL, mZ, bQZ, X, eu, bRp, ig, Ou, bw, vl, cM, bBZ, yX, Dq, bIQ, jS, av, fy, fY, Bm, fi, vR, V, ae, nl, aDI, J, aRS, fJ, bPM, aY, dY, xe, rr, aDF, TA, aFI, vY, pl, yN, bxk, aJ, Xx, oO, aE, da, Mi, gL, ad, rB, fH, JI, nV, aoy, aoA, bQb, yA, TP, zD, gn, gN, C, iL, gE, aDt, jQ, fG, xT, ajn, aQk, Ir, aTe, qB, aCH, wF, m, be, bRs, bd, bR, jo, bnn, mb, Ic, asx, E, hz, gl, dx, iU, IM, qP, bf, O, DB, OM, bNZ, aoh, og, du, gm, bp, asz, x, wh, qt, aZg, sS, fc, bMf, bT, bP, fl, mk, ix, U, amx, co, f, aDD, fb, bu, aFZ, yV, Ov, gv, acM, ny, cl, yf, eE, Oa, ti, WH, qz, z, zL, d, bb, IY, jd, q, QE, sR, ff, hb, ar, yW, aM, iR, o, fh, adJ, oJ, BT, aZ, Ut, jU, jH, aAs, asm, NG, xU, EI, gd, bwo, fl, aZU, bRq, Jh, aDj, xu, qd, byM, pD, al, sb, bJz, apP, kt, uG, aq, LR, dt, Po, T, II, nk, aEb, DI, iB, gf, aw, iD, sE, bRw, DT, Ka, eW, ku, bPI, iq, Vx, asy, bRy, fP, eE, aD, kX, yG, g, aAL, bK, asM, fO, vc, BW, fx, FG, Pw, bRv, bY, cT, Pi, pW, vJ, nX, Al, cY, jz, NH, vp, tp, pp, DM, B, k, iv, bv, gg, CG, iT, QD, rN, BV, zO, bt, aum, bJd, fw, aNw, iu, he, fn, ach, gB, b, zH, aF, au, bRt, tG, re, hV, Dg, cz, bOp, Fo, qV, et, PL, hU, Qx, kC, gU, aFi, di, WP, yh, adK, mW, ds, iV, vg, eM, DK, eh, Iv, sx, ik, bPZ, Yb, bFT, bRo, aDA, jl, qT, Y, ajv, fW, zM, gu, at, eG, h, bRr, pV, bx, qE, sJ, w, cO, yi, dv, cy, t, JF, Hs, gl, n, tY, bsb, lb, sH, aDe, Lz, jT, eg, xO, ro, Ox, os, aeR, IN, i, dc, Zp, td, aFy, Kc, ax, bkc, xw, y, bPv, vQ, cs, kN, bm, ye, aZC, Dp, cK, pi, dP, dU, jR, aDL, gA, TQ, lm, kE, ic, ey, eV, lz, bX, jV, se, dQ, jG, u, nj, PJ, sQ, tg, I, by, G, Io, vw, dH, Jd, eQ, rq, I, aff, azt, A, xa, aZZ, D, pu, bj, aCX, aX, fq, adl, F, M, ID, aV, jZ, aPQ, cV, hZ, wE, gj, P, j, bRx, qe, zE, bh, MU, azF); #c1(IL4I1) c2(NP_001244947) c3(5466) c4(31580, 44637, 57694, 18523, 70751) c5(A, aX, iP, B, gm, sJ, bOa); #c1(IL4R) c2(NP_001244336) c3(5467) c4(31581, 44638, 57695, 18524, 70752) c5(Gm, dB, Ka, w, bf, yi, e, O, cp, gM, cy, t, bx, dl, azc, aD, fH, blz, RQ, g, ha, aC, bK, sH, fO, vc, x, jT, dH, qt, TO, tO, ag, cT, axC, pH, i, bq, aA, td, asm, bRz, mk, vR, Ku, Ou, bw, U, y, Ov, DM, B, bu, bIQ, kN, iT, aQs, QD, be, V, ae, QP, aCE, bt, cl, qD, dP, xe, iu, aG, ny, b, aF, bGG, ic, tG, eV, d, bb, bX, qd, jD, IY, se, dQ, ff, ar, u, aE, o, fh, da, I, Dg, LR, gL, aFy, rw, vw, et, Ut, Jd, jH, ig, rq, I, xa, bL, iL, xu, gU, adK, gN, bpE, Iv, vg, gE, al, oy, m, aX, ty, fq, eN, ID, fP, aV, jZ, pE, si, bRA, bd, P, ti, T, j, aDA, jl, ya, by, qe, fJ, nk, Ic, DI, auy, bh, at); #c1(IL5) c2(XP_006714664) c3(5468) c4(31582, 44639, 57696, 18525, 70753) c5(dx, dM, iq, oz, DT, sJ, en, bPI, vp, Mn, e, dv, cy, aZM, yh, bJJ, eE, bnh, aD, fH, gl, n, JI, NM, aC, sH, du, bRE, fO, iU, vc, aDe, fx, JN, Pw, aoC, aei, bm, bY, os, tO, cT, axC, pH, i, dc, jl, bT, fl, AI, asm, jz, eu, Kc, mk, NH, bkc, cM, bBZ, eK, DM, f, IN, vQ, bu, B, iv, gg, DL, DK, yV, aSz, aDI, aRS, fJ, dP, aY, fG, gA, aNw, TQ, aDF, iu, ap, WH, kE, b, HK, aZv, tG, aiE, IS, eV, d, bPz, gz, q, jD, bRC, dQ, as, ar, jG, u, nj, Jo, I, atr, gL, cz, bIF, aZ, WZ, jH, ig, ub, gd, CL, Bm, bQb, C, aKO, A, aDj, asx, Mj, Ik, gn, gN, JE, di, Iv, vg, al, bRB, JK, eb, jQ, m, aX, fq, h, M, bRF, bNJ, azT, oS, J, gm, P, ti, II, aDA, bRD, bRx, qe, jT, NG, JQ, kx, akm, DI, fP, gj, Nu, azF); #c1(IL5RA) c2(NP_000555) c3(5469) c4(31583, 44640, 57697, 18526, 70754) c5(fl, Ka, ig, NH, bb, fq, DM, dl, DI, jG, aV, fh, I, aC, sH, nk, cy, fx, aoC, NG, Ic, tO, gd, cT, ti, Bm, i, Xz, at); #c1(IL6) c2(NP_000591) c3(5470) c4(31584, 44641, 57698, 18527, 70755) c5(en, bPf, aHH, dD, dB, aqt, aDg, fb, baB, JH, rF, OH, ra, uA, cp, vr, LL, Zq, kJ, dl, aFA, aQd, cl, asa, TP, aNq, mz, oz, aCP, ajc, vN, bxO, jD, ft, ee, ME, aiL, bLi, pq, pb, jE, eW, aei, ie, tO, ag, axC, bk, fD, aC, pt, aA, wz, avz, asL, wJ, iF, X, aTF, eu, ul, ig, ali, dV, iG, bPG, GV, If, VJ, Oh, cM, yV, eK, yX, uj, adr, rr, hg, e, aPi, MR, av, fy, pW, zO, fi, vR, V, ae, nl, cd, IR, ar, fJ, bPM, bxm, auK, aY, dY, ajM, HB, bNO, oM, aG, aFI, bn, acA, Dr, jJ, Hr, vY, cl, aGX, pl, alD, qH, Tp, ap, yp, p, fv, tg, Tr, mR, DY, dh, wY, aNN, In, fs, il, Mi, bc, gL, ad, aD, aFz, fH, Eb, aYw, uf, nV, aoy, axA, mA, eo, VT, xf, Mp, Vs, cS, BK, zD, bRT, aED, bOm, vd, fr, pR, bII, gn, gN, QV, iH, fe, vZ, byQ, iL, DM, zK, KT, jQ, m, xT, or, oj, aQk, wG, bQC, oE, bjP, RQ, zv, iq, dj, Ea, ui, mc, J, asM, bR, jo, My, azo, bQA, aeq, zG, Jh, Ic, CW, bRH, atR, tk, pv, gl, dx, jK, r, vk, BW, WH, sd, iU, sA, eH, Dy, vp, aK, xl, cU, aDi, bQ, LN, AX, DB, bNZ, Pv, Zv, gd, oJ, tS, Ad, aeM, nl, du, yO, gm, bp, MO, auf, Kw, x, FW, fp, Ew, gs, dS, bPO, QD, aWQ, adJ, bRP, sU, bP, aEX, fl, C, aAb, wF, aGg, rd, mk, pX, ix, Ku, kY, cA, Iw, U, OJ, aEI, aiH, amx, co, BL, aoR, vn, f, aDD, bsY, bu, xb, dZ, ky, yK, be, aog, Ov, aDM, NZ, byO, gv, aGS, ny, bq, Hh, bd, bvV, gD, aH, nb, eF, Oa, tl, vj, aln, vq, am, PA, atU, oi, z, AI, bah, d, bb, eA, jd, aVK, aBG, q, IY, mL, sR, ff, hb, hV, HL, iR, o, fh, RG, kF, Xp, ob, qL, kt, LR, aZ, wd, Ut, jU, bnn, jH, Eu, aDb, uc, ch, azr, xU, aof, xY, Ou, bQv, bQE, fl, QP, Xm, sF, MZ, aDj, xu, gU, bPx, qX, HF, eO, al, vl, aW, vB, wN, bY, hN, cB, fP, aq, bRR, ax, aMH, ww, aZG, dt, dU, T, II, bi, ya, aZT, ii, bRQ, sE, eB, DI, auy, azZ, bRG, gf, akQ, eX, aw, Io, dN, aiu, bRK, aMr, iC, Ka, HC, axx, eD, sX, brv, Vx, aDx, eE, ji, bw, kX, yG, g, ha, aAL, bK, po, fO, Yl, vc, zX, fx, hR, xx, bRU, aml, rS, wK, hn, aEL, cT, aLT, aZD, eQ, rn, nX, gE, cG, cY, sj, cO, jz, kB, apN, Ni, amh, bf, cC, Jo, TG, tp, bQL, aFJ, px, pp, na, ml, B, gX, k, O, iv, bv, gg, iT, yJ, Gr, azd, asx, yg, bj, v, cx, bcL, aR, bt, aGa, By, gC, iA, BV, akG, sP, JY, MW, dO, cf, fw, uK, VE, bRS, ej, adq, iu, ach, gB, bW, b, zH, aF, Of, bg, wA, au, Ny, tG, aiE, aiR, bQt, bOk, wZ, jR, re, gz, bRN, NJ, OC, vu, blp, ri, aEf, Dg, atr, cz, da, IX, IJ, aGn, wx, qV, et, cW, axM, hU, xL, aJA, DR, hT, ex, cX, kC, IS, aFi, vF, D, pz, IA, blo, uk, IO, JS, adK, mW, aFe, og, akL, Iv, vg, eM, wf, xe, jx, vH, qs, LS, sG, hP, Bi, gT, HY, pC, ik, bPZ, afp, PT, sH, qG, nk, GS, Ej, W, asO, bNt, zS, jl, bRI, aM, bmV, Y, MP, tA, zM, aas, Sv, aPd, at, eG, h, byB, pV, Ym, Ob, bx, F, bad, gG, aN, eC, Zs, sJ, w, Gk, gO, M, dv, cy, qc, t, Si, bOx, bPP, tE, JF, Hs, Uy, gl, bsb, aDk, bRO, gJ, Ij, Lz, od, Jj, PZ, jT, dL, dH, jM, fN, sS, os, baY, we, yE, IN, vK, i, dc, bsZ, rN, id, td, Kt, Zx, aFy, bRM, fU, IW, aXg, A, y, ed, MI, ip, bPv, UV, vQ, amZ, Em, aFL, cc, cs, kN, JD, bm, ye, cj, em, jB, sB, fz, jh, zl, afB, pr, cK, pi, aec, aaa, dP, py, aNp, bT, aDL, aFW, gA, TQ, gj, fK, Im, qB, ci, wT, nU, kE, aOR, vh, anb, eR, DJ, Ey, yU, ic, axq, ey, gZ, gF, aO, bRL, ND, Fp, xi, lz, zJ, bX, aXF, jV, se, dQ, aRY, bQo, jG, u, nj, wR, PJ, iP, sQ, I, qA, el, aZI, by, BZ, wM, G, qp, Sq, aAB, Jm, GW, Jd, bPT, NW, KK, IS, hS, Fn, RU, he, aE, ih, aFk, rv, I, vf, bsk, bL, bRJ, aov, xa, OV, HJ, aZZ, di, pu, sx, yw, amE, oy, vW, aX, ty, kn, fq, aEz, bQJ, az, Vr, eN, n, bNJ, aV, jZ, aFc, aSL, pE, ma, si, aFV, cV, adh, iB, P, IC, j, Oi, mQ, pF, ac, Lc, zE, LQ, bRV, vS, aBz, bh, aT, rZ, Nu, wc, oT); #c1(IL6R) c2(NP_000556) c3(5471) c4(31585, 44642, 57699, 18528, 70756) c5(dx, jK, eX, cO, bf, e, O, cp, dv, cy, aC, sH, du, fO, ft, vc, fx, jT, gg, rS, tO, yE, cT, i, bq, aA, X, jz, mk, ix, bw, vl, y, tp, co, DM, px, fb, bu, cc, av, fy, bm, iF, cd, JY, nJ, b, ic, tG, ey, d, bb, Tp, q, mL, Tr, u, dh, o, I, Dg, LR, gL, by, agl, aGn, MO, aYZ, ig, I, Vs, A, iL, fr, vg, jQ, m, aX, ik, n, aV, cV, J, vF, P, T, azo, aM, zE, aDy, Dl, fP, at); #c1(ILGST) c2(NP_001177910) c3(5472) c4(31586, 44643, 57700, 18529, 70757) c5(dx, B, b, bx, X, z, dk, di, YB, cO, vl, jR, aGX, bmo, y, d, Ag, aX, px, ag, t, h, f, e, g, yE, bu, mR, O, Xp, iv, ar, av, u, o, fh, g, iF, be, rN, I, gG, aC, hZ, sH, du, J, fO, vF, W, P, T, II, jU, by, ac, yG, nk, agl, bm, LR, G, Jj, eX, gd, cT, fP, Af, bq, aA, at, re, rn, pv); #c1(IL7) c2(NP_001186815) c3(5473) c4(31587, 44644, 57701, 18530, 70758) c5(dx, en, ER, dB, sJ, bf, O, dv, cy, t, Si, yh, apw, bRW, Dc, aC, du, fO, ME, jT, gg, fc, cT, X, jz, eu, mk, U, y, V, co, yX, DM, B, jS, av, fy, rN, cK, fG, WH, b, zH, aF, oR, jD, bb, pn, oO, u, aE, Dg, UG, gL, by, G, jH, gd, A, Pb, qd, gn, CE, Iv, iL, al, aJj, jQ, aX, fq, h, aV, aq, cV, sj, be, J, P, bp, aM, eJ, mb, Dl, fP, iB, at); #c1(IL7R) c2(NP_002176) c3(5474) c4(31588, 44645, 57702, 18531, 70759) c5(mZ, bxj, en, ER, Kt, b, eu, gN, Ip, sJ, vR, Ku, iL, gE, e, U, G, aJj, y, cy, d, jl, co, aGE, aDr, t, h, f, aWb, bu, aEU, aoQ, fy, iv, mR, dH, u, aE, nk, pE, ax, V, ae, cV, aC, Dg, aYF, J, I, P, ti, T, II, aZ, Hh, or, jH, aV, eV, fc, aq, Dc, jS, i, fq, iB, aA, aGE, eG, bT, oT); #c1(IL9) c2(NP_000581) c3(5475) c4(31589, 44646, 57703, 18532, 70760) c5(jS, vW, Tp, JH, asx, adK, jz, DT, aE, DJ, ig, sJ, NH, Iv, vk, U, pH, ps, CZ, eE, co, aX, sG, fq, DM, vf, zh, jQ, cy, dl, dQ, bRW, JF, Tr, ik, yW, aV, ye, o, fh, da, aKq, V, ae, m, aC, sH, fO, J, gL, eu, aD, P, ti, bol, aZ, HE, aDA, bb, Ka, gg, jQ, jH, jT, dP, NG, fc, lc, yj, bY, fP, tO, aeR, gd, cT, Dl, TQ, bq, gj, aeS, at); #c1(IL9R) c2(NP_002177) c3(5476) c4(31590, 44647, 57704, 18533, 70761) c5(vk, TQ, sJ, z, co, aX, fq, DM, JF, aD, o, da, vR, aC, sH, ti, cy, jQ, dP, tO, Dl, i); #c1(ILDR1) c2(NP_001186728) c3(5477) c4(31591, 44648, 57705, 18534, 70762) c5(bRX, aV, ix, n); #c1(ILDR2) c2(NP_955383) c3(5478) c4(31592, 44649, 57706, 18535, 70763) c5(di, cp); #c1(ILF2) c2(NP_001254738) c3(5479) c4(31593, 44650, 57707, 18536, 70764) c5(AX, Lu, Ip, P, re, iT); #c1(ILF3) c2(NP_001131145) c3(5480) c4(31594, 44651, 57708, 18537, 70765) c5(ld, en, lq, c, aC, AX, gL, cc, cO, oD, u, bq, O); #c1(ILK) c2(NP_001014795) c3(5481) c4(31595, 44652, 57709, 18538, 70766) c5(gK, by, hV, aw, b, k, X, QG, eu, Hr, O, hS, w, dd, fv, cO, HJ, nT, U, A, fD, y, gO, co, Ml, i, h, f, q, bu, HY, fr, mR, B, cs, bw, ar, av, Hs, u, dh, Ty, cl, g, V, I, is, J, bp, ft, T, II, x, aX, fx, hR, et, jU, eQ, fy, of, nV, sS, vZ, Fr, fO, et, XH, tl, ds, at, cK, alQ, dB); #c1(IMMP1L) c2(NP_001291203) c3(5482) c4(31596, 44653, 57710, 18539, 70767) c5(cs, od, yN, b, ad); #c1 (IMMP2L) c2(XP_005250687) c3(5483) c4(31597, 44654, 57711, 18540, 70768) c5(hW, b, I, bo, cz, w, zb, cO, Fg); #c1(IMMT) c2(NP_001093639) c3(5484) c4(31598, 44655, 57712, 18541, 70769) c5(bP, A, b, EM, aoJ, aM, bf, yv, na, f, bjg, B, as, aV, aq, g, Eg, an, bN, cV, ac, sK, ag, fP, fD, ji); #c1(IMP3) c2(NP_060755) c3(5485) c4(31599, 44656, 57713, 18542, 70770) c5(i, b, k, fr, hV, q, ft, afz, Mr, kY, fx, u, y); #c1(IMPA1) c2(NP_001138350) c3(5486) c4(31600, 44657, 57714, 18543, 70771) c5(fl, avb, b, I, ado, ak, J, ad, Sw, cs, pY); #c1(IMPA2) c2(NP_055029) c3(5487) c4(31601, 44658, 57715, 18544, 70772) c5(bb, ak, ns, vu, cM, hW, eG, aO, fh); #c1(IMPACT) c2(NP_060909) c3(5488) c4(31602, 44659, 57716, 18545, 70773) c5(at, b, aY, vu, ak, dc, J, B, ns, nm, nt, nq, nr, nn, fy, A, no, np, kV, cM, ap); #c1(IMPAD1) c2(NP_060283) c3(5489) c4(31603, 44660, 57717, 18546, 70774) c5(cp, fl, bRY, b, ID); #c1 (IMPDH1) c2(NP_000874) c3(5490) c4(31604, 44661, 57718, 18547, 70775) c5(bSb, IH, nQ, bRZ, Nx, fP, nv, ea, nW, y, yn, bSc, bSa, u, ml, aW); #c1(IMPDH2) c2(NP_000875) c3(5491) c4(31605, 44662, 57719, 18548, 70776) c5(iw, IH, b, fr, ft, aC, hN, fD, bf); #c1(IMPG1) c2(NP_001269297) c3(5492) c4(31606, 44663, 57720, 18549, 70777) c5(t, ml, bSd, SF, dX, bq, Nx, aW); #c1 (IMPG2) c2(NP_057331) c3(5493) c4(31607, 44664, 57721, 18550, 70778) c5(ml, v, bSd, bSe, Nx, bw, nW, aW); #c1(INADL) c2(XP_011538767) c3(5494) c4(31608, 44665, 57722, 18551, 70779) c5(A, jz, ow, bq, alE, U, IV, jfl); #c1(INA) c2(NP_116116) c3(5495) c4(31609, 44666, 57723, 18552, 70780) c5(aHi, jR, aw, bS, pp, cV, bK, RY, Fs, PY, jt, es, eu, v, w, fO, aj, bSf, ai, O); #c1(INCENP) c2(NP_001035784) c3(5496) c4(31610, 44667, 57724, 18553, 70781) c5(by, aX, bu); #c1(INF2) c2(NP_001026884) c3(5497) c4(31611, 44668, 57725, 18554, 70782) c5(bP, ec, bSh, wB, cG, wd, nU, BP, Y, fD, bSg, et, te); #c1(ING1) c2(NP_001254657) c3(5498) c4(31612, 44669, 57726, 18555, 70783) c5(b, k, X, pD, w, U, e, y, d, co, aX, h, f, F, q, bu, M, fr, ar, O, av, fy, bm, g, V, aeM, cV, bp, ft, qO, T, fO, rT, cy, aeC, by, jH, u, DO, fP, tl, rr); #c1(ING2) c2(NP_001278888) c3(5499) c4(31613, 44670, 57727, 18556, 70784) c5(aMC, b, O, e, y, d, jT, aX, jd, f, F, q, bu, ar, fy, u, V, cV, bp, by, P, fx, qH, UW, i); #c1(ING3) c2(NP_061944) c3(5500) c4(31614, 44671, 57728, 18557, 70785) c5(aMC, b, cY, U, e, y, d, aX, ip, f, F, q, bu, ar, fy, u, V, by, GB, cz, DO, UW); #c1(ING4) c2(NP_001121054) c3(5501) c4(31615, 44672, 57729, 18558, 70786) c5(B, b, k, X, w, U, A, y, co, aX, ip, f, F, q, cU, ar, O, cs, gg, fy, u, g, Bk, LR, fO, ad, by, av, JY, ag, ji); #c1(ING5) c2(NP_115705) c3(5502) c4(31616, 44673, 57730, 18559, 70787) c5(ag, h, T, aZK, by); #c1(INHA) c2(NP_002182) c3(5503) c4(31617, 44674, 57731, 18560, 70788) c5(A, b, X, jj, dB, bci, MS, ck, di, Lr, bbz, jw, jx, bDN, cy, Be, re, B, q, bu, cU, apB, ar, tg, av, aq, kF, sH, by, P, Hq, T, Ca, Ap, US, u, eQ, SJ, eG); #c1(INHBA) c2(NP_002183) c3(5504) c4(31618, 44675, 57732, 18561, 70789) c5(A, ID, b, X, dB, kB, ck, ku, cO, Lr, e, d, qf, DP, q, bu, ar, oJ, av, ji, u, kF, V, aC, sH, by, T, pt, iA, ao, py, eQ, in, UT, kC, bq, oM, aA, eG); #c1(INHBB) c2(NP_002184) c3(5505) c4(31619, 44676, 57733, 18562, 70790) c5(US, A, arl, V, UV, UW, jJ, W, ck, T, Lr, cO, kF, di, av, u, aA, jw); #c1(INHBC) c2(NP_005529) c3(5506) c4(31620, 44677, 57734, 18563, 70791) c5(ck, W, Lr, av, fy, aW); #c1 (INHBE) c2(NP_113667) c3(5507) c4(31621, 44678, 57735, 18564, 70792) c5(gK, f, b, cY, kB, ck, Lr, Iw, Co, bQ, aX, kJ, hV, X, kz, cc, cB, yE, av, pP, aB, Cz, ad, IR, IX, Hq, T, Ca, W, nV, ep, aq, IS, bq, eG); #c1(IN080B) c2(NP_112578) c3(5508) c4(31622, 44679, 57736, 18565, 70793) c5(A, B); #c1(IN080D) c2(NP_060229) c3(5509) c4(31623, 44680, 57737, 18566, 70794) c5(Fg); #c1 (IN080D) c2(NP_060023) c3(5510) c4(31624, 44681, 57738, 18567, 70795) c5(KM); #c1(INPP1) c2(NP_001122400) c3(5511) c4(31625, 44682, 57739, 18568, 70796) c5(b, V, I, ak, cz, ns, Ey, cB, U); #c1 (INPP4A) c2(NP_001127696) c3(5512) c4(31626, 44683, 57740, 18569, 70797) c5(aD, nQ, cy); #c1(INPP4B) c2(NP_001095139) c3(5513) c4(31627, 44684, 57741, 18570, 70798) c5(GD, A, aw, b, X, B, J, rR, kY, aX, av, u, y, cp); #c1(INPP5A) c2(NP_005530) c3(5514) c4(31628, 44685, 57742, 18571, 70799) c5(Lm, qP, adr, kM); #c1 (INPP5B) c2(NP_001284363) c3(5515) c4(31629, 44686, 57743, 18572, 70800) c5(Lm, acg); #c1(INPP5D) c2(NP_001017915) c3(5516) c4(31630, 44687, 57744, 18573, 70801) c5(dx, dv, gE, b, Ec, h, du, N, gm, fO, J, M, pJ, jG, bZ, II, iv, al, aA, n); #c1(INPP5E) c2(NP_063945) c3(5517) c4(31631, 44688, 57745, 18574, 70802) c5(Pu, aX, aPA, nU, TD, Lm, aTd, aA, bSi); #c1(INPP5F)

c2(NP_001230123) c3(5518) c4(31632, 44689, 57746, 18575, 70803) c5(oy); #c1(INPP5K) c2(NP_057616) c3(5519) c4(31633, 44690, 57747, 18576, 70804) c5(EO, DO, aX, kE, fl); #c1(INPPL1) c2(NP_001558) c3(5520) c4(31634, 44691, 57748, 18577, 70805) c5(b, w, di, bf, y, bsL, qs, bSj, eX, q, cs, jG, u, aE, I, fO, ad, T, x, aM, cf, aA); #c1(INSC) c2(NP_001027024) c3(5521) c4(31635, 44692, 57749, 18578, 70806) c5(A, bb); #c1(INS) c2(NP_001278826) c3(5522) c4(31636, 44693, 57750, 18579, 70807) c5(en, dD, bSz, dB, bSQ, hM, ER, cp, kJ, nm, aQd, cl, xl, ati, mz, xc, fe, aC, qY, bSI, YT, Kb, kl, iz, tS, jE, bAI, Dz, ag, aah, bk, fD, aZA, aHD, ug, avX, iF, X, vD, eu, ig, afD, vT, bo, bw, bAJ, kV, cM, DG, ak, vE, av, fy, is, Hb, V, ae, aoz, IR, Fy, rT, jG, aAE, ahT, bSr, bSG, aY, dY, bSN, TT, oM, qh, bSC, ap, ck, fQ, bSU, jJ, QY, bJw, bSw, aoi, mF, jh, Be, bSx, bgp, aDN, aoG, oO, Jm, DY, dh, aNN, il, be, j, ad, asG, kS, ao, nV, aYZ, RT, aGv, mA, th, BK, fr, ka, C, iL, gE, zK, jw, awa, Nl, avW, lr, bn, RQ, p, ev, nW, m, me, J, jo, ato, bSU, cq, Ap, TE, lc, yC, so, PS, dx, aNi, r, mq, eH, bf, Pl, aK, xl, wm, dC, bQ, DE, rh, gB, bSH, bbJ, bOL, afF, Cp, oN, afM, og, du, yO, QZ, FW, akK, fp, aOo, atn, wh, Lz, dS, mB, sN, bSM, mx, bSp, ZT, Mb, bP, fl, dE, oH, mk, kY, cA, U, Wl, co, sT, f, bu, xb, bBR, yV, mt, gv, pt, Hh, zf, qH, aA, aZC, aH, tm, Fz, aLz, tl, UU, am, bhr, z, jy, ec, aao, bb, eA, jd, q, QX, mL, ff, aGw, yW, qT, o, jj, bSE, ob, qL, oJ, Fw, LR, sf, uw, qg, afj, jH, rQ, bru, UJ, aCp, xU, na, xY, fl, mv, aiF, arN, mp, asx, bSI, Ik, pD, adu, bSV, qX, eO, nU, al, ft, aW, LI, aci, ni, bSm, bAr, Gw, arK, bSs, aCr, Ry, ax, nQ, sj, sB, dt, uF, T, II, wU, ii, bSB, hq, iB, eX, aw, dN, rR, aoJ, dM, wX, iy, Vx, bLm, Kg, bSk, aD, bze, g, aXy, Ph, aqQ, bK, yL, fO, azo, bSt, fx, hR, OA, mC, OR, aTZ, cT, w, ch, bSn, bmX, afT, fi, cO, kB, bSJ, yn, asl, Hi, bSo, pp, ml, B, gX, k, iv, bv, oD, gg, iT, Gr, rv, bj, qq, cx, v, Hq, iA, JY, dO, aac, aKy, nc, cf, fw, uK, qc, iu, uy, b, KG, aF, bg, MG, au, kF, bSq, re, hV, adP, HD, sz, bSv, UK, KL, bzj, da, IX, ack, et, Ha, awV, hU, aOO, RS, hX, aNY, Ck, ex, yy, IS, ZL, uk, bAk, aFq, ea, xf, wf, vH, qs, S, hP, ajo, cU, tF, ik, Ld, PT, bSR, bzB, Dw, vF, W, ji, jl, bSS, fM, aM, Y, abX, MP, aas, at, eG, iq, gG, bSP, ns, nm, nt, nq, nr, nn, bSW, no, np, Mn, gO, dv, bJm, t, eQ, Me, bKA, sL, bKp, tE, Hs, Ox, n, pN, sH, afh, gJ, bKu, Kh, ca, jT, dL, dH, bSA, fN, Kf, vY, os, Hf, we, yE, IN, i, dc, wD, mh, aVa, id, td, Kt, LD, hS, IW, bAz, xw, aNQ, y, ed, aoW, vQ, afH, cc, cs, bSu, bm, cj, em, jB, bAm, Hd, bSL, mD, cK, wM, bOP, aaa, py, Fu, jR, bT, bDy, UT, ci, uh, An, kE, eR, Hu, agy, MY, ey, gZ, jD, aO, yK, ala, ZB, es, ar, jG, u, wR, bSK, I, el, by, Km, G, aFj, aoT, Nh, avF, Aj, bSF, GW, yG, rd, tW, tJ, he, aE, arA, bq, bSy, biS, aKw, bL, A, bST, sv, big, rU, et, BY, di, pu, Bz, sx, oy, c, MT, aX, wp, sS, kn, h, op, az, awS, aV, jZ, Pk, pE, fU, si, IN, cV, bSD, P, Oi, gF, pF, sK, qp, agc, bh, aT, oT); #c1(INSIG1) c2(NP_005533) c3(5523) c4(31637, 44694, 57751, 18580, 70808) c5(dx, A, b, eH, Ag, dv, f, q, bu, bm, o, ZA, I, du, by, T, eX, hR, dL, fN, Af, bq, aA, at); #c1(INSIG2) c2(XP_011509594) c3(5524) c4(31638, 44695, 57752, 18581, 70809) c5(dx, ml, dD, rd, cO, bf, y, arl, eX, Ml, cs, aV, u, qL, du, cx, ad, x, cy, hR, aM, ag, bq, aA, at); #c1(INS-IGF2) c2(NP_001035835) c3(5525) c4(31639, 44696, 57753, 18582, 70810) c5(en, dD, bSz, dB, hM, ER, cp, kJ, om, cl, ati, mz, xc, fe, aC, qY, bSl, YT, Kb, kl, jE, bAI, Dz, ag, aah, bk, fD, aZA, aHD, ug, avX, iF, X, vD, eu, ig, afD, vT, bo, bw, bAJ, kV, cM, DG, ak, vE, av, fy, Hb, V, ae, aoz, IR, Fy, rT, jC, aAE, ahT, bSr, bSG, aY, dY, bSN, TT, oM, qh, bSC, ap, ck, aGv, jJ, QY, bJw, bSw, aoi, mF, jh, Be, bSx, bgp, fr, oO, Jm, DY, dh, aNN, il, be, j, ad, asG, kS, ao, nV, aYZ, RT, mA, th, BK, ka, C, iL, gE, zK, jw, awa, Nl, avW, lr, bn, oJ, p, ev, me, jo, ate, bSU, Ap, TE, lc, yC, so, PS, dx, aNi, r, mq, eH, bf, Pl, aK, xl, wm, dC, bQ, DE, rh, gB, bSH, bbJ, bOL, afF, Cp, afM, nq, du, yO, QZ, FW, akK, fp, aOo, atn, wh, dS, mB, sN, bSM, bSp, ZT, Mb, bP, fl, dE, oH, mk, kY, et, U, Wl, co, sT, f, bu, xb, bBR, yV, mt, gv, wt, pt, Hh, zf, qH, aA, azC, tm, Fz, aLz, tl, UU, am, bhr, z, jy, ec, aao, bb, jd, q, QX, mL, ff, hV, yW, qT, o, jj, kF, ob, qL, Fw, LR, sf, uw, qg, afj, jH, bru, UJ, aCp, xU, na, xY, mv, aiF, mp, asx, HD, Ik, pD, adu, bSV, qX, bSE, al, aW, LI, aci, ni, bSm, Gw, pN, bSs, Ry, sj, sB, dt, uF, T, II, wU, ii, bSB, hq, eX, aw, dN, rR, aoJ, dM, iy, Vx, bLm, Kg, bSk, bze, g, aXy, aqQ, bK, yL, fO, azo, bSt, fx, hR, mC, OR, aTZ, cT, nm, bmX, afT, fi, cO, kB, bSJ, arN, asl, Hi, pp, ml, B, gX, k, iv, bv, oD, gg, iT, Gr, arA, qq, v, Hq, iA, JY, dO, aac, aKy, nc, cf, fw, vH, qc, iu, uy, b, KG, aF, bg, MC, au, bSg, re, aGw, adP, sz, wp, UK, KL, bzj, da, IX, et, Ha, awV, hU, aOO, RS, hX, Ck, ex, yy, IS, ZL, uk, bAk, aFq, xf, wf, uK, qs, S, hP, ajo, cU, tF, ik, Ld, PT, bSR, bzB, Dw, vF, W, ji, jl, bSS, fM, aM, Y, abX, MP, aas, at, eG, iq, gG, bSP, ns, w, nt, nq, nr, nn, bSW, no, np, gO, dv, bJm, t, eQ, Me, bKA, sL, bKp, tE, Hs, Qx, n, arK, ft, afh, gJ, bKu, Kh, ca, jT, dL, cg, bSA, fN, Kf, vY, os, fQ, we, yE, IN, i, dc, wD, mh, aVa, id, Kt, LD, hS, IW, bAz, xw, aNQ, y, ed, aoW, vQ, afH, cc, cs, bSu, bm, cj, em, jB, bAm, Hd, bSL, mD, cK, wM, aaa, py, Fu, jR, bT, bDy, UT, ci, uh, An, kE, eR, Hu, agy, MY, ey, gZ, jD, aO, yK, ala, ZB, es, ar, jG, u, wR, bSK, I, el, by, Km, G, aFj, aoT, Nh, avF, Aj, GW, yG, rd, tW, tJ, he, aE, rv, bq, bSy, biS, aKw, bL, A, sv, big, rU, di, pu, Bz, sx, c, MT, aX, kn, h, op, az, awS, nU, aV, jZ, pE, fU, si, cV, yH, P, Oi, gF, pF, sK, qp, bh, aT, oT); #c1(INSL3) c2(NP_001252516) c3(5526) c4(31640, 44697, 57754, 18583, 70811) c5(B, iq, am, X, Lv, ck, bf, cp, bLd, bSX, hV, PA, bu, afM, fU, kE, UK, Be, NT, vF, W, UT, nP, by, aM, US, nV, eQ, UW, yy); #c1(INSL4) c2(NP_002186) c3(5527) c4(31641, 44698, 57755, 18584, 70812) c5(od, aq, Dd, u, jH); #c1(INSL6) c2(NP_009110) c3(5528) c4(31642, 44699, 57756, 18585, 70813) c5(jH, fs); #c1(INSM1) c2(NP_002187) c3(5529) c4(31643, 44700, 57757, 18586, 70814) c5(fU, b, cV, jR, w, cB, fl, bm, qp); #c1(INSM2) c2(NP_115983) c3(5530) c4(31644, 44701, 57758, 18587, 70815) c5(bf, cf, bm, aE, aM); #c1(INSR) c2(NP_000199) c3(5531) c4(31645, 44702, 57759, 18588, 70816) c5(dx, B, eH, hM, bf, e, xl, dv, iy, bJm, aQd, cl, IV, g, pb, bSZ, sH, du, Kh, ed, Kb, atn, fN, ag, cT, i, mD, aA, bTb, X, EB, vD, rd, U, y, co, f, O, qY, oD, av, fy, bm, em, jB, V, Et, cx, v, bQ, eX, eq, bq, Hh, iA, azC, d, cf, nJ, b, QY, bg, sU, Hu, z, ey, fD, hh, bSg, vf, q, bTa, QX, ar, aGv, oO, u, aE, o, kE, I, el, Km, aZ, et, ch, aCt, mA, I, A, bSY, mz, pD, di, pu, bSE, bj, Ld, oy, c, qs, sG, h, avW, ajo, cU, rR, vF, W, Ql, T, gF, aM, jT, lc, asx, aT, at, eG); #c1(INSRR) c2(NP_055030) c3(5532) c4(31646, 44703, 57760, 18589, 70817) c5(P, ae, I, cV, bjQ, fl, dB, J, ad, aoN, ah, cs, rb, u, y, ap); #c1(INTS12) c2(NP_001135943) c3(5533) c4(31647, 44704, 57761, 18590, 70818) c5(l, DF, di, aZ); #c1(INTS1) c2(NP_001073922) c3(5534) c4(31648, 44705, 57762, 18591, 70819) c5(aw, b, h, dB, P, n, QP); #c1(INTS2) c2(NP_065799) c3(5535) c4(31649, 44706, 57763, 18592, 70820) c5(aw, b, X, eu, wy, Ip, ow, O, e, y, d, jh, aX, btg, Be, h, F, q, gT, cU, CO, ar, n, HE, av, u, fe, Yv, il, qq, J, P, T, iO, iA, Pk, yG, hX, avB, i); #c1(INTS3) c2(NP_075391) c3(5536) c4(31650, 44707, 57764, 18593, 70821) c5(pz, J); #c1(INTS4) c2(NP_291025) c3(5537) c4(31651, 44708, 57765, 18594, 70822) c5(ao, bKn, pq, iU, j, Bm, aZ, CX, NO); #c1(INTS5) c2(NP_085131) c3(5538) c4(31652, 44709, 57766, 18595, 70823) c5(u, y); #c1(INTS6) c2(NP_001035026) c3(5539) c4(31653, 44710, 57767, 18596, 70824) c5(A, b, cV, X, B, T, cB, X, fy, u, y, fh); #c1(INTS7) c2(NP_001186738) c3(5540) c4(31654, 44711, 57768, 18597, 70825) c5(ak, bb); #c1(INTS8) c2(NP_060334) c3(5541) c4(31655, 44712, 57769, 18598, 70826) c5(aGk, Jz, BW, oE); #c1(INTU) c2(NP_056508) c3(5542) c4(31656, 44713, 57770, 18599, 70827) c5(eu, J, P, T, O, ar, u, y, cq); #c1(INVS) c2(NP_055240) c3(5543) c4(31657, 44714, 57771, 18600, 70828) c5(bP, da, r, bTc, fD, h, vU, J, TD, bKw, aLg, wt, EG, Cl, NB, Hs, Mw, nW); #c1(IPGK1) c2(NP_001006115) c3(5544) c4(31658, 44715, 57772, 18601, 70829) c5(1); #c1(IPGK2) c2(NP_001005911) c3(5545) c4(31659, 44716, 57773, 18602, 70830) c5(si, av, T, b, nJ); #c1(IPGK3) c2(NP_001136355) c3(5546) c4(31660, 44717, 57774, 18603, 70831) c5(bq, m); #c1(IPCEF1) c2(XP_005266979) c3(5547) c4(31661, 44718, 57775, 18604, 70832) c5(gj, bf, ie); #c1(IPMK) c2(NP_689416) c3(5548) c4(31662, 44719, 57776, 18605, 70833) c5(bg); #c1(IPO11) c2(NP_001128251) c3(5549) c4(31663, 44720, 57777, 18606, 70834) c5(ape); #c1(IPO13) c2(XP_011540763) c3(5550) c4(31664, 44721, 57778, 18607, 70835) c5(cy, ti, u, b, ge); #c1(IP07) c2(NP_006382) c3(5551) c4(31665, 44722, 57779, 18608, 70836) c5(P, B, di, II, fl); #c1(IP08) c2(NP_001177924) c3(5552) c4(31666, 44723, 57780, 18609, 70837) c5(fP); #c1(IP09) c2(NP_060555) c3(5553) c4(31667, 44724, 57781, 18610, 70838) c5(e); #c1(IQCB1) c2(NP_001018864) c3(5554) c4(31668, 44725, 57782, 18611, 70839) c5(bP, vU, wp, nQ, bTe, hP, nW, xJ, bu, bTd, Nx, UT, et, SO); #c1(IQCG) c2(NP_001127907) c3(5555) c4(31669, 44726, 57783, 18612, 70840) c5(M); #c1(IQCH) c2(NP_001026885) c3(5556) c4(31670, 44727, 57784, 18613, 70841) c5(aX); #c1(IQCJ) c2(NP_001036170) c3(5557) c4(31671, 44728, 57785, 18614, 70842) c5(O, cV); #c1(IQCJ-SCHIP1) c2(NP_001184042) c3(5558) c4(31672, 44729, 57786, 18615, 70843) c5(ig, pR, sh, et, sg); #c1(IQCK) c2(NP_694940) c3(5559) c4(31673, 44730, 57787, 18616, 70844) c5(aA); #c1(IQGAP1) c2(NP_003861) c3(5560) c4(31674, 44731, 57788, 18617, 70845) c5(fl, b, X, og, U, O, jh, f, g, bu, ra, ar, y, cs, hV, av, u, Yb, ma, V, bd, by, et, ad, nV, fS); #c1(IQGAP2) c2(NP_001272390) c3(5561) c4(31675, 44732, 57789, 18618, 70846) c5(by, bu, bm, q, dA); #c1(IQGAP3) c2(NP_839943) c3(5562) c4(31676, 44733, 57790, 18619, 70847) c5(co, b); #c1(IQSEC1) c2(NP_001127854) c3(5563) c4(31677, 44734, 57791, 18620, 70848) c5(b, Be, bm, q, ag, ar, sF, ji, u, dh, y); #c1(IQSEC2) c2(NP_001104595) c3(5564) c4(31678, 44735, 57792, 18621, 70849) c5(cG, WW, nx, nz, nU, agp, bK, O); #c1(IQSEC3) c2(NP_001164209) c3(5565) c4(31679, 44736, 57793, 18622, 70850) c5(cO); #c1(IRAK1BP1) c2(NP_001010844) c3(5566) c4(31680, 44737, 57794, 18623, 70851) c5(gn); #c1(IRAK1) c2(NP_001020413) c3(5567) c4(31681, 44738, 57795, 18624, 70852) c5(dx, A, X, aF, Ou, bf, m, dv, bb, Ov, B, bu, gg, dh, fh, PJ, I, Ea, aC, Bs, du, j, by, P, T, cy, fx, av, aM, nV, fw, xe, ag, i, at); #c1(IRAK2) c2(NP_001561) c3(5568) c4(31682, 44739, 57796, 18625, 70853) c5(V, N, pF, P, bTf, pi, U); #c1(IRAK3) c2(NP_001135995) c3(5569) c4(31683, 44740, 57797, 18626, 70854) c5(eX, axx, aF, w, bTh, gE, O, cp, IE, cy, f, bTg, u, aC, aDM, bp, co, pi, jH, gs, gd, ji, aA); #c1(IRAK4) c2(NP_001138728) c3(5570) c4(31684, 44741, 57798, 18627, 70855) c5(dx, bTi, A, Al, TH, aF, OH, O, m, dv, cy, DM, B, ajJ, zQ, dh, fh, aNu, awD, ae, aC, du, gL, P, bNt, pi, nk, cT, Dl, fl, bTf); #c1(IREB2) c2(NP_004127) c3(5571) c4(31685, 44742, 57799, 18628, 70856) c5(yJ, yK, co, aP, b, xM, yO, q, Fc, ji, I, hi, o, pq); #c1(IRF1) c2(NP_002189) c3(5572) c4(31686, 44743, 57800, 18629, 70857) c5(dx, ml, aw, dN, aiW, dB, cO, e, M, dv, cy, t, mR, aD, dH, JI, aC, iv, fO, bp, Q, cq, jE, sS, fc, hD, i, pJ, ib, X, ig, aeD, ix, dV, JE, y, DM, f, bu, dZ, cs, av, fy, bm, iT, cj, ae, et, eX, iA, ma, JY, du, dP, py, jR, tl, T, iu, bX, b, eV, d, bb, re, q, jV, dQ, jG, u, da, qL, gL, ad, G, aHE, aZ, rO, hue, hX, rq, Ol, I, iL, gE, al, hP, sb, aX, h, cU, aEU, n, aCH, aV, aq, jZ, ax, qO, cV, be, J, bR, P, ti, Nx, Il, by, qe, nk, ci, DI, at); #c1(IRF2BP2) c2(NP_001070865) c3(5573) c4(31687, 44744, 57801, 18630, 70858) c5(apH, dh); #c1(IRF2BPL) c2(NP_078772) c3(5574) c4(31688, 44745, 57802, 18631, 70859) c5(aaz, asT, cV); #c1(IRF2) c2(NP_002190) c3(5575) c4(31689, 44746, 57803, 18632, 70860) c5(aw, b, X, bNI, mk, iL, gE, bw, al, y, Ei, cy, fq, h, ak, q, hN, ik, RF, cs, av, u, jZ, da, il, cV, J, ad, ti, II, bq, jG, aFC, aoC, jR, dh, ag, cT, fl, Oi, pJ); #c1(IRF3) c2(NP_001184052) c3(5576) c4(31690, 44747, 57804, 18633, 70861) c5(vg, en, ER, b, aiW, NH, Ku, II, gE, al, re, O, m, Ei, aX, apx, sS, dL, h, q, cy, Uw, hN, dQ, cs, FG, fy, iT, ae, em, sQ, nQ, aC, Dg, gL, gv, P, II, Oi, bb, ad, ajd, yG, jT, aeg, NG, fN, aAu, Rd, dY, bNI, Dl, pH, i, fl, I, bh, aA, DM, wT); #c1(IRF4) c2(NP_001182215) c3(5577) c4(31691, 44748, 57805, 18634, 70862) c5(acE, px, aw, b, TQ, ie, iX, pD, apY, ig, Iv, Ou, ajw, rS, U, Bz, ps, e, y, cy, d, fJ, jT, aX, Ov, apr, h, hg, yh, fP, bu, ND, jQ, jU, iv, aD, fH, jG, aV, u, dh, V, aeM, cV, jz, gm, fO, J, P, bTj, II, bb, by, apM, ac, yG, jH, dP, hX, DO, bTk, cT, CL, tl, Oi, yA, jl, Nu, ic); #c1(IRF5) c2(NP_001092097) c3(5578) c4(31692, 44749, 57806, 18635, 70863) c5(dx, ml, Kt, b, qd, qz, gn, mW, axA, vY, fl, bTn, bTm, y, bxm, fm, co, bb, ajn, DM, hV, cy, qL, jT, cs, gg, aV, u, gl, da, PJ, ax, bTI, im, Be, du, j, ei, adK, ad, Jc, II, cl, Pk, et, jG, dH, jH, yG, nV, hU, aAu, fc, pS, acA, aE, m, cT, Dl, fP, aC, iB, bq, at, eG, bT, rn); #c1(IRF6) c2(NP_001193625) c3(5579) c4(31693, 44750, 57807, 18636, 70864) c5(KC, aw, kE, Gm, bvY, e, y, d, atj, Vx, brX, XG, btJ, u, bjD, tz, AD, aPe, amR, AP, bTp, bTo, Nq, Ns, amS, bpz, fl, Oi, apU); #c1(IRF7) c2(NP_001563) c3(5580) c4(31694, 44751, 57808, 18637, 70865) c5(en, b, k, X, Pv, aiW, mW, NH, gE, bf, al, eV, y, d, m, co, f, e, bu, hN, O, pH, u, gl, g, gL, by, P, Ei, II, jT, ajd, aeq, bdW, NG, Oa, aE, j, bh); #c1(IRF8) c2(NP_002154) c3(5581) c4(31695, 44752, 57809, 18638, 70866) c5(bL, fl, b, mZ, fr, aFe, bTr, U, bj, al, y, m, jl, jT, bTq, pp, bvl, h, f, N, jV, bu, M, aC, dZ, cs, pB, jG, aV, u, jZ, dA, Ib, fO, J, j, ft, T, II, aX, by, jH, oj, hX, ie, aE, fc, cT, fg, aRK, Oi, apM, at, bT, iE, dV); #c1(IRF9) c2(NP_006075) c3(5582) c4(31696, 44753, 57810, 18639, 70867) c5(en, ER, b, jz, dB, aWc, aDg, w, gE, al, A, y, jQ, Ei, aX, DM, B, q, jV, hN, O, cs, aV, u, jZ, bm, Ib, ad, P, II, cy, iR, Dj, Dl, zO, re); #c1(IRG1) c2(NP_001245335) c3(5583) c4(31697, 44754, 57811, 18640, 70868) c5(dx, A, b, eR, eH, vY, id, di, C, bW, U, y, dv, bb, q, jV, tE, aah, akk, u, V, I, sj, xf, du, cM, P, bp, ZF, nV, dS, aY, vK, ZL, fz, dc, bq, at, ap); #c1(IRGM) c2(NP_001139277) c3(5584) c4(31698, 44755, 57812, 18641, 70869) c5(dx, jH, dv, rY, pp, b, aMH, bTs, du, acg, Wh, aC, fP, O, Ny, bf, aw, Xe, iU, yd, aCV); #c1(IRS1) c2(NP_005535) c3(5585) c4(31699, 44756, 57813, 18642, 70870) c5(dx, B, aw, dN, aoJ, eH, bf, cp, dv, iy, Kg, om, cl, mz, sH, du, fO, ft, x, cq, fN, tO, ag, i, aA, id, Al, X, EB, jj, bw, U, xw, y, co, pw, f, cc, cs, av, fy, bm, em, V, ze, cx, Fy, bQ, eX, iA, nc, jR, ap, An, b, aF, oi, z, ey, fD, q, bTt, ar, u, aE, o, kF, I, ad, ch, mA, I, anE, A, aiF, fr, di, C, gE, oy, qs, aX, HI, Dt, vF, W, T, gF, aM, Oi, at); #c1(IRS2) c2(NP_003740) c3(5586) c4(31700, 44757, 57814, 18643, 70871) c5(dx, A, d, b, X, rd, w, di, jR, z, bf, U, ey, y, gO, oy, bQ, cy, si, dL, f, e, q, bu, ar, B, cs, bw, fv, av, cp, u, aE, o, n, cj, mz, bm, kF, V, I, dA, du, cx, fO, gm, gF, ad, dv, eX, x, pw, cg, vF, et, aM, rQ, iK, ch, YA, cf, mA, Eo, ag, et, fP, i, iA, Oi, aA, at, eG, ci, bTu); #c1(IRS4) c2(NP_003595) c3(5587) c4(31701, 44758, 57815, 18644, 70872) c5(d, Dp, aX, I, b, f, q, gL, vF, G, aJB, z, bw, bf, e, o, aM); #c1(IRX1) c2(NP_077313) c3(5588) c4(31702, 44759, 57816, 18645, 70873) c5(oy, d, wV, hW, bt, cV, Bu, F, bu, wP, sf, aZ, bq, by, e); #c1(IRX2) c2(NP_150366) c3(5589) c4(31703, 44760, 57817, 18646, 70874) c5(Bu, iD, aZ); #c1(IRX3) c2(NP_077312) c3(5590) c4(31704, 44761, 57818, 18647, 70875) c5(aA, qf, bb, I, aZ); #c1(IRX4) c2(NP_057442) c3(5591) c4(31705, 44762, 57819, 18648, 70876) c5(oy, A, sK, acw, B, aO, cK, bw, at, rb, o, ap); #c1(IRX5) c2(NP_001239126) c3(5592) c4(31706, 44763, 57820, 18649, 70877) c5(KC, cr, A, bTw, aZ, b, cV, bjG, B, ad, na, aal, di, aNC, cs, Bu, Uf, AP, bTv, bjD); #c1(ISCU) c2(NP_055116) c3(5593) c4(31707, 44764, 57821, 18650, 70878) c5(aNN, kU, SS, bTx, oB, f, gm, ig, sL, T, TA, oD, jT, aPL); #c1(ISG20) c2(NP_001290163) c3(5594) c4(31708, 44765, 57822, 18651, 70879) c5(hg, JH, Io, Ot, sE, iU, Ip, sJ, w, hM, cO, bf, oU, O, cy, aEU, Pn, eE, mR, aD, gl, n, baH, Ad, aC, bK, gJ, gm, fO, dB, fy, PZ, jT, av, dH, xO, Lz, sS, fc, bRg, DO, bY, rS, cT, pH, fD, bT, aEN, bP, zr, kN, X, jz, Kc, ig, fU, NH, bW, bkc, vl, ER, yV, yt, co, BL, yX, Dq, ak, zh, Em, B, iv, gg, CX, rN, ae, byO, cd, bxn, bxl, bt, qX, gC, qH, JY, dP, P, ne, bH, tl, abs, xS, iu, eL, WH, bxj, b, LX, qz, bhr, oi, oR, cK, jy, Kt, bX, Tp, q, CO, zm, fv, ff, Tr, jG, u, aE, da, I, atU, j, aZ, jU, jH, Bm, zD, azt, A, adK, mW, cA, Iv, iL, xe, aW, jQ, m, aX, kn, fq, h, F, Ir, Vr, y, aV, aq, jZ, Yb, ax, be, J, bR, jo, T, II, aFt, pw, aM, NG, MP, auZ, fP, iB, XO, rr); #c1(ISL1) c2(NP_002193) c3(5595) c4(31709, 44766, 57823, 18652, 70880) c5(mD, at, aw, bq, I, cV, acw, cr, xj, os, rd, dZ, dV, cO, bf, aA, pg, u, zb, y, aM); #c1(ISM1) c2(NP_543016) c3(5596) c4(31710, 44767, 57824, 18653, 70881) c5(bq, by, bj, b, bu); #c1(ISM2) c2(NP_872315) c3(5597) c4(31711, 44768, 57825, 18654, 70882) c5(cK, T, xj); #c1(ISPD) c2(NP_001094896) c3(5598) c4(31712, 44769, 57826, 18655, 70883) c5(kG, bTy, wp, vt, oD, UR, Et); #c1(IST1) c2(NP_001257904) c3(5599) c4(31713, 44770, 57827, 18656, 70884) c5(d, jh, co, il, bp, BV, BY, ik, u, e, y); #c1(ISX) c2(NP_001290437) c3(5600) c4(31714, 44771, 57828, 18657, 70885) c5(ix, bm, g); #c1(ISYNA1) c2(NP_001164409) c3(5601) c4(31715, 44772, 57829, 18658, 70886) c5(bL, IJ, pV, pF, b, X, aF, z, eu, ig, di, Iv, cO, bf, U, bu, eV, y, qs, aX, ae, ml, f, F, zx, aaZ, dQ, ff, qB, ar, av, JY, u, da, kF, V, I, aC, cs, J, ad, jo, II, gn, cy, by, ajd, aM, aDA, jH, gE, eW, Ki, sS, fw, cT, bk, at, DM, rb); #c1(ITCH) c2(NP_001244066) c3(5602) c4(31716, 44773, 57830, 18659, 70887) c5(nV, fc, fq, hV, bTz, aC, og, w, fl, aud, aA, aV, wz); #c1(ITFG1) c2(NP_001291931) c3(5603) c4(31717, 44774, 57831, 18660, 70888) c5(fl); #c1(ITFG3) c2(NP_114428) c3(5604) c4(31718, 44775, 57832, 18661, 70889) c5(awK); #c1(ITGA10) c2(NP_001289969) c3(5605) c4(31719, 44776, 57833, 18662, 70890) c5(sE, aX); #c1(ITGA11) c2(NP_001004439) c3(5606) c4(31720, 44777, 57834, 18663, 70891) c5(d, fy, bX, bR, ji, at, e, Fg); #c1(ITGA1) c2(NP_852478) c3(5607) c4(31721, 44778, 57835, 18664, 70892) c5(l, aC, f, bTA, xe, x, zb, z, aCQ, bw, aV, jU, cp); #c1(ITGA2B) c2(NP_000410) c3(5608) c4(31722, 44779, 57836, 18665, 70893) c5(dx, jK, Em, eM, dj, bEH, cA, w, di, Ra, akk, wf, O, oU, y, m, Ei, aX, fm, jP, L, ak, N, bEK, n, dl, aC, aim, kk, bTB, iv, kX, tw, u, dh, o, fh, aO, ma, wi, cV, cJ, sj, sH, du, Fs, J, dB, qt, dv, wA, bb, pF, bTC, arQ, eN, gs, dS, pP, lc, vK, fD, bq, at, LQ, pv); #c1(ITGA2) c2(NP_002194) c3(5609) c4(31723, 44780, 57837, 18666, 70894) c5(dx, bL, id, aw, b, qd, dv, aWm, A, di, bLr, du, wf, bw, U, bgU, aO, m, co, aX, fm, adl, f, bEK, zx, dl, ar, y, Nf, jG, Hs, u, aE, o, fh, sF, Tl, qC, tw, wi, V, I, cV, fs, sX, sH, LR, bp, j, qt, Ei, T, fl, x, bb, be, ao, hU, dS, ql, lc, jR, B, ix, vK, fD, bq, qD, at, eG, cl, ap); #c1(ITGA3) c2(NP_002195) c3(5610) c4(31724, 44781, 57838, 18667, 70895) c5(GK, Pv, mk, w, kY, e, O, d, ip, jd, q, bu, ik, aF, ar, u, wB, BR, cs, bd, ad, GB, bTD, T, aZ, x, by, wd, hU, ch, Ya, GM, cT, i, bq, at); #c1(ITGA4) c2(NP_000876) c3(5611) c4(31725, 44782, 57839, 18668, 70896) c5(mZ, fl, X, sE, ig, Ou, wf, vp, e, y, d, aX, bvN, aEa, h, f, fr, ar, av, aV, u, LK, Ov, qL, J, Qz, cz, W, P, T, fO, x, cy, jT, jG, aZE, gd, cT, aC, MO); #c1(ITGA5) c2(NP_002196) c3(5612) c4(31726, 44783, 57840, 18669, 70897) c5(g, A, b, X, dB, aZE, w, iL, U, Na, y, d, BO, co, aX, ag, B, e, q, vQ, bu, mL, O, cs, Tr, av, fy, u, yJ, ma, fs, V, c, adh, fO, gL, ad, T, j, x, by, Tv, Eu, hX, iR, Jh, os, gd, qP, bp, eG, bT, Dg); #c1(ITGAG) c2(NP_000201) c3(5613) c4(31727, 44784, 57841, 18670, 70898) c5(dx, A, aw, kY, b, X, bdX, mk, w, XW, z, bw, y, c, co, bb, arT, XZ, h, fr, ar, O, Zv, u, jh, du, J, gL, cz, T, XT, aX, ft); #c1(ITGA7) c2(NP_001138468) c3(5614) c4(31728, 44785, 57842, 18671, 70899) c5(A, dv, At, x, w, iK, cK, bTE, oD, bm, xl); #c1(ITGA8) c2(NP_001278423) c3(5615) c4(31729, 44786, 57843, 18672, 70900) c5(aX, X, bj, fO, bu, T, btv, sx); #c1(ITGA9) c2(NP_002198) c3(5616) c4(31730, 44787, 57844, 18673, 70901) c5(jR, co, b, di, ak, F, bp, ns, Ce, nm, nt, nq, nr, nn, T, no, np, u, pR); #c1(ITGAD) c2(NP_005344) c3(5617) c4(31731, 44788, 57845, 18674, 70902) c5(aA, aKK); #c1(ITGAE) c2(NP_002199) c3(5618) c4(31732, 44789, 57846, 18675, 70903) c5(en, b, sJ, bb, Ou, aX, dQ, nj, fh, g, Ov, bp, P, II, aZ, cl, aAr, sN, cT, CL, bq, at, iu, ap); #c1(ITGAL) c2(NP_001107852) c3(5619) c4(31733, 44790, 57847, 18676, 70904) c5(px, b, dD, jz, mW, tN, ix, ayY, Iv, gE, vp, ajf, bj, jD, y, jQ, arR, m, aX, pp, eA, h, f, jV, cy, M, aC, asA, cM, pB, aye, aV, u, gl, TP, da, bfS, be, fz, ae, beW, ir, awD, fO, J, j, P, fl, pD, bb, jT, pi, jH, qt, aZg, sS, aY, aq, fw, uH, cT, fP, i, dc, I, jl, bT, gX); #c1(ITGAM) c2(NP_000623) c3(5620) c4(31734, 44791, 57848, 18677, 70905) c5(dx, f, dN, sE, bf, aK, e, dv, cy, kJ, AX, yh, aD, gl, TP, IU, aC, du, aCP, jT, aZg, sS, cT, i, bq, id, eu, vp, U, y, arR, co, ps, ak, B, fy, V, Ov, pi, vH, gR, Im, iu, TA, pv, bn, b, aF, fl, hr, d, eA, jV, dQ, jG, u, aE, o, da, PJ, I, ir, Ou, j, G, et, jU, pe, uH, CL, fl, I, A, MZ, mW, qX, vl, aW, m, aX, Qm, kn, fq, h, M, aV, cV, hZ, be, J, P, II, zS, HK, aM, aGc, ii, lc, gj, at, gf); #c1(ITGAV) c2(NP_001138471) c3(5621) c4(31735, 44792, 57849, 18678, 70906) c5(dx, id, b, adL, X, EB, arQ, O, kB, w, di, iL, z, GV, U, A, e, y, cp, oy, BO, co, aX, ag, B, q, vQ, fr, pC, ar, rR, Dg, Tr, av, fy, u, dh, aat, g, d, V, aeM, cV, aC, adh, du, j, cz, W, dv, T, fO, bb, by, Tv, bdW, py, Jh, os, jZ, gd, qP, o, fz, eG, bT); #c1(ITGAX) c2(NP_000878) c3(5622) c4(31736, 44793, 57850, 18679, 70907) c5(dx, WH, fl, b, asx, sE, jz, dv, bf, kF, aK, aDt, O, jQ, d, m, co, aX, aoR, gd, AX, eX, iw, jV, e, aV, u, aE, o, jH, da, mz, fe, baE, dA, aC, du, J, fO, P, bQ, T, II, cy, aM, aL, if, dP, fc, eA, DM, h, adh, cT, zO, aA, cK, aaA, zD); #c1(ITGB1BP1) c2(NP_004754) c3(5623) c4(31737, 44794, 57851, 18680, 70908) c5(AP); #c1(ITGB1) c2(NP_391988) c3(5624) c4(31738, 44795, 57852, 18681, 70909) c5(dx, QU, fr, A, aw, jT, b, fO, X, aF, i, O, w, wh, JC, cO, bf, U, jR, e, y, d, m, co, aX, kJ, wd, h, B, F, q, bu, dl, nL, mR, oJ, bw, ar, av, fy, u, eG, o, fh, yJ, bm, V, BR, aC, du, dB, J, bp, ft, G, T, II, x, bb, iA, by, et, mm, aM, pk, hU, aY, ch, Ck, cK, ag, cT, iu, tl, Yb, bq, at, vt, afd); #c1(ITGB2) c2(NP_000202) c3(5625) c4(31739, 44796, 57853, 18682, 70910) c5(dx, eX, aw, dN, dD, sE, aE, w, JH, fR, ajf, eD, O, aHr, dv, cy, yh, eE, do, asA, TP, bfU, mm, aC, jD, du, fO, jT, zQ, qt, aZg, ag, cT, fD, dc, vJ, aA, id, arQ, ahS, eu, mk, ix, vp, bw, U, cM, arR, px, pp, DM, f, bu, NB, bfS, Bd, V, ae, beW, eq, pi, dt, aY, byf, iu, ap, bn, b, bL, aF, tN, fl, aYA, dl, bb, nU, ahd, jV, jG, u, dh, fh, da, I, im, jz, awD, gL, by, BZ, CM, jH, aCx, pe, aos, uH, gd, fl, I, y, zD, KG, bf, qd, adK, pD, Iv, wf, bj, aW, vd, aX, h, M, jQ, eh, aV, aq, ma, be, J, W, P, II, bTF, jl, aM, aGc, nk, lc, Dl, j, gf, gl); #c1(ITGB3)

c2(NP_000203) c3(5626) c4(31740, 44797, 57854, 18683, 70911) c5(dx, sA, eH, bLr, e, O, dv, cy, aDx, dl, ix, bTI, kX, uL, fu, wc, aC, sH, du, bp, bta, BW, qt, hR, hj, gE, gs, dS, fc, wi, nG, tO, vK, fz, bq, aA, id, td, He, arQ, eu, ve, kB, xK, sF, Ra, U, y, co, fm, un, Wn, Em, bv, av, fy, pP, V, zA, qC, Ng, bTG, aR, wA, qD, dP, vZ, aGZ, fD, ci, ap, bTJ, ach, b, eR, vY, tG, pi, aO, d, bb, Wk, vj, bEK, fJ, X, mL, ar, ff, tg, wM, jG, u, fh, PJ, tw, kF, bTB, I, sX, be, j, cz, fH, et, yG, ao, rQ, hU, aaN, ch, na, Ns, vP, di, Jh, bL, A, Tl, fr, eO, gN, pv, bpE, eM, aW, oy, m, aX, sG, adl, n, tK, Yb, ma, hW, sj, xf, J, P, Ei, T, fO, jl, ac, nk, Kj, ql, lc, aGB, bqh, fP, Af, bTH, atR, XO, at, eG, gl); #c1(ITGB4) c2(NP_000204) c3(5627) c4(31741, 44798, 57855, 18684, 70912) c5(dx, Dr, A, XT, b, k, mk, w, arW, e, y, d, jh, dv, arT, XZ, aRL, gz, bTK, ar, n, aD, u, Yb, du, J, bp, dt, Q, iD, x, nV, Ya, cT, T, rb, ap); #c1(ITGB5) c2(NP_002204) c3(5628) c4(31742, 44799, 57856, 18685, 70913) c5(dx, iq, YA, du, bu, P, pC, T, I, by, u, y); #c1(ITGB6) c2(NP_000879) c3(5629) c4(31743, 44800, 57857, 18686, 70914) c5(oy, gK, bb, I, aJc, asE, vB, O, aCE, fh, z, x, al, Ur, u, e, y, d); #c1(ITGB7) c2(NP_000880) c3(5630) c4(31744, 44801, 57858, 18687, 70915) c5(cy, NG, jz, fP, P, NH, Iv, HK, pH, jT, jQ); #c1(ITGB8) c2(NP_002205) c3(5631) c4(31745, 44802, 57859, 18688, 70916) c5(fy, LR, eG, j, iD); #c1(ITGBL1) c2(NP_001258683) c3(5632) c4(31746, 44803, 57860, 18689, 70917) c5(ac); #c1(ITIH1) c2(NP_002206) c3(5633) c4(31747, 44804, 57861, 18690, 70918) c5(co, b, bm, ak, T, cA, u); #c1(ITIH2) c2(NP_002207) c3(5634) c4(31748, 44805, 57862, 18691, 70919) c5(X, u, y); #c1(ITIH3) c2(NP_002208) c3(5635) c4(31749, 44806, 57863, 18692, 70920) c5(hW, ak, q, he, T, bq, cM); #c1(ITIH4) c2(NP_001159921) c3(5636) c4(31750, 44807, 57864, 18693, 70921) c5(ak, aCO, kE, zu, k, PA, dD, dE, Ku, Eg, ER, jD, y, f, CR, aoQ, u, beW, hZ, ht, J, asM, Fo, II, cV, pi, P, aeq, hT, Oa, aoN, IN, zO, fl); #c1(ITIH5) c2(NP_001001851) c3(5637) c4(31751, 44808, 57865, 18694, 70922) c5(nV, aw, Be, qC, qL, T, i, bq, aA, u, fx, y); #c1(ITK) c2(NP_005537) c3(5638) c4(31752, 44809, 57866, 18695, 70923) c5(hV, aw, b, X, QB, dB, oH, aDg, sJ, A, os, kY, O, bw, U, adr, y, cU, co, aX, pp, kJ, oB, f, q, bu, HY, Mr, ar, B, cs, qu, av, Hs, u, pS, V, dA, Be, LR, nu, rV, ad, bTL, P, nV, asO, ji, x, cy, fx, by, cW, fy, jT, aoC, bTM, bm, sS, jh, nJ, ag, oi, fl, i, T, zD); #c1(ITLN1) c2(NP_060095) c3(5639) c4(31753, 44810, 57867, 18696, 70924) c5(iP, kF, b, I, f, fP, bu, T, bf, aA, by, cy); #c1(ITLN2) c2(XP_011507512) c3(5640) c4(31754, 44811, 57868, 18697, 70925) c5(bf, I); #c1(ITM2A) c2(NP_001165052) c3(5641) c4(31755, 44812, 57869, 18698, 70926) c5(iu, ac); #c1(ITM2B) c2(NP_068839) c3(5642) c4(31756, 44813, 57870, 18699, 70927) c5(aL, o, A, tX, u, ml, v, dZ, aN, oH, cl, aax, mL, di, dV, acX, aya, aT, nR, aK, y); #c1(ITM2C) c2(NP_001012532) c3(5643) c4(31757, 44814, 57871, 18700, 70928) c5(bb, bTN, o); #c1(ITPA) c2(NP_001254552) c3(5644) c4(31758, 44815, 57872, 18701, 70929) c5(gE, al, gM, m, Ei, ni, t, rr, aC, hN, bTO, jH, ir, gv, G, aU, gY, pq, iw, P, dY, fP, afK, bh); #c1(ITPK1) c2(NP_001136065) c3(5645) c4(31759, 44816, 57873, 18702, 70930) c5(bb, IJ, et); #c1(ITPKA) c2(NP_002211) c3(5646) c4(31760, 44817, 57874, 18703, 70931) c5(d, e, b); #c1(ITPKC) c2(XP_006723467) c3(5647) c4(31761, 44818, 57875, 18704, 70932) c5(cW, bL, re, ox, Io, bTP, iT); #c1(ITPR1) c2(NP_001093422) c3(5648) c4(31762, 44819, 57876, 18705, 70933) c5(vl, f, gn, A, cO, kV, xl, c, cy, ak, dl, B, fH, EX, ma, si, cV, v, n/v, fx, kS, fJ, bmt, i, bTR, bTQ); #c1(ITPR2) c2(NP_002214) c3(5649) c4(31763, 44820, 57877, 18706, 70934) c5(oy, ao, cV, aC, bmt, ak, dB, Vr, i, fx); #c1(ITPR3) c2(NP_002215) c3(5650) c4(31764, 44821, 57878, 18707, 70935) c5(c, ak, si, ez, cV, aC, iu, f, bu, m, aE, i, cO, aA, kV, fx, xl); #c1(ITSN1) c2(NP_001001132) c3(5651) c4(31765, 44822, 57879, 18708, 70936) c5(O, aq, o, b, cV); #c1(ITSN2) c2(NP_006268) c3(5652) c4(31766, 44823, 57880, 18709, 70937) c5(bj, gn); #c1(IVD) c2(NP_001152980) c3(5653) c4(31767, 44824, 57881, 18710, 70938) c5(P, bb, auC); #c1(IVL) c2(XP_006711363) c3(5654) c4(31768, 44825, 57882, 18711, 70939) c5(d, bTS, akQ, JH, Kx, b, fq, re, F, aBd, il, KL, da, P, ik, ic, tl, Xx, NB, e); #c1(IVNS1ABP) c2(NP_006460) c3(5655) c4(31769, 44826, 57883, 18712, 70940) c5(en, gE, b, aGV, aiW, A, z, bf, rY, RD, AX, dQ, atT, be, I, aC, NZ, fC, II, aM, UE, aA, DM, vL, bps); #c1(IYD) c2(NP_001158166) c3(5656) c4(31770, 44827, 57884, 18713, 70941) c5(nV, bb, VD, aQF, iu, hV, ra, hM, wX, bTT, bzf); #c1(IZUMO1) c2(XP_005258850) c3(5657) c4(31771, 44828, 57885, 18714, 70942) c5(NT, bTU, am); #c1(JADE1) c2(NP_001274366) c3(5658) c4(31772, 44829, 57886, 18715, 70943) c5(hh, dB, jo, ew, ff, VP, et); #c1(JADE2) c2(NP_001276914) c3(5659) c4(31773, 44830, 57887, 18716, 70944) c5(aA, cO); #c1(JAG1) c2(NP_000205) c3(5660) c4(31774, 44831, 57888, 18717, 70945) c5(aw, sd, ads, w, bf, O, aek, gB, dl, mg, aLt, fe, lb, fO, bp, jT, FG, JD, ag, cT, EO, beO, Al, X, bTW, jj, Ni, iG, bw, U, y, co, B, mx, bu, av, cp, V, gv, bt, Qt, bTX, JY, beQ, T, b, z, blU, BQ, jd, q, jV, AK, bTV, ar, u, o, LR, acv, by, CM, Mw, et, yG, atb, hd, A, iL, pR, acH, JC, gE, hP, cr, anR, h, F, M, aC, n, aV, HI, bmK, cV, akd, J, dt, bgg, II, aX, aM, bLu, zM, aal, bh, at, rb, rZ); #c1(JAG2) c2(NP_002217) c3(5661) c4(31775, 44832, 57889, 18718, 70946) c5(b, wy, Ak, w, BQ, y, d, bb, or, e, QE, od, u, J, fO, W, sf, T, aPe, jC, AP, wV, anG, Nq, wP, Ns, fl, ji, apU); #c1(JAGN1) c2(NP_115881) c3(5662) c4(31776, 44833, 57890, 18719, 70947) c5(ael, hN); #c1(JAK2) c2(NP_004963) c3(5663) c4(31777, 44834, 57891, 18720, 70948) c5(dx, by, B, aw, zh, EM, dB, w, ps, e, O, dv, cy, kT, t, DB, sZ, jK, tE, kX, g, JI, jH, du, fO, gm, tz, bkZ, od, cV, x, hR, mm, pq, of, oQ, ie, bpM, hX, cT, pH, bTY, afK, pt, aA, cY, aiE, eu, mk, ix, NH, pK, IW, JE, bw, U, y, co, RD, pp, pz, DM, f, N, cs, bu, bpV, iv, fg, av, fy, iT, afc, V, FK, hf, Bs, bTZ, IR, aR, pJ, bt, tj, bUd, fJ, aqf, kU, fG, gA, bUb, aqn, ej, ci, pv, b, aKO, jg, NI, oR, z, re, HQ, d, dl, bb, aBP, jd, vj, k, g, X, pn, Tr, jG, u, dh, o, wY, da, I, be, ad, IX, G, fH, iw, rm, VQ, pe, aE, IS, vZ, bL, A, pF, vd, bUa, ds, Iv, nl, eh, aX, h, F, M, hN, n, aV, aq, jZ, fU, oS, xf, J, Ei, T, bUc, oM, gF, Pk, pc, jT, nk, NG, Vh, Dl, fP, at, adl); #c1(JAK3) c2(XP_005259953) c3(5664) c4(31778, 44835, 57892, 18721, 70949) c5(azR, jK, fl, anY, b, bAI, wd, jz, eu, pz, eC, Iv, ps, y, jQ, jT, aGE, pp, Dk, kn, t, h, f, N, cy, M, n, iv, zQ, u, iT, jS, nl, cs, J, fO, ad, G, T, CF, aX, by, pi, jG, jU, aq, De, DO, PY, jd, cT, fP, i, Dc, I, pJ, aGF, re, ap); #c1(JAKMIP1) c2(NP_001092903) c3(5665) c4(31779, 44836, 57893, 18722, 70950) c5(oy, cz); #c1(JAKMIP2) c2(NP_001257863) c3(5666) c4(31780, 44837, 57894, 18723, 70951) c5(od, ig, aX, b, jh); #c1(JAKMIP3) c2(XP_011537986) c3(5667) c4(31781, 44838, 57895, 18724, 70952) c5(bb); #c1(JAM2) c2(NP_001257336) c3(5668) c4(31782, 44839, 57896, 18725, 70953) c5(oy, O); #c1(JAM3) c2(NP_001192258) c3(5669) c4(31783, 44840, 57897, 18726, 70954) c5(dx, tp, du, bUe, aw, acL, X, ak, gm, MO, gd, O, aC, aX, av, fy, be, gl); #c1(JARID2) c2(NP_001253969) c3(5670) c4(31784, 44841, 57898, 18727, 70955) c5(IJ, f, S, b, sO, Wk, nU, ix, lv, cV, cO, cr, rQ, pz, cl); #c1(JAZF1) c2(NP_778231) c3(5671) c4(31785, 44842, 57899, 18728, 70956) c5(A, b, X, Tw, bf, U, oy, m, Qu, B, cU, cs, av, aE, Fg, V, I, j, ad, P, iA, aM, aEt, aA); #c1(JDP2) c2(XP_005267389) c3(5672) c4(31786, 44843, 57900, 18729, 70957) c5(aC, h, J, q, ag, sF, jT); #c1

(JMJD1C) c2(NP_001269877) c3(5673) c4(31787, 44844, 57901, 18730, 70958) c5(by, b, t, eX, aeU, J, bu, G, rb, fN, cz, u, bqW, y); #c1(JMJDG) c2(NP_001074930) c3(5674) c4(31788, 44845, 57902, 18731, 70959) c5(g, aem, b, da, ar, qX, cs, ji, vl, u, y, bk); #c1(JMY) c2(NP_689618) c3(5675) c4(31789, 44846, 57903, 18732, 70960) c5(f, u, nl); #c1 (JPH2) c2(NP_787109) c3(5676) c4(31790, 44847, 57904, 18733, 70961) c5(cK, hR, bUf, sK); #c1(JPH3) c2(NP_001258533) c3(5677) c4(31791, 44848, 57905, 18734, 70962) c5(dx, ajQ, eR, AA, di, PE, kV, dv, ZZ, aag, si, I, el, du, v, Fy, bUg, bb, gF, et, ao, aaz, xM, zp, bq, aA, at, bT); #c1(JPH4) c2(NP_115828) c3(5678) c4(31792, 44849, 57906, 18735, 70963) c5(Yr); #c1(JRK) c2(NP_001070995) c3(5679) c4(31793, 44850, 57907, 18736, 70964) c5(hY, Hp, Id, hS, iZ, jr); #c1(JSRP1) c2(NP_653217) c3(5680) c4(31794, 44851, 57908, 18737, 70965) c5(AA, iu, kF, Jm); #c1(JTB) c2(NP_006685) c3(5681) c4(31795, 44852, 57909, 18738, 70966) c5(A, aw, b, mW, iL, sx, y, m, aX, dN, B, q, hb, cs, u, dh, aC, NZ, T, Pk, lc, SJ, gl, cT); #c1(JUNB) c2(NP_002220) c3(5682) c4(31796, 44853, 57910, 18739, 70967) c5(B, iq, bx, w, bW, e, O, cy, t, fH, xc, aC, pF, gm, bp, fx, jT, su, qt, ag, bk, i, aA, anY, X, Hk, jz, kB, Ku, IW, U, y, co, uj, f, N, bu, cs, av, fy, bm, iT, V, Dp, bt, fJ, fw, ji, ap, b, aF, Of, dk, ey, d, re, hV, q, sR, ff, jG, u, o, da, fs, j, ad, G, rw, aZ, nV, hU, gd, fg, yA, hd, bL, A, sO, di, C, jQ, m, aX, fq, F, cU, ui, be, P, T, II, nP, by, lc, Yv, at); #c1(JUND) c2(NP_005345) c3(5683) c4(31797, 44854, 57911, 18740, 70968) c5(B, iq, bx, w, dd, bW, e, O, cy, t, xc, aC, fx, jT, su, qt, ag, bk, i, aA, anY, X, Hk, jz, Ku, IW, U, y, co, uj, f, bu, cs, av, fy, bm, iT, V, Dp, bt, PY, fw, ji, ap, b, aF, Of, dk, ey, d, re, hV, q, ff, u, o, da, fs, j, ad, G, rw, aZ, nV, hU, gd, yA, hd, bL, A, sO, di, lv, jQ, m, aX, fq, h, F, ui, be, J, P, T, II, nP, by, lc, Yv, bh); #c1(JUP) c2(XP_006721941) c3(5684) c4(31798, 44855, 57912, 18741, 70969) c5(dx, A, aw, dB, z, U, e, y, d, dv, alK, bUh, u, aEq, V, du, xj, bnH, T, cK, iA, biA, nV, QG, i, at); #c1(KAL1) c2(NP_000207) c3(5685) c4(31799, 44856, 57913, 18742, 70970) c5(mZ, nU, aiF, b, X, bUj, aVX, yD, w, dn, avX, btm, pp, fq, B, q, Jf, cs, sV, av, bUi, g, hW, agc, nx, US, fO, ad, UT, yG, UH, tW, bUk, aMp, btv, aA); #c1(KALRN) c2(NP_001019831) c3(5686) c4(31800, 44857, 57914, 18743, 70971) c5(bL, A, b, X, tC, di, U, e, y, d, co, aX, cV, q, bu, O, av, u, o, fh, si, V, dA, J, by, P, T, bb, st, DO, Eo, Ez, at, eG); #c1(KANK1) c2(NP_001243806) c3(5687) c4(31801, 44858, 57915, 18744, 70972) c5(axq, b, pF, bUI, dB, jo, ff, kX, cy, aV, u, pi, y); #c1(KANK2) c2(NP_001129663) c3(5688) c4(31802, 44859, 57916, 18745, 70973) c5(dB, by, ag, jo, y, cK, bu, u, O); #c1 (KANK4) c2(NP_001307198) c3(5689) c4(31803, 44860, 57917, 18746, 70974) c5(aC, nl); #c1(KANSL1) c2(XP_005275701) c3(5690) c4(31804, 44861, 57918, 18747, 70975) c5(bUn, hT, aYo, bj, nU, bUm, mg, AP, rb); #c1(KANSL3) c2(NP_001108488) c3(5691) c4(31805, 44862, 57919, 18748, 70976) c5(nQ); #c1(KARS) c2(NP_001123561) c3(5692) c4(31806, 44863, 57920, 18749, 70977) c5(bUg, en, kW, cG, Pv, Y, bUp, eo, P, aPY, ac, bUo); #c1(KAT2A) c2(NP_066564) c3(5693) c4(31807, 44864, 57921, 18750, 70978) c5(em, alz, b, t, h, v, pa, G, si, bUr, u, bu, y); #c1(KAT2B) c2(NP_003875) c3(5694) c4(31808, 44865, 57922, 18751, 70979) c5(alz, b, X, KN, w, si, lv, bf, bUr, y, jh, cy, t, g, bu, Kz, cl, cs, aM, u, aE, em, m, v, ad, jm, G, by, JY, jR, pa, at); #c1(KAT5) c2(NP_001193762) c3(5695) c4(31809, 44866, 57923, 18752, 70980) c5(dx, f, b, cY, aF, jz, dv, A, U, Kx, pA, co, aX, h, hV, q, NJ, jQ, B, cs, pB, gg, aV, bm, dh, o, em, og, V, lb, bK, du, v, J, aD, P, ti, T, pt, fy, cy, fx, ad, pi, nV, fw, xe, auC, i, aC, oM, aA, bUs); #c1(KAT6A)

c2(NP_006757) c3(5696) c4(31810, 44867, 57924, 18753, 70981) c5(wh, gt, b, t, hx, jL, J, K, G, jR, iv, aVL, h, rb); #c1(KAT6B) c2(NP_001243397) c3(5697) c4(31811, 44868, 57925, 18754, 70982) c5(aIS, oC, zi, b, h, J, bUt, bUv, bUu, wh, ap); #c1(KAT7) c2(NP_001186084) c3(5698) c4(31812, 44869, 57926, 18755, 70983) c5(u, y, b); #c1(KAT8) c2(NP_115564) c3(5699) c4(31813, 44870, 57927, 18756, 70984) c5(RG, co, aF, dB, jR, bu, ff, fy, U, by, y); #c1(KATNA1) c2(NP_001191005) c3(5700) c4(31814, 44871, 57928, 18757, 70985) c5(u); #c1(KATNAL2) c2(XP_005258414) c3(5701) c4(31815, 44872, 57929, 18758, 70986) c5(beH, cz); #c1(KATNB1) c2(NP_005877) c3(5702) c4(31816, 44873, 57930, 18759, 70987) c5(qL, Dr, u, b); #c1(KAZALD1) c2(XP_005270251) c3(5703) c4(31817, 44874, 57931, 18760, 70988) c5(asg, oi, bjq); #c1(KAZN) c2(XP_011539377) c3(5704) c4(31818, 44875, 57932, 18761, 70989) c5(oy, at); #c1(KBTBD11) c2(NP_055682) c3(5705) c4(31819, 44876, 57933, 18762, 70990) c5(bj); #c1(KBTBD13) c2(NP_001094832) c3(5706) c4(31820, 44877, 57934, 18763, 70991) c5(AC, bUw); #c1(KBTBD8) c2(NP_115894) c3(5707) c4(31821, 44878, 57935, 18764, 70992) c5(bq); #c1(KCMF1) c2(NP_064507) c3(5708) c4(31822, 44879, 57936, 18765, 70993) c5(ag, by, b, bu); #c1(KCNA1) c2(NP_000208) c3(5709) c4(31823, 44880, 57937, 18766, 70994) c5(IK, b, akB, hS, GF, jR, kV, O, f, y, Nw, IL, u, aQw, bK, KU, aVY, akq, ays, ayu, xo, bUx); #c1(KCNA4) c2(NP_002224) c3(5710) c4(31824, 44881, 57938, 18767, 70995) c5(Fp, f, pw, b, le, cl, iB, dR, mO, sK); #c1(KCNA5) c2(NP_002225) c3(5711) c4(31825, 44882, 57939, 18768, 70996) c5(f, b, gu, bUy, uC, le, w, di, lW, bf, bu, A, y, Fp, Co, cy, B, gT, mL, k, O, lg, fH, sK, u, ez, sX, Fs, j, by, IR, IX, fy, jT, fJ, mO, aM, at, ch, xd, lS, bh, dR); #c1(KCNA6) c2(XP_011519257) c3(5712) c4(31826, 44883, 57940, 18769, 70997) c5(aQw); #c1(KCNA7) c2(NP_114092) c3(5713) c4(31827, 44884, 57941, 18770, 70998) c5(bUz, I); #c1(KCNAB1) c2(NP_003462) c3(5714) c4(31828, 44885, 57942, 18771, 70999) c5(hS, HN, nr); #c1(KCNAB2) c2(XP_011540622) c3(5715) c4(31829, 44886, 57943, 18772, 71000) c5(aY, blq, hS, cM, dc, cA, dl); #c1(KCNAB3) c2(NP_004723) c3(5716) c4(31830, 44887, 57944, 18773, 71001) c5(sG); #c1(KCNB1) c2(XP_011527101) c3(5717) c4(31831, 44888, 57945, 18774, 71002) c5(bb, l, Y, lC, f, wN, jR, cU, di, cO, iA, mO); #c1(KCNB2) c2(NP_004761) c3(5718) c4(31832, 44889, 57946, 18775, 71003) c5(vW); #c1 (KCNC1) c2(NP_001106212) c3(5719) c4(31833, 44890, 57947, 18776, 71004) c5(zk, zp); #c1(KCNC2) c2(NP_001247427) c3(5720) c4(31834, 44891, 57948, 18777, 71005) c5(b); #c1(KCNC3) c2(XP_006723266) c3(5721) c4(31835, 44892, 57949, 18778, 71006) c5(bK, nU, v, dt, kV, Kl, alZ, sL, kS, bUA); #c1(KCND2) c2(NP_036413) c3(5722) c4(31836, 44893, 57950, 18779, 71007) c5(ajW, cz, hS, iZ, di, KM, mO); #c1(KCNE1) c2(NP_001257334) c3(5723) c4(31837, 44894, 57951, 18780, 71008) c5(bzC, b, le, hS, cO, mL, io, atV, Fp, adx, f, ajW, iZ, aE, Fg, vR, Fx, l, sX, bUC, P, rw, bq, cK, hR, mO, Fz, bUB, dR, ap); #c1(KCNE2) c2(NP_751951) c3(5724) c4(31838, 44895, 57952, 18781, 71009) c5(bx, uC, bUE, bUF, hM, io, atV, Fp, ajW, bu, mL, mg, aes, le, l, sX, by, W, cK, mO, pg, at, ch, vW, MA, bq, bUD, dR); #c1(KCNE3) c2(NP_005463) c3(5725) c4(31839, 44896, 57953, 18782, 71010) c5(bUG, ayP, Fx, aPt, ayj, sX, uC, Iw, ayQ, blu, lZ, Wi, Ij, mO); #c1(KCNE4) c2(NP_542402) c3(5726) c4(31840, 44897, 57954, 18783, 71011) c5(oy, sX, ie, dA); #c1(KCNE5) c2(NP_036414) c3(5727) c4(31841, 44898, 57955, 18784, 71012) c5(mL, arL, ajW, mO, sX); #c1 (KCNG3) c2(NP_579875) c3(5728) c4(31842, 44899, 57956, 18785, 71013) c5(d, e, b); #c1(KCNG4) c2(NP_758857) c3(5729) c4(31843, 44900, 57957, 18786, 71014) c5(sG, d, e); #c1(KCNH1) c2(NP_002229) c3(5730) c4(31844, 44801, 57958, 18787, 71015) c5(b, fr, hS, w, e, y, d, aX, h, DP, bu, O, u, iT, bUH, dA, qL, ft, W, bb, hR, mO, ja, hX, cT, re); #c1(KCNH2) c2(NP_000229) c3(5731) c4(31845, 44902, 57959, 18788, 71016) c5(bUK, jK, B, aw, le, jt, w, Bj, cO, e, M, bhQ, t, Si, mR, cl, Fg, R, nW, iv, x, hR, hj, mO, ie, OJ, bk, GO, id, X, hS, dV, U, io, co, pp, SK, mL f, cs, akf, bu, dZ, cc, bkd, Tk, av, nR, dX, YV, V, hf, Fr, iA, W, aY, nJ, T, dR, ap, b, ZE, atV, Fm, d, aeQ, Fp, bUJ, ajW, es, mL, ar, bnW, l, qL, sX, Fw, atr, ad, G, rw, bnU, bnT, aJA, he, TD, MA, QP, cK, SW, QU, A, k, Pa, xj, di, in, jR, aW, qs, adx, wp, h, bzC, F, bgm, cU, rR, bUI, aq, bnV, fU, nQ, cV, J, dt, P, SF, Bg, by, bgn, ayr, avB, Dt, bnX, at); #c1(KCNH3) c2(NP_036416) c3(5732) c4(31846, 44903, 57960, 18789, 71017) c5(hS, J); #c1(KCNH4) c2(NP_036417) c3(5733) c4(31847, 44904, 57961, 18790, 71018) c5(dx, f, aw, bg, w, aaZ, U, A, y, jx, m, dv, aX, yQ, h, aqs, g, bu, kz, ar, B, u, fs, V, cV, nx, nz, du, v, IR, IX, zi, gC, Lt, iR, IS, mD); #c1(KCNH5) c2(NP_647479) c3(5734) c4(31848, 44905, 57962, 18791, 71019) c5(d, bb, IC, bK, jR, cz, hS, ar, eO, aX, e, cp); #c1(KCNH6) c2(NP_110406) c3(5735) c4(31849, 44906, 57963, 18792, 71020) c5(W, Be, cW, apG); #c1(KCNH7) c2(NPJ50375) c3(5736) c4(31850, 44907, 57964, 18793, 71021) c5(da, A, bBt, dA, B, W, bq, aV); #c1(KCNH8) c2(NP_653234) c3(5737) c4(31851, 44908, 57965, 18794, 71022) c5(dx, f, b, bg, w, aaZ, bw, U, A, y, jx, m, dv, gC, yQ, h, aqs, q, bu, kz, ar, B, fy, u, fs, V, cV, nx, nz, du, v, IR, IX, zi, jT, Lt, iR, IS, mD); #c1(KCNIP1) c2(NP_001030009) c3(5738) c4(31852, 44909, 57966, 18795, 71023) c5(aV, aeq); #c1(KCNIP2) c2(NP_055406) c3(5739) c4(31853, 44910, 57967, 18796, 71024) c5(cO); #c1(KCNIP3) c2(NP_001030086) c3(5740) c4(31854, 44911, 57968, 18797, 71025) c5(cV, J, hS, y, fM, u, o); #c1(KCNIP4) c2(NP_001030175) c3(5741) c4(31855, 44912, 57969, 18798, 71026) c5(bAS, bb, dA, t, hT, ao, dB, cy, fh); #c1(KCNJ10) c2(NP_002232) c3(5742) c4(31856, 44913, 57970, 18799, 71027) c5(vf, bUL, hS, w, vZ, dV, wf, bf, aNa, nQ, na, adl, nU, XQ, dZ, aV, l, bK, aPG, aM, bUM, ao, rQ, dk, iZ, HM, alo, aeP, Bx, bwJ, dR, zn, rn); #c1 (KCNJ11) c2(NP_000516) c3(5743) c4(31857, 44914, 57971, 18800, 71028) c5(dx, mv, id, aw, hY, HD, bUN, my, mq, mC, hS, di, cO, bf, U, ey, dl, bQ, f, bUO, mm, dh, o, mz, kF, V, l, du, aVY, MO, dt, P, eX, gF, hR, mO, aM, at, ig, ch, mB, cf, MP, mA, aE, ih, fD, bq, aA, Ah, ap); #c1(KCNJ12) c2(NP_066292) c3(5744) c4(31858, 44915, 57972, 18801, 71029) c5(bAi, b, f, aQp, nJ, atV, mO); #c1(KCNJ13) c2(NP_001165887) c3(5745) c4(31859, 44916, 57973, 18802, 71030) c5(bkC, bb, bOQ, HH, ql, bUP, bUR); #c1(KCNJ14) c2(NP_037480) c3(5746) c4(31860, 44917, 57974, 18803, 71031) c5(F0); #c1(KCNJ15) c2(XP_011527863) c3(5747) c4(31861, 44918, 57975, 18804, 71032) c5(mD, gF, aq, I); #c1(KCNJ16) c2(NP_001278551) c3(5748) c4(31862, 44919, 57976, 18805, 71033) c5(bUL); #c1(KCNJ18) c2(NP_001181887) c3(5749) c4(31863, 44920, 57977, 18806, 71034) c5(lw, lZ, bUS, lj); #c1(KCNJ1) c2(NP_000211) c3(5750) c4(31864, 44921, 57978, 18807, 71035) c5(oy, qf, vR, XL, vz, l, bUT, nU, bd, bKv, W, aeP, di, Hu, mD, aic, bf, TW, XQ, fD, aM); #c1(KCNJ2) c2(XP_011523081) c3(5751) c4(31865, 44922, 57979, 18808, 71036) c5(f, bUV, le, mk, atV, ec, Fp, cr, Gv, ayQ, mL, Gs, oD, bUU, fU, Pz, sX, S, bAi, IG, Cf, bb, HR, mO, at, ayP, cC, aBI, rw, bq, dR); #c1(KCNJ3) c2(NP_001247437) c3(5752) c4(31866, 44923, 57980, 18809, 71037) c5(bAi, l, b, cV, bHp, bp, hS, w, T, O, mD, fy, ar, dR, u, y); #c1(KCNJ4) c2(NP_690607) c3(5753) c4(31867, 44924, 57981, 18810, 71038) c5(vR, l, rf, MP, HS, bj); #c1(KCNJ5) c2(XP_011541112) c3(5754) c4(31868, 44925, 57982, 18811, 71039) c5(bUY, ajF, le, ajW, di, bf, atV, qs, Hq, bUZ, HR, bHp, eX, bUW, mL, zb, avP, bLI, jj, cV, sX, Fw, bp, W, bbl, mO, aM, Fz, bUX, mD, aA, dR, ap); #c1(KCNJ6) c2(NP_002231) c3(5755) c4(31869, 44926, 57983, 18812, 71040) c5(f, cr, l, qc, ak, nU, bp, bAi, aY, vR, HS, dc, mD, aq, cM, Gl); #c1(KCNJ8) c2(XP_005253415) c3(5756) c4(31870, 44927, 57984, 18813, 71041) c5(Fp, ma, sK, aF, mG, mM, ajW, hS, mL, di, Bs, mR, hR, at); #c1(KCNJ9) c2(XP_006711368) c3(5757) c4(31871, 44928, 57985, 18814, 71042) c5(l, vf, bp, hS, bVa, bf, aM); #c1(KCNK10) c2(NP_066984) c3(5758) c4(31872, 44929, 57986, 18815, 71043) c5(aal, cV, b, fh); #c1(KCNK12) c2(NP_071338) c3(5759) c4(31873, 44930, 57987, 18816, 71044) c5(vW, o, qB); #c1(KCNK16) c2(NP_001128577) c3(5760) c4(31874, 44931, 57988, 18817, 71045) c5(l, b); #c1(KCNK17) c2(NP_001128583) c3(5761) c4(31875, 44932, 57989, 18818, 71046) c5(bb, l, aO, fh); #c1(KCNK18) c2(NP_862823) c3(5762) c4(31876, 44933, 57990, 18819, 71047) c5(xy, b, sG, vf, dZ, dV, ayx, bVb); #c1(KCNK1) c2(NP_002236) c3(5763) c4(31877, 44934, 57991, 18820, 71048) c5(dx, X, du, ajW, av, O); #c1(KCNK2) c2(NP_001017424) c3(5764) c4(31878, 44935, 57992, 18821, 71049) c5(dx, ao, du, b, dk, aY, sB, iZ, vW, hS, A, B, dc, cA, gZ, dh, cM, fh); #c1(KCNK3) c2(NP_002237) c3(5765) c4(31879, 44936, 57993, 18822, 71050) c5(Fp, f, b, lX, le, dk, jJ, fw, lR, hS, mL, lS, bVc, MQ, di, dR, mO, sK); #c1(KCNK5) c2(NP_003731) c3(5766) c4(31880, 44937, 57994, 18823, 71051) c5(b, Fw, W, dk, jG, aV, u, y); #c1(KCNKG) c2(NP_004814) c3(5767) c4(31881, 44938, 57995, 18824, 71052) c5(qt); #c1(KCNK9) c2(XP_011515404) c3(5768) c4(31882, 44939, 57996, 18825, 71053) c5(aX, MH, b, Fw, nU, Id, w, bVd, u, y); #c1(KCNMA1) c2(NP_001154824) c3(5769) c4(31883, 44940, 57997, 18826, 71054) c5(A, Al, b, hY, Dv, dB, rd, hS, di, bf, iA, y, oy, qs, aX, B, wN, fa, cU, fr, do, O, bzq, u, dh, vR, Fw, v, cz, lh, bb, bnU, ft, akd, ao, dk, xM, bVe, agQ, bq, aA); #c1(KCNMB1) c2(NP_004128) c3(5770) c4(31884, 44941, 57998, 18827, 71055) c5(bP, at, bb, vG, bVf, vR, di, bq, cy, arL, et, O, gO); #c1(KCNMB2) c2(NP_001265840) c3(5771) c4(31885, 44942, 57999, 18828, 71056) c5(bVg, ie, cO); #c1(KCNMB3) c2(NP_001157149) c3(5772) c4(31886, 44943, 58000, 18829, 71057) c5(d, hY, arQ, yH, ld, e, hS, CG); #c1 (KCNMB4) c2(NP_055320) c3(5773) c4(31887, 44944, 58001, 18830, 71058) c5(oy, hS, or); #c1(KCNN1) c2(NP_002239) c3(5774) c4(31888, 44945, 58002, 18831, 71059) c5(jH); #c1(KCNN2) c2(NP_067627) c3(5775) c4(31889, 44946, 58003, 18832, 71060) c5(bL, hT, ox, XH, lo, ap); #c1(KCNN3) c2(NP_002240) c3(5776) c4(31890, 44947, 58004, 18833, 71061) c5(vf, b, uC, ahS, jJ, oH, nm, nt, nq, nr, nn, no, np, y, aX, sG, ak, mL, u, sX, el, jv, aes, ns, vW, at); #c1(KCNN4) c2(NP_002241) c3(5777) c4(31891, 44948, 58005, 18834, 71062) c5(dx, A, dN, EB, di, iC, bf, O, HY, dv, cy, f, cU, B, cs, aD, Hs, LR, du, J, ad, G, iA, aM, fw, bg); #c1(KCNQI) c2(NP_000209) c3(5778) c4(31892, 44949, 58006, 18835, 71063) c5(QU, OG, bzC, als, b, ji, uC, le, bUF, oH, hS, fe, di, atV, bf, U, hP, mF, bq, avQ, co, cr, io, pq, f, ajW, bVj, mL, mg, fy, mR, hj, bVh, Fg, vR, V, l, sX, Fp, ad, dt, P, adx, rw, aZ, Qt, cK, gF, hR, et, mO, aM, dR, sK, HC, aY, cf, mA, na, MA, ar, aA, at, bVi, ap); #c1(KCNQ2) c2(NP_004509) c3(5779) c4(31893, 44950, 58007, 18836, 71064) c5(ak, nr, hY, ns, hS, nm, nt, nq, KF, nn, no, np, bVI, avQ, or, nU, ahd, CG, akp, bK, jr, mO, aOj, IC, hT, Gh, akA, bVn, bVk, dR, bVm); #c1(KCNQ3) c2(NP_001191753) c3(5780) c4(31894, 44951, 58008, 18837, 71065) c5(avQ, jr, bb, hY, nU, iZ, akA, ld, ahd, vW, hS, bVn, cO, CG, akp); #c1(KCNQ5) c2(NP_001153602) c3(5781) c4(31895, 44952, 58009, 18838, 71066) c5(hS, atS, Bu, b); #c1(KCNRG) c2(NP_775876) c3(5782) c4(31896, 44953, 58010, 18839, 71067) c5(cT, A, jT, q, fO); #c1(KCNS1) c2(XP_005260466) c3(5783) c4(31897, 44954, 58011, 18840, 71068) c5(ih, PL, P, gZ); #c1(KCNS3) c2(XP_011531127) c3(5784) c4(31898, 44955, 58012, 18841, 71069) c5(vW, ao, ak, bb, dA); #c1(KCNT1) c2(NP_065873) c3(5785) c4(31899, 44956, 58013, 18842, 71070) c5(bVp, aOe, dA, hY, aOd, hS, bVe, IL); #c1(KCNT2) c2(NP_001274748) c3(5786) c4(31900, 44957, 58014, 18843, 71071) c5(aW); #c1(KCNU1) c2(NP_001027006) c3(5787) c4(31901, 44958, 58015, 18844, 71072) c5(cO); #c1(KCNV1) c2(NP_055194) c3(5788) c4(31902, 44959, 58016, 18845, 71073) c5(oy); #c1(KCNV2) c2(NP_598004) c3(5789) c4(31903, 44960, 58017, 18846, 71074) c5(pk, bVg, Pa, ml, le, rw, nR, mO); #c1(KCTD10) c2(NP_114160) c3(5790) c4(31904, 44961, 58018, 18847, 71075) c5(eH, fM, cV); #c1(KCTD11) c2(NP_001002914) c3(5791) c4(31905, 44962, 58019, 18848, 71076) c5(fU, b, iP, jR, oi, di, iG, jj, pg); #c1(KCTD12) c2(NP_612453) c3(5792) c4(31906, 44963, 58020, 18849, 71077) c5(at, fM, l); #c1(KCTD13) c2(NP_849194) c3(5793) c4(31907, 44964, 58021, 18850, 71078) c5(QZ, cz); #c1(KCTD15) c2(NP_076981) c3(5794) c4(31908, 44965, 58022, 18851, 71079) c5(dx, dv, V, l, dA, du, U, aA, ap); #c1(KCTD16) c2(XP_005268550) c3(5795) c4(31909, 44966, 58023, 18852, 71080) c5(at); #c1(KCTD1) c2(NP_001136202) c3(5796) c4(31910, 44967, 58024, 18853, 71081) c5(cT, XG, bVr, bVs); #c1(KCTD21) c2(XP_005273982) c3(5797) c4(31911, 44968, 58025, 18854, 71082) c5(jR); #c1(KCTD2) c2(NP_056168) c3(5798) c4(31912, 44969, 58026, 18855, 71083) c5(aal); #c1(KCTD3) c2(NP_057205) c3(5799) c4(31913, 44970, 58027, 18856, 71084) c5(rQ, fl); #c1(KCTD6) c2(NP_699162) c3(5800) c4(31914, 44971, 58028, 18857, 71085) c5(jR); #c1(KCTD7) c2(NP_001161433) c3(5801) c4(31915, 44972, 58029, 18858, 71086) c5(ahd, sp, zk, bVt, bVu, bEU, zp); #c1(KCTD9) c2(NP_060104) c3(5802) c4(31916, 44973, 58030, 18859, 71087) c5(jZ, vQ, aGq); #c1(KDELC1) c2(NP_076994) c3(5803) c4(31917, 44974, 58031, 18860, 71088) c5(bb); #c1(KDELR1) c2(NP_006792) c3(5804) c4(31918, 44975, 58032, 18861, 71089) c5(A); #c1(KDM2A) c2(NP_001243334) c3(5805) c4(31919, 44976, 58033, 18862, 71090) c5(co, T, fy, b); #c1(KDM2B) c2(NP_001005366) c3(5806) c4(31920, 44977, 58034, 18863, 71091) c5(b, kJ, J, ag, avY, kY, u, anW, y); #c1(KDM3A) c2(NP_060903) c3(5807) c4(31921, 44978, 58035, 18864, 71092) c5(A, aw, b, wn, U, cn, B, q, ff, cs, PX, NT, V, cV, ad, jo, T, fx, fp, wV, wP, i, aA); #c1(KDM3B) c2(NP_057688) c3(5808) c4(31922, 44979, 58036, 18865, 71093) c5(M, aw, V, t, h, J, ih, G, U, bdq, u, y); #c1(KDM4B) c2(NP_055830) c3(5809) c4(31923, 44980, 58037, 18866, 71094) c5(by, co, V, b, B, jR, bu, A, ar, i, cs, U, ad, u, y, cp); #c1(KDM4C) c2(NP_001140167) c3(5810) c4(31924, 44981, 58038, 18867, 71095) c5(GK, A, b, dB, GM, cO, e, oy, jh, ip, B, ik, fH, u, d, dA, cz, GB, jT, fJ, jR, bq, Gn); #c1(KDM5A) c2(NP_001036068) c3(5811) c4(31925, 44982, 58039, 18868, 71096) c5(nl, by, co, aw, h, nU, DO, q, J, yy, fy, cB, iv, HE, bu, u, y); #c1(KDM5B) c2(NP_006609) c3(5812) c4(31926, 44983, 58040, 18869, 71097) c5(co, aX, V, b, ck, hq, i, A, di, fx, kY, cO, HE, U, u, yA, y, pp); #c1(KDM5C) c2(NP_001140174) c3(5813) c4(31927, 44984, 58041, 18870, 71098) c5(IO, nz, nU, dB, cz, hS, RF, bVv, pR); #c1(KDM5D) c2(NP_001140177) c3(5814) c4(31928, 44985, 58042, 18871, 71099) c5(aEL, Bl, by, dB, bu); #c1(KDM6A) c2(NP_001278344) c3(5815) c4(31929, 44986, 58043, 18872, 71100) c5(aw, b, pR, dB, lO, y, jh, nU, jV, n, iR, Yj, J, fO, fx, bVw, u, jR, bUk, i, iu, rb); #c1(KDM6B) c2(NP_001073893) c3(5816) c4(31930, 44987, 58044, 18873, 71101) c5(m, A, b, nU, dB, q, ad, B, cs, x, n, bm, ci, rb, cp); #c1(KDR) c2(NP_002244) c3(5817) c4(31931, 44988, 58045, 18874, 71102) c5(dx, B, aw, dD, gG, jt, dB, HG, eW, sJ, w, bf, arl, oO, O, gO, cU, dv, cy, b, iR, t, e, nv, dl, mR, cl, oP, g, UV, Ad, aC, du, gm, fO, od, cV, PZ, Kb, aup, Nf, fy, oO, dS, sg, os, bVy, ag, cT, WR, dc, aol, ajG, Vx, beO, wa, cY, oa, eu, wy, fU, kY, GV, bw, VJ, y, rN, tp, co, bVx, pp, f, cs, bu, ra, iv, av, JD, bm, iT, yJ, iF, be, V, ae, nl, bd, iA, aAo, pk, beQ, gt, py, iP, fw, HB, fD, jw, ck, uS, acA, ia, oi, Ty, z, ey, gZ, fT, aO, d, biX, bb, eA, q, es, X, vu, ar, ff, bVz, as, fv, jG, HL, u, dh, o, fh, da, bU, UA, VM, VD, j, ad, BZ, Fo, Ca, Io, Vw, aeC, et, M, jU, jH, ao, nV, ch, eQ, l, di, wR, bL, A, iG, k, fN, pR, gw, bVA, cA, gQ, og, ds, jR, JC, wf, aI, U, aW, m, MT, aX, l, aGt, h, lr, iZ, ik, bkS, cB, HI, ma, bC, an, sB, J, gV, dU, P, T, Oi, jI, nP, by, fM, aM, rM, jT, ip, hq, G, XH, Af, bh, at, eG, iE, oT); #c1(KDSR) c2(NP_002026) c3(5818) c4(31932, 44989, 58046, 18875, 71103) c5(kz, gm, b, at); #c1(KEAP1) c2(NP_036421) c3(5819) c4(31933, 44990, 58047, 18876, 71104) c5(bP, bL, QF, b, X, aF, Zy, aWN, jc, fe, IW, bf, U, bj, e, y, gO, d, ed, co, h, f, F, q, ar, cs, av, QJ, u, o, is, ma, V, jh, dB, v, bp, ad, W, T, aZ, cK, aM, ao, fy, os, ag, og, fD, l, ap); #c1(KEL) c2(NP_000411) c3(5820) c4(31934, 44991, 58048, 18877, 71105) c5(fn, aag, ZZ, bgq, ae, gv, l, lo, hq, cy); #c1(KERA) c2(XP_011536083) c3(5821) c4(31935, 44992, 58049, 18878, 71106) c5(dx, qf, dv, bna, du, bVC, bVB, ba); #c1(KHDC3L) c2(NP_001017361) c3(5822) c4(31936, 44993, 58050, 18879, 71107) c5(gA, ZU, Dd); #c1(KHDRBS2) c2(NP_689901) c3(5823) c4(31937, 44994, 58051, 18880, 71108) c5(ji, f, aX); #c1(KHDRBS3) c2(NP_006549) c3(5824) c4(31938, 44995, 58052, 18881, 71109) c5(aw, bVD, f, jR, hS, x, u, y); #c1(KHK) c2(NP_000212) c3(5825) c4(31939, 44996, 58053, 18882, 71110) c5(hh, b, ch, dB, bVF, bVE, ff); #c1(KHSRP) c2(NP_003676) c3(5826) c4(31940, 44997, 58054, 18883, 71111) c5(eR, aN, iG, cA, bf, aK, O, jh, LS, LI, fq, h, f, N, q, bu, M, kz, iv, u, Qx, fU, fs, aqQ, cV, bK, by, Fy, aX, anf, ao, hX, jR, zO, aCQ, Xm); #c1(KIAA0020) c2(NP_055693) c3(5827) c4(31941, 44998, 58055, 18884, 71112) c5(ig); #c1(KIAA0040) c2(NP_055471) c3(5828) c4(31942, 44999, 58056, 18885, 71113) c5(cO); #c1(KIAA0100) c2(NP_055495) c3(5829) c4(31943, 45000, 58057, 18886, 71114) c5(Be, T, u, y, kY); #c1(KIAA0101) c2(NP_001025160) c3(5830) c4(31944, 45001, 58058, 18887, 71115) c5(dx, B, auc, b, pR, jj, DT, Tw, Kc, mk, fl, y, co, aX, jk, f, q, bu, ik, ff, cs, ar, fy, u, da, il, cV, qL, du, ad, jo, dv, T, Ml, by, jE, nV, bm, hq, ag, at, Hq); #c1(KIAA0196) c2(NP_055661) c3(5831) c4(31945, 45002, 58059, 18888, 71116) c5(bVG, A, bS, cV, ajl, bN, bVH, T, B, bZ, oD, di); #c1(KIAA0226) c2(NP_001139114) c3(5832) c4(31946, 45003, 58060, 18889, 71117) c5(bVI); #c1(KIAA0226L) c2(NP_001273691) c3(5833) c4(31947, 45004, 58061, 18890, 71118) c5(d, ao, fl, re, ik, e, iT); #c1(KIAA0232) c2(NP_001094060) c3(5834) c4(31948, 45005, 58062, 18891, 71119) c5(at); #c1(KIAA0319) c2(NP_001161846) c3(5835) c4(31949, 45006, 58063, 18892, 71120) c5(WE, r, b, Xd, WW, nf, aeX, bVN, lv, hS, yD, A, ak, bVJ, bPL, xw, y, aev, iy, yQ, bea, Lw, nU, beb, bVM, aIW, bVL, B, u, aew, em, Ad, hW, FR, FO, bK, bVK, v, Wh, dt, Q, lI, cV, bB, PZ, cz, cq, KK, kH, Y, tW, he, xJ, bdN, FT, Au, UT, aeu, cG, alM); #c1(KIAA0319L) c2(XP_011540484) c3(5836) c4(31950, 45007, 58064, 18893, 71121) c5(m, fD, yQ, j); #c1(KIAA0355) c2(NP_055501) c3(5837) c4(31951, 45008, 58065, 18894, 71122) c5(ak); #c1(KIAA0391) c2(NP_001243607) c3(5838) c4(31952, 45009, 58066, 18895, 71123) c5(da, bq, at, dH); #c1(KIAA0586) c2(NP_001231118) c3(5839) c4(31953, 45010, 58067, 18896, 71124) c5(ao, AP, zW); #c1(KIAA0825) c2(NP_001139150) c3(5840) c4(31954, 45011, 58068, 18897, 71125) c5(is, at); #c1(KIAA0907) c2(NP_055764) c3(5841) c4(31955, 45012, 58069, 18898, 71126) c5(co); #c1(KIAA0922) c2(NP_001124479) c3(5842) c4(31956, 45013, 58070, 18899, 71127) c5(bq); #c1(KIAA1024) c2(NP_056021) c3(5843) c4(31957, 45014, 58071, 18900, 71128) c5(oy); #c1(KIAA1033) c2(NP_056090) c3(5844) c4(31958, 45015, 58072, 18901, 71129) c5(nU, ak); #c1(KIAA1109) c2(XP_005263344) c3(5845) c4(31959, 45016, 58073, 18902, 71130) c5(jH, KK, Ky, aC, nz, gY, ig, aE, KA); #c1(KIAA1147) c2(NP_001073861) c3(5846) c4(31960, 45017, 58074, 18903, 71131) c5(vZ, dh, fw); #c1(KIAA1161) c2(NP_065753) c3(5847) c4(31961, 45018, 58075, 18904, 71132) c5(o); #c1(KIAA1211) c2(NP_065773) c3(5848) c4(31962, 45019, 58076, 18905, 71133) c5(A); #c1(KIAA1211L) c2(XP_005263981) c3(5849) c4(31963, 45020, 58077, 18906, 71134) c5(ak); #c1(KIAA1273) c2(NP_001091970) c3(5850) c4(31964, 45021, 58078, 18907, 71135) c5(jz, EA, cO, bw, rC, jQ); #c1(KIAA1279) c2(NP_056449) c3(5851) c4(31965, 45022, 58079, 18908, 71136) c5(ni, nU, ahS, bVO, ahO, QZ, bj); #c1(KIAA1324) c2(XP_011540127) c3(5852) c4(31966, 45023, 58080, 18909, 71137) c5(An, Ao, QB, cU, bby, av, avg, iA, ac); #c1(KIAA1324L) c2(NP_001136221) c3(5853) c4(31967, 45024, 58081, 18910, 71138) c5(dA); #c1(KIAA1377) c2(NP_065853) c3(5854) c4(31968, 45025, 58082, 18911, 71139) c5(axQ); #c1(KIAA1456) c2(XP_005273641) c3(5855) c4(31969, 45026, 58083, 18912, 71140) c5(U, at, V); #c1(KIAA1462) c2(XP_011517910) c3(5856) c4(31970, 45027, 58084, 18913, 71141) c5(rd, at, gk, o, ap); #c1(KIAA1468) c2(NP_065905) c3(5857) c4(31971, 45028, 58085, 18914, 71142) c5(cO); #c1(KIAA1524) c2(NP_065941) c3(5858) c4(31972, 45029, 58086, 18915, 71143) c5(dx, by, en, aw, b, X, dB, ea, kY, bf, nT, U, y, co, aX, h, F, q, bu, cU, fr, cs, av, fy, u, iT, pE, asQ, V, nQ, cV, aC, du, J, bp, ad, dv, T, iy, ft, jG, JY, DO, Rd, ji, af, re); #c1(KIAA1549) c2(NP_001158137) c3(5859) c4(31973, 45030, 58087, 18916, 71144) c5(bb, k, EM, Fs, Vz, HG, anD, auR, O, auv, Fg); #c1(KIAA1551) c2(XP_005253462) c3(5860) c4(31974, 45031, 58088, 18917, 71145) c5(aX); #c1(KIAA1598) c2(NP_001120683) c3(5861) c4(31975, 45032, 58089, 18918, 71146) c5(bvY, Ns, cO); #c1(KIAA1715) c2(NP_001291937) c3(5862) c4(31976, 45033, 58090, 18919, 71147) c5(aMi, bj); #c1(KIAA1804) c2(NP_5811) c3(5863) c4(31977, 45034, 58091, 18920, 71148) c5(bb, V); #c1(KIAA1841) c2(XP_005264663) c3(5864) c4(31978, 45035, 58092, 18921, 71149) c5(ig); #c1(KIAA1919) c2(NP_699200) c3(5865) c4(31979, 45036, 58093, 18922, 71150) c5(aE); #c1(KIAA2022) c2(NP_001008537) c3(5866) c4(31980, 45037, 58094, 18923, 71151) c5(rQ, KH, WW, nz, nU, qa, cA, abw, bVP); #c1(KIDINS220) c2(NP_065789) c3(5867) c4(31981, 45038, 58095, 18924, 71152) c5(ake, b, cY, eR, iV, iL, gE, m, co, aX, pp, f, cl, TI, pP, o, cV, aC, nW, v, P, cy, fx, fy, QG, fw, XH, i); #c1(KIF11) c2(NP_004514) c3(5868) c4(31982, 45039, 58096, 18925, 71153) c5(g, gk, Qc, l, b, bVQ, nU, bVR, w, fl, QZ, VJ, u, o, oP); #c1(KIF13A) c2(NP_001099036) c3(5869) c4(31983, 45040, 58097, 18926, 71154) c5(ak, A); #c1(KIF14) c2(NP_055690) c3(5870) c4(31984, 45041, 58098, 18927, 71155) c5(fl, aw, b, X, kY, bw, e, O, d, co, re, q, ar, y, cB, av, fy, u, Be, bp, jR, ag, ji); #c1(KIF15) c2(NP_064627) c3(5871) c4(31985, 45042, 58099, 18928, 71156) c5(qP, fl); #c1(KIF16B) c2(NP_001186795) c3(5872) c4(31986, 45043, 58100, 18929, 71157) c5(bxA, bVS); #c1(KIF17) c2(XP_011540143) c3(5873) c4(31987, 45044, 58101, 18930, 71158) c5(wn, NT); #c1(KIF18A) c2(NP_112494) c3(5874) c4(31988, 45045, 58102, 18931, 71159) c5(fl, V, b, U, u, y); #c1(KIF1A) c2(NP_001230937) c3(5875) c4(31989, 45046, 58103, 18932, 71160) c5(bVT, A, iy, b, Y, cV, F, bqU, bVV, aFh, bf, bVU, ale); #c1(KIF1C) c2(NP_006603) c3(5876) c4(31990, 45047, 58104, 18933, 71161) c5(IK, Eg, nl, bVW, Nw, kS, Wz); #c1(KIF20A) c2(NP_005724) c3(5877) c4(31991, 45048, 58105, 18934, 71162) c5(fl, aX, b, kJ, bu, ag, bw, by, aw); #c1(KIF20B) c2(NP_001271188) c3(5878) c4(31992, 45049, 58106, 18935, 71163) c5(ck, KM, zO, i, fx, u, y); #c1(KIF21A) c2(NP_001166934) c3(5879) c4(31993, 45050, 58107, 18936, 71164) c5(aNF, Am, fU, arP, xL, aUs, bVS, AB, uH, bxA, bVY, oD, Nq, bVX); #c1(KIF21B) c2(NP_001239029) c3(5880) c4(31994, 45051, 58108, 18937, 71165) c5(jH, aV, fP, nl, aW); #c1(KIF22) c2(NP_001243199) c3(5881) c4(31995, 45052, 58109, 18938, 71166) c5(A, b, X, dB, U, y, aed, pp, Qm, B, F, q, bu, cs, qu, av, fy, u, bWa, V, bp, ad, co, ll, x, rV, by, bVZ); #c1(KIF23) c2(NP_004847) c3(5882) c4(31996, 45053, 58110, 18939, 71167) c5(aX, fl, u, O, y); #c1(KIF24) c2(NP_919289) c3(5883) c4(31997, 45054, 58111, 18940, 71168) c5(ai); #c1(KIF25) c2(NP_005346) c3(5884) c4(31998, 45055, 58112, 18941, 71169) c5(Eo); #c1(KIF26A) c2(NP_056471) c3(5885) c4(31999, 45056, 58113, 18942, 71170) c5(bw, bb); #c1(KIF26B) c2(NP_060482) c3(5886) c4(32000, 45057, 58114, 18943, 71171) c5(bb, at, u, y); #c1(KIF2A) c2(NP_001091981) c3(5887) c4(32001, 45058, 58115, 18944, 71172) c5(Ad, ez, bWb, B, A, fl, Ig, bf, QZ, PZ, u, y, aM); #c1(KIF2B) c2(NP_115948) c3(5888) c4(32002, 45059, 58116, 18945, 71173) c5(aA, uH); #c1(KIF2C) c2(NP_001284584) c3(5889) c4(32003, 45060, 58117, 18946, 71174) c5(by, ck, V, b, bu, ad, T, cs, bf, U, at, u, bq, y, aM); #c1(KIF3A) c2(NP_001287720) c3(5890) c4(32004, 45061, 58118, 18947, 71175) c5(bWc, tY, xc, A, cy, b, fq, f, P, B, tl, asa, bP, AP, zW, ge); #c1(KIF3B) c2(NP_004789) c3(5891) c4(32005, 45062, 58119, 18948, 71176) c5(q); #c1(KIF3C) c2(NP_002245) c3(5892) c4(32006, 45063, 58120, 18949, 71177) c5(PY, cV); #c1(KIF4A) c2(XP_011529195) c3(5893) c4(32007, 45064, 58121, 18950, 71178) c5(fl, b, qL, nU, hS, co, fy); #c1(KIF48) c2(NP_001092763) c3(5894) c4(32008, 45065, 58122, 18951, 71179) c5(di, bb, dA); #c1(KIF5A) c2(NP_004975) c3(5895) c4(32009, 45066, 58123, 18952, 71180) c5(ax, cN, cG, aC, u, bN, ajl, uH, cb, bWd, Y, y, xe, aV, ajj, aE, bdu, dH); #c1(KIF5B) c2(NP_004512) c3(5896) c4(32010, 45067, 58124, 18953, 71181) c5(d, qp, aX, V, js, cV, fs, fl, N, bN, bWd, w, ar, co, ji, fy, bf, U, QJ, e, O); #c1(KIF5C) c2(NP_004513) c3(5897) c4(32011, 45068, 58125, 18954, 71182) c5(Ad, bWe, nU, FT, QZ, PZ); #c1(KIF6) c2(NP_001275949) c3(5898) c4(32012, 45069, 58126, 18955, 71183) c5(dx, bL, dv, bb, l, du, fh, dl, tF, bq, at, ap); #c1(KIF7) c2(XP_005254959) c3(5899) c4(32013, 45070, 58127, 18956, 71184) c5(bwH, bWg, bWf, aX, rP, LY, nU, Nq, TD, di, beu); #c1(KIF9) c2(NP_001128350) c3(5900) c4(32014, 45071, 58128, 18957, 71185) c5(at); #c1(KIFAP3) c2(NP_001191443) c3(5901) c4(32015, 45072, 58129, 18958, 71186) c5(Vr, ao, A, cp); #c1(KIFC1) c2(NP_002254) c3(5902) c4(32016, 45073, 58130, 18959, 71187) c5(m, gP); #c1(KIFC3) c2(NP_001123572) c3(5903) c4(32017, 45074, 58131, 18960, 71188) c5(nQ, TD); #c1(KIN) c2(NP_036443) c3(5904) c4(32018, 45075, 58132, 18961, 71189) c5(u, y); #c1(KIR2DL1) c2(NP_055033) c3(5905) c4(32019, 45076, 58133, 18962, 71190) c5(en, gU, gn, ig, ix, vZ, awg, gE, al, HQ, M, bb, t, h, bx, q, dl, se, aE, tg, jG, aV, bm, jZ, da, l, im, aC, sH, nl, J, gL, P, bPN, ny, vM, jC, aBa, aCK, bbK, blV, rS, iu, G, iV, xe, fG, m, Bm, cV, bq, bh, jl, eG, re); #c1(KIR2DL2) c2(NP_055034) c3(5906) c4(32020, 45077, 58134, 18963, 71191) c5(aBa, gU, gn, Ka, ig, bBu, ix, vZ, aEK, gE, bf, al, HQ, M, aX, t, h, bx, g, vQ, dl, se, aE, tg, bJd, aV, bm, jZ, da, ha, im, aC, sH, nl, J, bPN, dB, m, P, ll, ny, bq, bb, jG, aCK, jH, fc, Jh, cV, iV, xe, fG, rS, j, Bm, aM, fl, bh, jC, jl, iu, re); #c1(KIR2DL3) c2(NP_056952) c3(5907) c4(32021, 45078, 58135, 18964, 71192) c5(aBa, Kt, b, gU, Em, gn, aE, Ka, ig, bBu, ix, vZ, aEK, gE, bf, al, HQ, M, aX, ae, t, h, zH, q, vQ, anf, dl, aC, se, O, tg, bJd, aV, bm, jZ, da, l, im, bx, sH, nl, fO, J, bPN, dB, P, jG, j, ny, vM, bb, jT, IV, aCK, jH, aGc, iL, eW, rS, iu, Jh, cV, iV, xe, fG, m, Bm, aM, bq, bh, jl, eG, re); #c1(KIR2DL4) c2(NP_001074239) c3(5908) c4(32022, 45079, 58136, 18965, 71193) c5(aBa, b, gU, mW, ig, ix, iL, gE, al, xe, HQ, M, h, bx, q, dl, se, aE, tg, aV, bm, gl, da, m, aC, sH, nl, J, W, P, ny, VP, jC, jT, aCK, rS, eQ, iV, jZ, Bm, bh, re); #c1(KIR2DL5A) c2(NP_065396) c3(5909) c4(32023, 45080, 58137, 18966, 71194) c5(aBa, JH, b, gU, gE, iU, aE, ig, ix, iL, eM, al, G, aYA, aW, M, jl, ae, t, h, qd, q, pf, dl, gX, se, HQ, tg, jG, aV, bm, jZ, da, l, m, bx, aXd, nl, J, j, axl, ll, ny, jT, anf, aMw, aCK, rS, iu, P, iV, xe, CL, Bm, aC, bh, aA, eG); #c1 (KIR2DL5B) c2(NP_001018091) c3(5910) c4(32024, 45081, 58138, 18967, 71195) c5(m, nl, JH, h, aBa, J, ig, P, se, ll, aE); #c1(KIR2DSI) c2(NP_055327) c3(5911) c4(32025, 45082, 58139, 18968, 71196) c5(aBa, JH, iL, b, gU, gn, aE, ig, ix, vZ, awg, eM, al, G, aYA, aW, M, bb, ae, t, h, qd, q, pf, dl, gX, se, aFL, HQ, tg, jG, aV, bm, jZ, da, l, im, bx, aXd, sH, nl, J, j, iU, axl, ll, ny, bq, jl, jT, anf, aMw, aCK, rS, iu, P, iV, xe, m, CL, Bm, cV, aC, bh, aA, eG, re); #c1(KIR2DS2) c2(NP_001278624) c3(5912) c4(32026, 45083, 58140, 18969, 71197) c5(awg, aBa, Kt, b, zH, Em, dB, aE, Ka, eW, bBu, ix, vZ, aM, gE, bf, al, HQ, M, bb, t, h, bx, g, vQ, dl, se, O, tg, bJd, aV, bm, jZ, da, ae, im, aC, nl, J, j, P, jG, fO, ny, bq, jl, jT, anf, aCK, aGc, iL, rS, iu, Jh, iV, xe, m, CL, Bm, cV, bh, eG); #c1(KIR2DS3) c2(NP_036445) c3(5913) c4(32027, 45084, 58141, 18970, 71198) c5(aBa, Kt, gU, gn, ig, ix, iV, awg, gE, al, aYA, HQ, M, jl, t, h, bx, q, dl, se, aFL, aE, tg, jG, aV, bm, jZ, da, cV, aC, sH, nl, J, P, ny, anf, aCK, iL, blV, rS, dY, xe, m, CL, Bm, bh, iu, re); #c1(KIR2DS4) c2(NP_036446) c3(5914) c4(32028, 45085, 58142, 18971, 71199) c5(bP, aBa, JH, awg, gU, gn, ig, ix, aEK, gE, al, HQ, M, aX, ae, t, h, qd, q, pf, dl, aC, se, aE, tg, bFX, aV, bm, jZ, aju, da, l, cV, bx, sH, nl, J, axl, ny, jl, jT, jG, aCK, iL, rS, P, iV, xe, m, Bm, bh, iu, re); #c1(KIR3DL1) c2(NP_037421) c3(5915) c4(32029, 45086, 58143, 18972, 71200) c5(aw, bx, dB, bf, fR, gC, t, dl, gl, aC, sH, fO, bPN, iU, vM, jT, aMw, fc, pP, rS, aA, rn, ig, bBu, ix, y, yX, vQ, gX, aFL, bm, ae, aXd, nl, gv, pr, jC, anf, aCK, P, iV, xe, gA, lm, iu, afE, b, zH, awg, aYA, HQ, re, q, se, tg, jG, u, aE, da, l, gL, cz, G, JH, mk, ale, CL, Bm, Xf, gU, gE, gn, mW, iL, eM, al, aW, m, aX, h, aBa, M, n, aV, jZ, cV, J, dt, axl, ll, jl, aM, blV, Jh, j, bh, eG); #c1(KIR3DL2) c2(NP_001229796) c3(5916) c4(32030, 45087, 58144, 18973, 71201) c5(aBa, gU, ig, ix, al, jw, HQ, M, h, bx, q, dl, se, aE, tg, aV, bm, jZ, da, nl, m, aC, sH, be, J, P, ny, vM, aCK, rS, iV, xe, fG, Bm, bh, re); #c1(KIR3DL3) c2(NP_703144) c3(5917) c4(32031, 45088, 58145, 18974, 71202) c5(aBa, Kt, b, gU, Em, dB, aE, Ka, ig, bBu, ix, aM, gE, bf, al, HQ, M, h, q, vQ, dl, aC, se, O, tg, bJd, aV, bm, jZ, da, ae, im, bx, sH, nl, J, j, P, jG, fO, ny, jT, anf, aCK, aGc, iL, eW, rS, Jh, iV, xe, m, Bm, bh, eG, re); #c1(KIRREL2) c2(NP_115499) c3(5918) c4(32032, 45089, 58146, 18975, 71203) c5(asx); #c1(KIR-REL3) c2(NP_001155179) c3(5919) c4(32033, 45090, 58147, 18976, 71204) c5(hW, WW, nU, bWh, alF, cO, bb); #c1(KIRREL) c2(NP_001273278) c3(5920) c4(32034, 45091, 58148, 18977, 71205) c5(aE, bd, fD, te); #c1(KISS1) c2(XP_011507827) c3(5921) c4(32035, 45092, 58149, 18978, 71206) c5(dx, by, A, aw, b, cY, dB, jw, bWi, yD, di, e, U, fx, y, d, tp, dv, aX, yE, Bl, f, F, q, bu, cU, X, ar, B, cs, fv, av, fy, u, iF, qL, kF, V, Be, du, ad, W, T, cK, iA, Dd, US, iR, od, ag, HB, i, UT, aA, at); #c1(KISS1R) c2(NP_115940) c3(5922) c4(32036, 45093, 58150, 18979, 71207) c5(dx, b, eu, yD, e, y, d, dv, aX, f, q, bu, cU, Dd, fy, u, iF, du, dB, od, iA, yG, bWj, US, nV, aMW, bWk, iR, yE, T, UT); #c1(KIT) c2(NP_000213) c3(5923) c4(32037, 45094, 58151, 18980, 71208) c5(jp, B, pV, aAB, wS, zh, EM, jt, dB, Tw, Ip, Ty, bWr, w, bWu, aw, bu, pz, aTh, O, cp, M, jT, cy, am, bau, t, asz, aPN, cl, bWw, bsP, n, g, fe, p, cs, gm, bp, ft, cV, x, HG, fp, pq, aDJ, wh, Tu, Dj, UR, DO, yE, qP, pH, bkv, ael, ib, Dr, aEq, gE, bWq, cY, afY, oa, wy, afR, NH, Bg, kY, bWn, bw, U, agb, y, co, pw, px, awA, ak, N, bWp, DP, iv, aPM, av, fy, bm, cj, d, V, bWl, Xr, bWv, QP, aEw, ny, Qt, cl, Lx, aA, iQ, ahT, dt, iP, asy, dP, iY, jq, cf, jR, aoD, bkU, gR, kD, ci, ck, b, QB, wn, ic, jC, jy, pF, bah, hh, WO, aBP, aga, Qu, Tp, jV, es, ND, X, OC, ar, fT, VM, Km, jG, u, bWt, NT, wp, ir, Xu, Tx, aTi, ad, aHx, Tr, G, sf, aZ, et, auY, Lt, wV, nV, hU, kB, hX, sh, Yg, aiJ, mA, ash, zZ, wP, agf, fg, bOT, Lr, aKO, ZB, A, aAM, aov, k, fr, Lv, pR, gw, FL, Lu, og, e, iL, eM, zK, bWo, hP, Ld, jx, pA, QV, aX, LI, awz, h, bWm, Uq, cU, aRT, apP, oJ, cB, qB, fM, aq, iq, Lg, fU, oS, J, W, jo, Ql, T, fO, aKc, by, bWs, qp, iK, NG, apT, adu, eL, bbB, iD, Af, iB, Oi, at, rb); #c1(KITLG) c2(NP_000890) c3(5924) c4(32038, 45095, 58152, 18981, 71209) c5(avO, pV, EM, dB, ck, oE, e, xl, cy, b, t, aPN, gP, Jl, aC, wV, bp, ft, jE, ag, pt, ael, cY, iP, eu, wy, JE, Lr, U, y, CZ, co, f, N, cc, aPM, av, fy, bm, iT, cj, V, v, lo, oM, eL, Tp, am, zH, wn, d, Ag, hV, q, QE, DC, jG, u, cl, NT, kF, KL, G, sf, Lt, ao, nV, hU, wP, bWx, A, fr, Lv, EL, fs, jw, jx, oy, aX, fq, h, Uq, cU, apP, n, qB, cV, be, J, jo, T, fO, Ap, fM, ci, Af, X, at, eG); #c1(KLB) c2(NP_783864) c3(5925) c4(32039, 45096, 58153, 18982, 71210) c5(A, b, B, q, Le, P, bQ, bWy, di, aA, bm); #c1 (KLC1) c2(NP_001123579) c3(5926) c4(32040, 45097, 58154, 18983, 71211) c5(tM, aWN, bb, Dq, di, ic, aX, aV, o, HL); #c1(KLF10) c2(NP_001027453) c3(5927) c4(32041, 45098, 58155, 18984, 71212) c5(iF, bi, qt, l, b, fv, X, pP, cK, J, ag, BY, T, bkG, ar, bh, u, dh, y, ah); #c1(KLF11) c2(NP_003588) c3(5928) c4(32042, 45099, 58156, 18985, 71213) c5(em, wh, b, l, fN, mB, ag, oJ, bWz, bf, eG, aM); #c1(KLF12) c2(XP_011533211) c3(5929) c4(32043, 45100, 58157, 18986, 71214) c5(pk, A, b, l, aC, B, bu, ajZ, IV, by, aW); #c1(KLF13) c2(NP_057079) c3(5930) c4(32044, 45101, 58158, 18987, 71215) c5(m, eG, I); #c1(KLF14) c2(NP_619638) c3(5931) c4(32045, 45102, 58159, 18988, 71216) c5(d, em, aX, aeM, l, ic, tl, at, e); #c1(KLF15) c2(NP_054798) c3(5932) c4(32046, 45103, 58160, 18989, 71217) c5(dx, ed, du, bW, l, bL, fN, f, dv, P, A, sO, sF, iL, cO, rO, aA, uE); #c1(KLF16) c2(NP_114124) c3(5933) c4(32047, 45104, 58161, 18990, 71218) c5(I); #c1(KLF1) c2(NP_006554) c3(5934) c4(32048, 45105, 58162, 18991, 71219) c5(avO, awa, bWA, qt, l, ps, h, bWB, FC, VX, Ck, bgd, ah, aU, J, pP, adH, pg); #c1(KLF2) c2(NP_057354) c3(5935) c4(32049, 45106, 58163, 18992, 71220) c5(dx, bL, td, b, aF, DT, bf, aO, dv, bb, dN, pp, f, fy, u, l, Ea, du, gv, P, sf, aZ, aM, gd, bk, l, bh, at, ap); #c1(KLF3) c2(NP_057615) c3(5936) c4(32050, 45107, 58164, 18993, 71221) c5(ao, l, sO, h, bw, ap); #c1(KLF4) c2(NP_004226) c3(5937) c4(32051, 45108, 58165, 18994, 71222) c5(dx, B, aw, dB, w, bW, adr, e, O, dv, kJ, fH, Fg, du, gm, fO, x, fx, jT, ag, i, bq, aA, jz, eu, aAM, IW, bw, U, bAJ, y, co, Dq, f, bu, cs, iT, fi, V, v, cd, ad, Qt, fJ, JY, bwn, tl, b, BQ, d, re, q, ff, oO, u, il, by, G, sf, et, wV, wP, yA, uE, bL, A, kY, k, pR, pD, di, lv, hP, jQ, cr, l, h, F, ik, Dt, cV, Be, J, W, Po, jo, T, pF, Rd, at); #c1(KLF5) c2(NP_001273747) c3(5938) c4(32052, 45109, 58166, 18995, 71223) c5(bL, A, aw, b, GD, X, Mz, di, GV, U, e, y, d, co, h, B, jV, M, ik, aW, cs, av, fy, u, o, rR, tw, V, l, bx, bp, ad, W, T, fx, ag, i, ap); #c1(KLF6) c2(NP_001153597) c3(5939) c4(32053, 45110, 58167, 18996, 71224) c5(fr, f, axq, b, k, cY, mW, O, Ey, en, ak, iL, gE, bf, U, ba, A, Up, fO, co, aX, kJ, qc, h, hg, q, jV, bu, dl, X, ar, y, cB, iv, av, fy, u, g, if, hW, V, l, dA, Be, Fs, bp, gv, Ce, T, il, cV, Qt, bb, ft, dL, fp, aM, qp, ji, bm, Fr, B, by, sG, et, w, fP, fN, bh, at, vt); #c1(KLF7) c2(NP_001257871) c3(5940) c4(32054, 45111, 58168, 18997, 71225) c5(aA, auz, I); #c1(KLF8) c2(XP_005262036) c3(5941) c4(32055, 45112, 58169, 18998, 71226) c5(nU, aw, l, b, X, pR, hg, dB, q, bu, jo, w, O, av, by, u, y); #c1(KLF9) c2(NP_001197) c3(5942) c4(32056, 45113, 58170, 18999, 71227) c5(bi, A, iq, b, Bl, B, q, cU, w, bh, Qj, iA, eG); #c1(KLHDC1) c2(NP_751943) c3(5943) c4(32057, 45114, 58171, 19000, 71228) c5(aC, at, di, aE, l); #c1(KLHDC2) c2(NP_055130) c3(5944) c4(32058, 45115, 58172, 19001, 71229) c5(fy); #c1(KLHDC8A) c2(XP_006711492) c3(5945) c4(32059, 45116, 58173, 19002, 71230) c5(ac); #c1(KLHDC88) c2(NP_775817) c3(5946) c4(32060, 45117, 58174, 19003, 71231) c5(fH, Ah, P, fJ); #c1(KLHL10) c2(NP_689680) c3(5947) c4(32061, 45118, 58175, 19004, 71232) c5(wn, NT, am, ZR, bWC); #c1(KLHL12) c2(NP_001289980) c3(5948) c4(32062, 45119, 58176, 19005, 71233) c5(di); #c1(KLHL1) c2(NP_001273654) c3(5949) c4(32063, 45120, 58177, 19006, 71234) c5(IO, b, kg, iP, dB, lM, hS, C, iG, gE, U, kV, al, y, d, it, co, aX, h, gB, q, e, ar, av, fy, u, fU, ly, by, T, ll, hX, ag, bT); #c1(KLHL20) c2(NP_055273) c3(5950) c4(32064, 45121, 58178, 19007, 71235) c5(aW); #c1(KLHL25) c2(NP_071925) c3(5951) c4(32065, 45122, 58179, 19008, 71236) c5(Eo, cp); #c1(KLHL26) c2(NP_060786) c3(5952) c4(32066, 45123, 58180, 19009, 71237) c5(Ns); #c1(KLHL29) c2(NP_443152) c3(5953) c4(32067, 45124, 58181, 19010, 71238) c5(at, dA); #c1(KLHL2) c2(NP_001154993) c3(5954) c4(32068, 45125, 58182, 19011, 71239) c5(g, WG, fe, V, f, atK, bWD, AG, w, aVn, yn, 1W, di, U, fy, Xe); #c1(KLHL31) c2(NP_001003760) c3(5955) c4(32069, 45126, 58183, 19012, 71240) c5(di); #c1(KLHL35) c2(NP_001034637) c3(5956) c4(32070, 45127, 58184, 19013, 71241) c5(q, dB); #c1(KLHL3) c2(NP_001244123) c3(5957) c4(32071, 45128, 58185, 19014, 71242) c5(M, aic, di, bWE); #c1(KLHL40) c2(NP_689606) c3(5958) c4(32072, 45129, 58186, 19015, 71243) c5(Aw, oD, bWE, AG); #c1(KLHL41) c2(NP_006054) c3(5959) c4(32073, 45130, 58187, 19016, 71244) c5(AC, bWG); #c1(KLHL42) c2(NP_065833) c3(5960) c4(32074, 45131, 58188, 19017, 71245) c5(fG, I); #c1(KLHL5) c2(NP_001007076) c3(5961) c4(32075, 45132, 58189, 19018, 71246) c5(dd); #c1(KLHL6) c2(NP_569713) c3(5962) c4(32076, 45133, 58190, 19019, 71247) c5(cT); #c1(KLHL7) c2(NP_001026880) c3(5963) c4(32077, 45134, 58191, 19020, 71248) c5(cT, bWH, nQ, yn, ml); #c1(KLHL9) c2(NP_061335) c3(5964) c4(32078, 45135, 58192, 19021, 71249) c5(aX, ic); #c1(KL) c2(NP_004786) c3(5965) c4(32079, 45136, 58193, 19022, 71250) c5(dx, B, dN, dB, eH, HC, bf, gO, dv, bsO, fH, Hs, aC, du, gJ, vc, mm, qt, Dz, rJ, ag, fz, aA, bP, bsS, adL, X, mk, OV, rH, y, ed, co, f, tv, cs, av, cp, bm, iT, em, vR, V, bsW, eX, cK, fJ, sP, aOE, W, zS, fD, ap, b, ia, tG, gF, aO, bb, re, q, jF, bTt, Km, fv, u, dh, l, FL, gL, ad, bos, Nh, vw, et, jU, D, A, asE, AQ, vg, U, oy, qs, aX, yx, HY, aV, amL, aAU, fU, si, Dw, dt, di, acx, aM, agl, AR, zM, bsX, bh, at); #c1(KLK10) c2(NP_002767) c3(5966) c4(32080, 45137, 58194, 19023, 71251) c5(Dr, A, b, X, xc, iH, iL, U, hP, e, y, d, kJ, B, q, bu, ar, DP, av, fy, u, da, Nb, V, qL, gv, T, by, bh); #c1(KLK11) c2(NP_001129504) c3(5967) c4(32081, 45138, 58195, 19024, 71252) c5(da, A, iP, b, X, B, dB, bu, W, T, fy, aJ, av, by, u, y); #c1(KLK12) c2(NP_062544) c3(5968) c4(32082, 45139, 58196, 19025, 71253) c5(A, b, B, j, bu, ar, by, u, y); #c1(KLK13) c2(NP_056411) c3(5969) c4(32083, 45140, 58197, 19026, 71254) c5(da, A, aw, b, X, Lv, B, bp, bu, ck, T, fy, ar, av, by, u, y); #c1(KLK14) c2(NP_071329) c3(5970) c4(32084, 45141, 58198, 19027, 71255) c5(da, fi, A, b, X, B, xU, W, ck, ar, fy, cs, Fr, av, ad, u, y); #c1(KLK15) c2(NP_001264010) c3(5971) c4(32085, 45142, 58199, 19028, 71256) c5(A, aw, b, X, Qf, B, ar, Fr, av, u, y); #c1(KLK1) c2(NP_002248) c3(5972) c4(32086, 45143, 58200, 19029, 71257) c5(bP, hq, b, TQ, X, vh, sv, bWl, id, sF, bW, bf, U, sx, aO, gO, hh, m, gs, bLO, LS, eA, bn, et, cK, f, el, wv, cy, cd, jF, iZ, dQ, y, A, cs, bv, ar, av, u, rX, jH, da, iF, ma, V, I, B, aC, bUz, sH, sB, dB, j, ad, sV, T, Jj, bq, x, bb, gF, by, hw, aM, kJ, aI, aH, uM, ch, bWJ, fw, dh, jd, w, fP, fD, fq, di, aA, at, ap); #c1(KLK2) c2(NP_001002231) c3(5973) c4(32087, 45144, 58201, 19030, 71258) c5(co, aw, ez, b, B, A, di, ny, ar, lg, bf, u, y, aM); #c1(KLK3) c2(NP_001025218) c3(5974) c4(32088, 45145, 58202, 19031, 71259) c5(B, aw, dB, JH, e, Up, asy, Si, azu, g, fe, Ph, nl, Dt, bp, asz, fD, bP, zu, X, Hk, eu, U, y, tp, fm, pp, f, bu, sh, av, V, ny, Fr, UZ, ji, b, jg, ic, bWL, d, ec, apG, WO, afX, ar, hb, fE, as, u, o, da, kF, aJ, UK, Mi, bc, dT, by, aZ, et, jU, iR, Bg, zX, ih, fl, bWK, OS, UT, A, aoG, gw, hA, jw, lr, m, jl, pN, p, cV, an, dU, T, aX, eN, gf); #c1(KLK4) c2(NP_004908) c3(5975) c4(32089, 45146, 58203, 19032, 71260) c5(B, b, X, mW, A, di, sF, cO, vp, U, y, m, Ur, bb, f, cU, ar, av, u, dh, bWM, Si, V, sB, W, P, T, Ca, iA, vA, et, fw, gl, xb, fD, bq, at); #c1(KLK5) c2(NP_036559) c3(5976) c4(32090, 45147, 58204, 19033, 71261) c5(d, da, A, dP, b, X, Mi, B, i, e, aFd, hb, fq, av, u, fx, y); #c1(KLK6) c2(NP_001012982) c3(5977) c4(32091, 45148, 58205, 19034, 71262) c5(Dr, mZ, A, aw, b, X, eu, aFd, w, U, Oq, y, hh, kJ, jd, fq, B, bu, cU, jF, ky, cs, ar, av, aV, u, o, da, V, dB, ad, W, T, by, bWN, xb); #c1(KLK7) c2(NP_001193982) c3(5978) c4(32092, 45149, 58206, 19035, 71263) c5(A, b, X, dB, aFd, mk, bw, U, y, hh, bSf, fq, B, Oq, eE, ar, cs, av, u, da, V, ad, W, T, aoG, ag); #c1(KLK8) c2(NP_009127) c3(5979) c4(32093, 45150, 58207, 19036, 71264) c5(co, aw, b, X, re, f, F, bp, iT, eE, A, ar, ak, VP, hW, av, fy, u, EM, y); #c1(KLK9) c2(NP_036447) c3(5980) c4(32094, 45151, 58208, 19037, 71265) c5(A, b, X, av, u, y); #c1(KLKB1) c2(NP_000883) c3(5981) c4(32095, 45152, 58209, 19038, 71266) c5(bP, A, b, aF, Zy, di, bCB, arW, y, m, qs, cy, cn, B, bu, u, by, bnH, aR, bvg, RY, fP, Cy, fD, bh, gl); #c1(KLLN) c2(NP_001119521) c3(5982) c4(32096, 45153, 58210, 19039, 71267) c5(hh, bWO, qO, b, hV, dB, bWP, jo, og, nV, T, B, A, ca, u, y, ff); #c1(KLRB1) c2(NP_002249) c3(5983) c4(32097, 45154, 58211, 19040, 71268) c5(en, aX, yX, bWQ, eQ, sS, eu, aDO, aC, P, T, II, iL, gE, wM, aV, C); #c1(KLRC1) c2(NP_998822) c3(5984) c4(32098, 45155, 58212, 19041, 71269) c5(en, pV, b, ix, iL, gE, aI, m, aX, cU, qB, jZ, aC, J, gL, P, iA, jT, qT, rS, gl, eG); #c1(KLRC2) c2(NP_002251) c3(5985) c4(32099, 45156, 58213, 19042, 71270) c5(da, m, iy, b, bWQ, aSB, aC, P, ix, aV, gI); #c1(KLRC4) c2(NP_038459) c3(5986) c4(32100, 45157, 58214, 19043, 71271) c5(cT, ix, jZ, b); #c1(KLRC4-KLRK1) c2(NP_001186734) c3(5987) c4(32101, 45158, 58215, 19044, 71272) c5(bP, dx, by, en, aw, b, PJ, X, ey, eM, iU, eH, w, e, iL, z, bf, U, buI, A, oU, O, d, M, co, aX, vn, et, h, f, F, q, bu, gG, fr, jT, B, iv, fH, av, aV, iT, n, em, du, V, cV, aC, aXd, LR, J, fO, ad, dU, P, dv, T, II, gC, ft, pi, am, atU, aM, fJ, et, nV, cs, pp, bIF, hx, sS, ie, xe, fG, m, cT, fD, I, jI, fR, re, oT); #c1(KLRDI) c2(NP_001107868) c3(5988) c4(32102, 45159, 58216, 19045, 71273) c5(m, b, aC, gL, gI, P, ix, aE, gE, VP, jC, aI, jT, eG, jZ); #c1(KLRGI) c2(NP_005801) c3(5989) c4(32103, 45160, 58217, 19046, 71274) c5(m, en, yV, I, kh, gL, cT, T, II, iL, gE, bf, ey, aE, aM); #c1(KLRG2) c2(NP_940910) c3(5990) c4(32104, 45161, 58218, 19047, 71275) c5(A, B); #c1(KMO) c2(NP_003670) c3(5991) c4(32105, 45162, 58219, 19048, 71276) c5(fU, si, t, ak, cA, G, gj, oO, aV); #c1(KMT2A) c2(NP_001184033) c3(5992) c4(32106, 45163, 58220, 19049, 71277) c5(dx, jK, B, aw, sE, dB, ps, oU, O, dv, t, fe, lb, yL, du, gm, fO, aNS, Q, jT, bWR, BX, hx, ie, cT, i, bq, pJ, mk, U, y, pp, f, N, bu, iv, fy, hD, iT, cj, em, aKq, V, FK, hf, pr, ny, gR, ci, ap, fn, ck, b, jL, jy, jd, q, jV, ar, oO, jG, iR, dh, fh, bzH, fs, by, as, G, oV, et, hX, u, hd, A, gw, pD, aFe, Iv, iL, ajT, Bz, aX, h, M, aC, n, aV, aq, fU, cV, an, bWS, J, P, ad, ip, pi, cZ); #c1(KMT2B) c2(NP_055542) c3(5993) c4(32107, 45164, 58221, 19050, 71278) c5(d, bm, bUk, nU, iL, b, et, pR, f, q, gm, ag, w, ac, A, jT, u, e, y); #c1(KMT2C) c2(NP_733751) c3(5994) c4(32108, 45165, 58222, 19051, 71279) c5(bck, b, u, gG, U, e, y, d, jh, h, gB, q, bu, ar, bm, hW, V, J, by, iR, ie, i, rb); #c1(KMT2D) c2(XP_005269219) c3(5995) c4(32109, 45166, 58223, 19052, 71280) c5(nU, b, pR, gG, w, iL, wf, bf, A, e, y, d, jh, am, pp, ag, t, f, g, Jf, cs, u, aE, gm, fO, G, kS, jT, et, ac, aM, Lc, bm, jR, na, bUk); #c1(KMT2E) c2(NP_061152) c3(5996) c4(32110, 45167, 58224, 19053, 71281) c5(dx, dv, b, dA, h, du, J, M, iT); #c1(KNGI) c2(NP_000884) c3(5997) c4(32111, 45168, 58225, 19054, 71282) c5(bWU, gK, mI, b, X, aE, A, di, C, dx, cO, bf, al, O, Ag, qs, co, cy, apd, f, F, bWT, ap, vP, dQ, bpP, hV, hj, bWV, uO, g, fD, I, Vc, Bs, Fw, du, dv, Wv, cV, bq, cK, fx, vA, et, av, qe, aM, jH, aH, nk, RY, m, bP, fP, o, i, l, zS, aA, at, gl); #c1(KNSTRN) c2(NP_001136233) c3(5998) c4(32112, 45169, 58226, 19055, 71283) c5(d, bLL, b, aOv, di, fD, adr, e); #c1(KNTC1) c2(NP_055523) c3(5999) c4(32113, 45170, 58227, 19056, 71284) c5(TV, P, do, QR, ib); #c1(KPNA1) c2(NP_002255) c3(6000) c4(32114, 45171, 58228, 19057, 71285) c5(aC, en, si); #c1(KPNA2) c2(NP_001307540) c3(6001) c4(32115, 45172, 58229, 19058, 71286) c5(fl, aw, b, k, X, w, A, y, co, AX, B, q, bu, cB, av, fy, bm, oP, gL, by, P, T, fx, Lx, jE, u, Lo, i); #c1(KPNA3) c2(NP_002258) c3(6002) c4(32116, 45173, 58230, 19059, 71287) c5(en, ho); #c1(KPNA4) c2(NP_002259) c3(6003) c4(32117, 45174, 58231, 19060, 71288) c5(kC, en, ku); #c1(KPNA6) c2(XP_011539462) c3(6004) c4(32118, 45175, 58232, 19061, 71289) c5(ag, dl, b); #c1(KPNA7) c2(NP_001139187) c3(6005) c4(32119, 45176, 58233, 19062, 71290) c5(ag, dl, b); #c1(KPNB1) c2(NP_001263382) c3(6006) c4(32120, 45177, 58234, 19063, 71291) c5(P, AX, u, iD, gL); #c1(KPRP) c2(NP_001020402) c3(6007) c4(32121, 45178, 58235, 19064, 71292) c5(Xx); #c1(KPTN) c2(NP_001278225) c3(6008) c4(32122, 45179, 58236, 19065, 71293) c5(bWW); #c1(KRAS) c2(NP_004976) c3(6009) c4(32123, 45180, 58237, 19066, 71294) c5(bck, by, B, aw, F, EM, gG, dB, HG, aJT, w, YB, bkJ, iq, aue, ra, O, yg, zi, iy, kJ, YY, t, AX, gB, e, fP, dl, aJP, Xi, cl, bXb, QB, aJQ, Zv, ava, anu, oP, g, fe, BQ, jH, zj, fO, of, bp, gY, Mg, Ce, x, fx, hR, fG, cg, wh, Tu, BX, auJ, bm, Qk, OR, DO, os, aEo, ag, agm, pH, i, agQ, aA, jl, Yw, Dr, is, Al, kN, cY, ie, afY, iP, eu, kP, wy, bXe, kY, blU, bw, U, Oh, aeC, y, bkT, tp, co, Ml, pp, wP, f, vQ, bu, gX, aEu, cs, auN, av, fy, avg, iT, yJ, fi, jB, YV, V, FK, aub, ze, n, Qz, gv, bav, YS, ny, Fr, YE, fv, pJ, qW, wp, gt, hp, QG, QO, in, ne, aut, jd, eg, awA, Tz, bXc, bXd, fD, ci, pv, bXh, auS, An, b, bWZ, Xj, MS, m, Ty, Og, z, hr, QF, iA, Mr, Ne, d, jh, bsQ, Bc, re, aua, q, X, ar, RF, VM, bXa, hV, jG, sK, u, ff, jj, ahF, il, qL, js, bWY, aza, ad, auG, Tt, QK, Ca, iD, ct, Be, M, apG, iw, wV, nV, iR, py, jc, Sk, abO, bXg, I, af, A, auO, JC, k, auj, gw, Tx, BY, pw, QQ, aES, gE, zK, ji, al, hP, zY, iK, bkC, aX, or, Qm, bn, h, anM, auh, cU, hN, ik, oJ, cB, LI, QJ, aJS, cV, aMH, bXf, auU, J, bWX, W, P, Ql, T, II, Kv, Oi, Zd, cr, Ap, fM, qT, jT, qp, ip, QN, Y, ck, YX, awz, G, jw, auy, Lr, auH, bh, eG, rb, as); #c1(KRBOX4) c2(NP_001123370) c3(6010) c4(32124, 45181, 58238, 19067, 71295) c5(jV); #c1(KREMEN1) c2(NP_001034659) c3(6011) c4(32125, 45182, 58239, 19068, 71296) c5(jB, fO); #c1(KRIT1) c2(NP_001013424) c3(6012) c4(32126, 45183, 58240, 19069, 71297) c5(A, b, bXi, iP, i, jc, w, hM, aA, JC, IW, O, e, cM, d, aX, qc, f, q, cy, bXm, cY, y, av, u, oJ, is, fU, bXj, bXn, B, Dg, jG, fO, bXI, dB, W, ME, T, ff, cV, bb, fx, jT, xx, Yp, bXk, P, wh, qt, azy, aY, jo, Cr, jd, OI, dc, X, rv); #c1(KRTI0) c2(NP_000412) c3(6013) c4(32127, 45184, 58241, 19070, 71298) c5(d, fj, bXq, bXr, bXo, Pv, cn, f, q, arW, mk, sf, ik, ic, il, bkJ, Pz, baW, bXp, e, bnH); #c1(KRT12) c2(NP_000214) c3(6014) c4(32128, 45185, 58242, 19071, 71299) c5(Ad, Ij, bXt, PZ, aOB, bXs); #c1(KRT13) c2(NP_002265) c3(6015) c4(32129, 45186, 58243, 19072, 71300) c5(aEq, d, jh, py, bXu, ar, u, e, y); #c1(KRT14) c2(NP_000517) c3(6016) c4(32130, 45187, 58244, 19073, 71301) c5(ml, iL, b, bXA, bPi, Ip, mk, BY, bXv, kY, gE, A, e, y, d, jh, XZ, biK, arW, re, f, bTK, arU, bXz, bXx, ik, Tr, ar, fy, u, iT, da, bXw, dt, bnH, T, Tp, YU, cW, bXy, atb); #c1(KRT15) c2(NP_002266) c3(6017) c4(32131, 45188, 58245, 19074, 71302) c5(pb, PJ, bAj, i, b, DP, bPi, uH, Ip, T, ic, bXB, rb, acR, u, aeM, y); #c1(KRT16) c2(NP_005548) c3(6018) c4(32132, 45189, 58246, 19075, 71303) c5(da, bvg, ata, bXD, il, b, I, akO, eX, i, bXC, aC, ik, bCz, bq, bf, aA, adr, baW, bix, aM); #c1(KRT17) c2(NP_000413) c3(6019) c4(32133, 45190, 58247, 19076, 71304) c5(Dr, A, b, X, hM, iL, adr, e, y, d, jh, co, arW, DM, B, F, es, ar, dQ, av, fy, u, jZ, da, aeM, amR, NB, bvg, ZN, ag, qO, xf, cn); #c1(KRT18) c2(NP_000215) c3(6020) c4(32134, 45191, 58248, 19077, 71305) c5(bP, gK, b, X, sE, Ty, C, z, al, e, y, gO, d, am, XZ, B, q, vQ, bu, Be, ar, cs, as, av, fy, u, fU, gG, an, bXE, sf, T, fx, dL, Lc, pS, bm, bY, ag, fP, fN, bh, aA, bT); #c1(KRT19) c2(NP_002267) c3(6021) c4(32135, 45192, 58249, 19078, 71306) c5(Dr, ji, hV, aw, b, pR, gG, dB, QM, bXH, A, xf, ic, iL, lr, U, ps, nP, y, d, jh, co, cy, aSW, kJ, re, f, F, q, vQ, bu, dl, gX, ra, ar, tE, e, Jk, fy, u, ajz, avm, yJ, jB, bm, V, aeM, IP, J, bp, gv, W, nV, T, cV, mD, pw, bXE, by, DP, ahT, bXG, jT, qp, lu, iR, os, B, ag, og, iT, gR, bh, yA, bT); #c1(KRT1) c2(NP_006112) c3(6022) c4(32136, 45193, 58250, 19079, 71307) c5(d, dt, Ip, bXo, bXM, bXL, cn, f, e, bvg, bXI, mk, bnH, T, ic, bAL, bXJ, baW, arW, bXK, hip); #c1(KRT20) c2(NP_061883) c3(6023) c4(32137, 45194, 58251, 19080, 71308) c5(by, aw, Zq, bx, gG, Ip, auJ, bf, aHp, e, M, bXP, cy, t, aoF, yh, iT, fH, gl, g, bXQ, vN, ss, gm, fO, aoS, aHv, x, fx, jT, bkT, pq, OR, aEo, ag, cT, axC, bk, i, jl, fl, oa, jz, eu, Ku, kY, Ou, bw, U, bAJ, cM, CZ, buf, hg, bu, gX, Em, cs, bXO, fY, V, Ov, nl, afz, rV, iA, fJ, in, ne, gR, re, Mo, WH, anh, b, qz, NU, IS, d, bxk, hV, ar, qu, fv, yW, u, ov, o, LR, j, ad, G, pD, ct, jG, yG, jH, wV, nV, iR, aE, wP, Mp, af, hd, zD, xu, Jo, mW, zz, gE, hP, jQ, m, bXN, ajn, h, cU, aC, Zs, y, aV, fU, si, be, J, W, P, T, aX, nP, Pk, fM, aM, alt, IX, E, eG); #c1(KRT23) c2(NP_056330) c3(6024) c4(32138, 45195, 58252, 19081, 71309) c5(V, ad, ag, ar, i, cs, I, U, dL, vl); #c1(KRT2) c2(NP_000414) c3(6025) c4(32139, 45196, 58253, 19082, 71310) c5(rr, bnH, bAL); #c1(KRT3I) c2(NP_002268)

c3(6026) c4(32140, 45197, 58254, 19083, 71311) c5(Ps, en, I, b, h, gw, M, P, aNw, Dd, bXR, ZU); #c1(KRT32) c2(NP_002269) c3(6027) c4(32141, 45198, 58255, 19084, 71312) c5(dB); #c1(KRT34) c2(NP_066293) c3(6028) c4(32142, 45199, 58256, 19085, 71313) c5(T); #c1(KRT35) c2(NP_002271) c3(6029) c4(32143, 45200, 58257, 19086, 71314) c5(vQ); #c1(KRT3) c2(NP_476429) c3(6030) c4(32144, 45201, 58258, 19087, 71315) c5(ba, bXt, aOB, bXS, kF); #c1(KRT4) c2(NP_002263) c3(6031) c4(32145, 45202, 58259, 19088, 71316) c5(jh, bXu, b); #c1(KRT5) c2(NP_000415) c3(6032) c4(32146, 45203, 58260, 19089, 71317) c5(fh, bXv, b, qd, iP, g, Ip, mk, ic, arW, e, y, jh, d, Ag, co, aX, pp, biK, jk, cn, F, bTK, arU, bXl, bXz, ar, Ek, fy, u, arS, zO, da, bXT, jj, i, aeM, bXM, dt, T, bb, fx, rW, aEs, XZ, Ty, bm, Ds, Af, tl, bq, at, afG, rb, ap); #c1(KRT6A) c2(NP_005545) c3(6033) c4(32147, 45204, 58261, 19090, 71318) c5(bvg, bXD, i, aum, bXU, bu, mk, hM, bCz, by, u, y); #c1(KRTGB) c2(NP_005546) c3(6034) c4(32148, 45205, 58262, 19091, 71319) c5(d, bvg, bXV, T, fy, e); #c1(KRT6C) c2(NP_775109) c3(6035) c4(32149, 45206, 58263, 19092, 71320) c5(bvg, bXW, bCz); #c1(KRT71) c2(NP_258259) c3(6036) c4(32150, 45207, 58264, 19093, 71321) c5(Ag, aey, T, Af, alx); #c1(KRT72) c2(NP_001139698) c3(6037) c4(32151, 45208, 58265, 19094, 71322) c5(adr); #c1(KRT74) c2(XP_011536204) c3(6038) c4(32152, 45209, 58266, 19095, 71323) c5(fh, bb, bKR, aey, alx, bXZ, bXY, cO, bq, at, bXX, ap); #c1(KRT75) c2(NP_004684) c3(6039) c4(32153, 45210, 58267, 19096, 71324) c5(bFb, aey, bYa); #c1(KRT76) c2(NP_056932) c3(6040) c4(32154, 45211, 58268, 19097, 71325) c5(Eo, alf, b); #c1(KRT78) c2(NP_001287743) c3(6041) c4(32155, 45212, 58269, 19098, 71326) c5(A); #c1(KRT7) c2(NP_005547) c3(6042) c4(32156, 45213, 58270, 19099, 71327) c5(zw, b, X, qz, jz, eu, pz, bYb, Ty, Iv, eM, jy, zY, gZ, adr, oU, cM, Sj, d, co, aX, bYc, kJ, t, h, f, e, q, Uq, M, bdv, ik, y, iv, ar, jQ, u, QM, jH, yJ, zL, si, aqQ, il, IP, aC, dB, gm, j, J, W, G, Ql, T, jl, fx, Ew, bcL, sg, aY, Tu, Yw, py, ie, aQM, in, xe, ih, Lo, Af, i, dc, aA, apT, bT); #c1(KRT80) c2(NP_001074961) c3(6043) c4(32157, 45214, 58271, 19100, 71328) c5(bvg, bix, cn, bnH, rr, arW, aey); #c1(KRT81) c2(XP_011536636) c3(6044) c4(32158, 45215, 58272, 19101, 71329) c5(d, bix, fy, aw, T, ar, QJ, e); #c1(KRT82) c2(NP_149022) c3(6045) c4(32159, 45216, 58273, 19102, 71330) c5(bb); #c1(KRT83) c2(NP_002273) c3(6046) c4(32160, 45217, 58274, 19103, 71331) c5(bix, bb); #c1(KRT85) c2(NP_001287739) c3(6047) c4(32161, 45218, 58275, 19104, 71332) c5(bKR, bb); #c1(KRT86) c2(XP_005268923) c3(6048) c4(32162, 45219, 58276, 19105, 71333) c5(bix, dt, jH, aey, bYd, aOB); #c1(KRT8) c2(NP_001243211) c3(6049) c4(32163, 45220, 58277, 19106, 71334) c5(gK, OG, A, b, bL, dB, bn, ic, iL, z, bw, al, e, y, d, asN, co, Be, iR, rr, f, q, bu, zB, ar, aTe, cB, cs, as, gg, fy, u, o, ju, fU, cV, an, bYe, LR, bXE, gv, bm, T, bp, fx, ad, jU, jH, Lc, aq, bY, B, by, ag, fP, bk, bkv, bh, bT); #c1(KRT9) c2(NP_000217) c3(6050) c4(32164, 45221, 58278, 19107, 71335) c5(d, bvg, bYg, X, cn, bYf, mk, bnH, mR, bvd, av, arW, e); #c1(KRTAP11-1) c2(NP_787054) c3(6051) c4(32165, 45222, 58279, 19108, 71336) c5(e0); #c1(KRTAP5-1) c2(NP_001005922) c3(6052) c4(32166, 45223, 58280, 19109, 71337) c5(bnH); #c1(KRTAP5-9) c2(NP_005544) c3(6053) c4(32167, 45224, 58281, 19110, 71338) c5(aC, be); #c1(KSR1) c2(XP_006722214) c3(6054) c4(32168, 45225, 58282, 19111, 71339) c5(b, aQF, X, J, ag, hM, bw, T, av, u, y); #c1(KSR2) c2(NP_775869) c3(6055) c4(32169, 45226, 58283, 19112, 71340) c5(h, ix, aA, I); #c1(KTN1) c2(NP_001072989) c3(6056) c4(32170, 45227, 58284, 19113, 71341) c5(kG, eM); #c1(KYNU)

c2(NP_001028170) c3(6057) c4(32171, 45228, 58285, 19114, 71342) c5(bYh, qs, fl, di, v); #c1(LICAM) c2(NP_000416) c3(6058) c4(32172, 45229, 58286, 19115, 71343) c5(jo, by, hV, aw, b, X, ahS, yz, w, O, U, bu, e, AO, d, co, aX, kJ, bYk, nU, bmk, bYi, cU, Mr, ar, y, bK, fv, av, fy, u, o, oP, g, fU, V, cV, nl, nz, cs, dB, cx, bN, adM, ahO, T, ff, bYj, x, ad, bYl, fM, EE, nV, ck, eG, aiy, bel, AR, ih, ag, fP, bYm, Nj, dc, vt); #c1(L2HGDH) c2(XP_005268132) c3(6059) c4(32173, 45230, 58287, 19116, 71344) c5(g, nU, bdc, bYn, hS, w); #c1(L3MBTL1) c2(NP_056293) c3(6060) c4(32174, 45231, 58288, 19117, 71345) c5(g, b, hX, h, N, J, pF, M, n); #c1(L3MBTL2) c2(NP_113676) c3(6061) c4(32175, 45232, 58289, 19118, 71346) c5(g, h, jR, pF); #c1(L3MBTL3) c2(NP_001007103) c3(6062) c4(32176, 45233, 58290, 19119, 71347) c5(jR, I); #c1(L3MBTL4) c2(NP_775735) c3(6063) c4(32177, 45234, 58291, 19120, 71348) c5(bw, bb); #c1(LACC1) c2(XP_006719829) c3(6064) c4(32178, 45235, 58292, 19121, 71349) c5(jH, acN, acO, ix, fP, Bm, cO); #c1(LACE1) c2(NP_660358) c3(6065) c4(32179, 45236, 58293, 19122, 71350) c5(ak); #c1(LACRT) c2(NP_150593) c3(6066) c4(32180, 45237, 58294, 19123, 71351) c5(u, bYo); #c1(LACTB) c2(NP_116246) c3(6067) c4(32181, 45238, 58295, 19124, 71352) c5(gM, aA); #c1(LAD1) c2(NP_005549) c3(6068) c4(32182, 45239, 58296, 19125, 71353) c5(KC, aw, arQ, bf, vl, arR, XZ, nU, aRO, yW, bfS, aRT, bfU, I, awD, J, dt, CM, eq, aRN, aM, pp, Ya, aE); #c1(LAG3) c2(NP_002277) c3(6069) c4(32183, 45240, 58297, 19126, 71354) c5(aoa, ml, auW, b, fc, asM, fO, J, qL, Be, P, aE, gE, fH, aV, fJ); #c1(LAIR1) c2(NP_001275955) c3(6070) c4(32184, 45241, 58298, 19127, 71355) c5(M, m, cT, fl); #c1(LAIR2) c2(NP_002279) c3(6071) c4(32185, 45242, 58299, 19128, 71356) c5(nl, ac); #c1(LALBA) c2(XP_011536644) c3(6072) c4(32186, 45243, 58300, 19129, 71357) c5(u, ml, aHz, y, boM); #c1(LAMA1) c2(NP_005550) c3(6073) c4(32187, 45244, 58301, 19130, 71358) c5(m, bb, I, am, ml, nU, cs, ad, iv, ji, aA, nR, jG, o); #c1(LAMA2) c2(NP_000417) c3(6074) c4(32188, 45245, 58302, 19131, 71359) c5(WE, Ik, eu, AA, ds, dV, bYp, U, arE, xl, c, aX, nU, wv, dZ, oD, JD, kG, V, dA, nl, bgw, ac, Iv, ao, nV, VQ, Y, aLz, Bu, Bm, Au, ji); #c1(LAMA3) c2(NP_000218) c3(6075) c4(32189, 45246, 58303, 19132, 71360) c5(by, A, bb, b, arT, aRL, et, byr, Ya, bYq, eo, W, w, ar, XW, bq, Zt, bu, u, fD, aG); #c1(LAMA4) c2(NP_001098676) c3(6076) c4(32190, 45247, 58304, 19133, 71361) c5(g, dx, by, A, b, bq, du, Ya, q, eo, W, T, ar, mR, jG, bYr, u, bu, O); #c1(LAMA5) c2(NP_005551) c3(6077) c4(32191, 45248, 58305, 19134, 71362) c5(bP, A, cy, V, BR, Ya, q, gL, pF, O, U, u, y); #c1(LAMB1) c2(NP_002282) c3(6078) c4(32192, 45249, 58306, 19135, 71363) c5(g, jH, wh, A, T, b, FR, eG, cz, hS, bYs, oJ, oD, u, y, kH); #c1(LAMB2) c2(NP_002283) c3(6079) c4(32193, 45250, 58307, 19136, 71364) c5(aSV, bYt, xQ, A, sU, al, KY, O, AD, aX, azb, ml, nU, bu, et, g, wB, BR, KU, bd, by, wd, pk, fD, vJ); #c1(LAMB3) c2(NP_001121113) c3(6080) c4(32194, 45251, 58308, 19137, 71365) c5(d, jh, by, A, aw, arT, b, aRL, re, XZ, Ya, J, bu, mk, Yb, Ir, Ur, e, iT, aG); #c1(LAMB4) c2(NP_031382) c3(6081) c4(32195, 45252, 58309, 19138, 71366) c5(cz); #c1(LAMC1) c2(NP_002284) c3(6082) c4(32196, 45253, 58310, 19139, 71367) c5(aSV, A, X, xQ, w, Ja, lu, KY, jw, m, AD, et, ml, B, q, bu, o, g, wB, bfV, BR, KU, bd, by, Ap, wd, ao, K, fD); #c1(LAMC2) c2(NP_005553) c3(6083) c4(32197, 45254, 58311, 19140, 71368) c5(aw, Zq, aiW, iX, iU, aN, eW, w, aXk, Vn, bu, aK, e, aWX, M, iy, tX, XZ, AX, do, amW, Pv, Qx, RQ, aXy, JI, ahM, aqQ, IU, aL, lb, bK, aHS, fO, ME, fl, aXr, IH, fx, jT, OA, pq, XY, aDJ, aFN, ro, fc, Ya, jh, rS, cT, xb, pH, i, aXi, aC, ael, RU, aXw, aEN, EO, mZ, bS, X, aXz, jz, eu, Kc, mk, NH, JE, ai, bF, cM, co, BL, pp, gd, pz, ml, f, aqU, aXq, ky, O, JX, cs, av, jq, em, SV, aWY, cJ, dc, v, kp, J, akT, Qz, afa, auw, aNO, fv, akG, Cs, aY, cf, jR, aXb, aG, ach, wt, b, Y, ami, aF, Dm, bg, XW, EG, aGX, d, ec, la, bb, eZ, aRL, jd, g, NJ, zm, ajJ, n, gu, ar, u, o, aaQ, Zz, Dg, aXm, cz, pB, sf, aFj, et, iw, ao, rQ, rq, tW, hT, HN, ajf, na, CL, xX, Xf, sc, di, acE, A, arT, eM, EE, aXt, aXs, abr, Oy, db, bj, U, dl, jQ, m, aXc, aX, oj, h, cU, tF, hN, y, aXl, aV, cV, hZ, aXu, P, T, aj, fT, by, vv, eJ, aXj, NG, xM, UE, cb, sp, bM, aT, at, vt); #c1(LAMC3) c2(NP_006050) c3(6084) c4(32198, 45255, 58312, 19141, 71369) c5(bYu, Wk, hT, cO); #c1(LAMP1) c2(NP_005552) c3(6085) c4(32199, 45256, 58313, 19142, 71370) c5(en, b, k, X, aF, sE, bg, U, bj, aW, aX, av, fy, V, LG, J, P, aJV, eq, jT, pS, cT, fl, wz, hT); #c1(LAMP2) c2(NP_001116078) c3(6086) c4(32200, 45257, 58314, 19143, 71371) c5(bn, b, nf, bg, ads, U, y, BM, oB, nU, mR, aKE, ju, oD, u, V, im, eq, cK, bnU, sK, dk, adw, aWz, ajg, ml); #c1(LAMP3) c2(NP_055213) c3(6087) c4(32201, 45258, 58315, 19144, 71372) c5(en, aw, b, awF, iU, fl, aEe, y, aX, bj, AX, ak, bu, dQ, ar, u, iT, awq, V, apx, aG, Yl, W, P, II, Ny, by, f, ji, re, alw); #c1(LAMTOR1) c2(NP_060377) c3(6088) c4(32202, 45259, 58316, 19145, 71373) c5(wa, aX, b, jd, f, q, fO, J, jF, n, iv, fs, aA, fy); #c1(LAMTOR2) c2(NP_001138736) c3(6089) c4(32203, 45260, 58317, 19146, 71374) c5(A, aw, b, dB, U, y, aX, f, q, ar, zQ, u, aEq, fU, V, bYv, by, Fo, T, jT, st, jR, cT, i); #c1(LAMTOR3) c2(NP_068805) c3(6090) c4(32204, 45261, 58318, 19147, 71375) c5(ag, u, y); #c1(LANCL1) c2(NP_001130047) c3(6091) c4(32205, 45262, 58319, 19148, 71376) c5(da, m, JH, V, ae, fc, fq, fP, cy, aeR, aG, P, dQ, aE, HE, aD, aX, U, aV, aeS); #c1(LANCL2) c2(NP_061167) c3(6092) c4(32206, 45263, 58320, 19149, 71377) c5(w, mD, en, fP); #c1(LAP3) c2(NP_056991) c3(6093) c4(32207, 45264, 58321, 19150, 71378) c5(cV, h, J, eu, cT, u, jU, pv); #c1(LAPTM4B) c2(NP_060877) c3(6094) c4(32208, 45265, 58322, 19151, 71379) c5(aw, b, gG, jc, iL, Oh, y, jh, co, re, f, q, bu, ik, cs, bm, iT, il, by, T, x, ad, u); #c1(LARGE) c2(XP_005261889) c3(6095) c4(32209, 45266, 58323, 19152, 71380) c5(oy, bYw, bm, el, bYx, xq, T, cO, kG, bxy, u, bq, xl); #c1(LARP1) c2(NP_056130) c3(6096) c4(32210, 45267, 58324, 19153, 71381) c5(b); #c1(LARP4) c2(NP_001164274) c3(6097) c4(32211, 45268, 58325, 19154, 71382) c5(kF); #c1(LARP6) c2(NP_060827) c3(6098) c4(32212, 45269, 58326, 19155, 71383) c5(aX, I, pp, pR, dB, jo, ff, i, O, aA, u, fx, y); #c1(LARP7) c2(NP_001253968) c3(6099) c4(32213, 45270, 58327, 19156, 71384) c5(avF, by, nU, bYy, bu); #c1(LARS2) c2(NP_056155) c3(6100) c4(32214, 45271, 58328, 19157, 71385) c5(EO, aQI, bYz, bb, I, SS, ak, pQ, bf, aM); #c1(LARS) c2(NP_064502) c3(6101) c4(32215, 45272, 58329, 19158, 71386) c5(EO, aQI, ak, bb, bYA, SS, f, bp, pQ, I, z, bf, aM); #c1(LAS1L) c2(NP_001164120) c3(6102) c4(32216, 45273, 58330, 19159, 71387) c5(beq); #c1(LASP1) c2(NP_001258537) c3(6103) c4(32217, 45274, 58331, 19160, 71388) c5(A, kY, b, X, fE, iL, U, y, jh, f, q, M, B, av, iR, V, dT, cz, T, fx, DP, u, jR, i); #c1(LAT2) c2(NP_115852) c3(6104) c4(32218, 45275, 58332, 19161, 71389) c5(M, fl, b, aiV, q, ih, h, pR); #c1(LAT) c2(NP_001014987) c3(6105) c4(32219, 45276, 58333, 19162, 71390) c5(A, b, adf, F, pR, gG, dB, w, z, e, O, hh, m, aX, aXh, B, je, aD, fy, iR, bev, d, dt, P, cy, PY, abf, fl, ji); #c1(LATS1) c2(NP_001257448) c3(6106) c4(32220, 45277, 58334, 19163, 71391) c5(aLt, fk, ahF, b, k, X, f, av, fy, u, y); #c1(LATS2) c2(XP_005266399) c3(6107) c4(32221, 45278, 58335, 19164, 71392) c5(jh, co, il, V, b, k, f, J, bp, cT, A, ik, B, iG, U, fy, u); #c1(LAXI) c2(NP_001129662) c3(6108) c4(32222, 45279, 58336, 19165, 71393) c5(di); #c1(LAYN) c2(NP_001245319) c3(6109) c4(32223, 45280, 58337, 19166, 71394) c5(ar); #c1(LBH) c2(NP_112177) c3(6110) c4(32224, 45281, 58338, 19167, 71395) c5(hR, cy); #c1(LBP) c2(NP_004130) c3(6111) c4(32225, 45282, 58339, 19168, 71396) c5(gK, aF, aFy, gE, vl, IE, bsa, qc, eX, g, hN, kg, bm, o, aNu, Zz, Ea, cs, gL, P, T, bq, x, aaa, dL, jU, xd, gs, nG, ex, aDL, aFk, bk, aFp, bh, aA, gf); #c1(LBR) c2(XP_005273182) c3(6112) c4(32226, 45283, 58340, 19169, 71397) c5(WH, ER, kE, b, eu, ix, oR, Iv, y, m, bYB, jT, aX, fq, h, f, jV, aoY, ar, cs, oO, aV, u, aE, g, bYC, bjC, J, ad, II, bYD, gn, cy, JN, cq, Dj, kM, P, asM, ag, cT, oi, btH, ji, fj, Dg, zD); #c1(LBX1) c2(XP_005269500) c3(6113) c4(32227, 45284, 58341, 19170, 71398) c5(by, f, gG, ck, bf, e, bkn, arl, b, kJ, t, axK, zb, fH, fe, bK, nz, iv, od, x, FW, jT, fp, su, Iq, M, ie, ag, cT, boO, aA, sa, avX, fi, X, jz, wy, pK, U, y, V, co, kH, anl, ak, bu, B, cs, bYE, av, iT, iF, anJ, hf, bDj, fJ, acL, W, pk, kD, hV, am, Un, ha, d, jh, bTc, re, nU, q, ar, VM, Sc, oO, jG, u, amO, Id, I, qL, yH, ad, qu, G, rO, ao, hX, he, yy, agf, o, aOB, af, agG, A, Lv, VY, bqc, jQ, wp, h, gT, cU, atg, Dd, cV, YR, J, dt, bYE, T, bKF, cz, aM, qp, xM, Ic, Nq, eG); #c1(LBX2) c2(NP_001009812) c3(6114) c4(32228, 45285, 58342, 19171, 71399) c5(TE); #c1(LCA5) c2(NP_001116241) c3(6115) c4(32229, 45286, 58343, 19172, 71400) c5(alM, nQ, nW, qu, nE, bYG, nR); #c1(LCAT) c2(NP_000220) c3(6116) c4(32230, 45287, 58344, 19173, 71401) c5(bP, dx, wm, bYH, ZG, eH, z, dv, or, ni, ev, o, fD, I, du, dK, dt, ZF, et, eU, fw, i, I, bq, aA, at, dF, ap); #c1(LCE1C) c2(NP_001263260) c3(6117) c4(32231, 45288, 58345, 19174, 71402) c5(aA, di, xe); #c1(LCE3A) c2(NP_848518) c3(6118) c4(32232, 45289, 58346, 19175, 71403) c5(da, fq); #c1(LCE3B) c2(NP_848520) c3(6119) c4(32233, 45290, 58347, 19176, 71404) c5(da, m, blY, aC, fq, xe, gj); #c1(LCE3C) c2(NP_848521) c3(6120) c4(32234, 45291, 58348, 19177, 71405) c5(da, m, blY, aC, fq, xe, qa, gj); #c1(LCE3D) c2(NP_115952) c3(6121) c4(32235, 45292, 58349, 19178, 71406) c5(da, JH); #c1(LCE3E) c2(NP_848522) c3(6122) c4(32236, 45293, 58350, 19179, 71407) c5(da, Ge, Gf); #c1(LCE5A) c2(NP_848525) c3(6123) c4(32237, 45294, 58351, 19180, 71408) c5(fg); #c1(LCK) c2(XP_011539756) c3(6124) c4(32238, 45295, 58352, 19181, 71409) c5(b, jz, eu, Iv, gE, bf, U, bYl, m, co, pw, t, F, q, jQ, cs, aCH, aM, u, aE, V, cV, J, ad, P, aZ, hR, pq, pb, jT, QJ, ie, G, cT); #c1(LCLAT1) c2(NP_001291374) c3(6125) c4(32239, 45296, 58353, 19182, 71410) c5(gd, gg, LR, cO); #c1(LCMT1) c2(NP_001027563) c3(6126) c4(32240, 45297, 58354, 19183, 71411) c5(Kj, o, cV); #c1(LCN1) c2(NP_001239546) c3(6127) c4(32241, 45298, 58355, 19184, 71412) c5(sE, b, an, f, gn, as, HE, iR, o); #c1(LCN2) c2(NP_005555) c3(6128) c4(32242, 45299, 58356, 19185, 71413) c5(dx, gK, B, axx, dN, gG, dB, w, cO, aw, OH, e, O, gO, dv, kJ, aFA, xc, aC, bK, du, zU, od, x, aVd, mm, pq, sS, aei, bm, ag, fD, fN, bq, aA, bP, id, X, eu, rd, mk, kY, bf, bw, U, y, ed, co, Ml, f, av, pP, iT, V, hf, aDM, v, cd, gv, bQ, aGU, iA, hw, aH, uJ, tl, zS, re, aG, bn, b, fl, ic, BQ, d, bb, Qu, hV, g, ar, fv, jG, u, dh, o, da, I, pF, aZ, et, et, jU, Yz, jH, ao, nV, ch, HN, aE, gd, bL, A, vd, di, ajb, m, PQ, il, h, aml, cU, tF, bmQ, aV, ma, Oq, J, W, P, IC, T, Oi, fP, atR, bh, pv); #c1(LCOR) c2(NP_001164237) c3(6129) c4(32243, 45300, 58357, 19186, 71414) c5(fN, aA, A, dL, B); #c1(LCP1) c2(XP_005266431) c3(6130) c4(32244, 45301, 58358, 19187, 71415) c5(dx, id, wm, b, X, dD, QY, eH, A, di, bf, U, aW, dv, aX, bn, B, q, aO, cB, cs, fP, av, fy, u, fU, V, I, jH, du, gm, J, Fy, T, eX, x, bb, fx, ad, baL, aM, rd, cT, fl, ZL, i, bq, aA, at, ap); #c1(LCP2) c2(NP_005556) c3(6131) c4(32245, 45302, 58359, 19188, 71416) c5(zS, VJ, dh, Ct, Cr); #c1(LCT) c2(NP_002290) c3(6132) c4(32246, 45303, 58360, 19189, 71417) c5(dx, aAZ, A, b, aiM, yU, bf, aMh, U, cp, bYJ, rr, B, bDb, tE, aRY, qu, aMi, u, aE, o, V, I, dA, du, eX, cV, rV, jU, jH, ch, bYK, xf, aA, ap); #c1(LDB1) c2(NP_001106878) c3(6133) c4(32247, 45304, 58361, 19190, 71418) c5(bP, d, pG, T, iv, e); #c1(LDB2) c2(NP_001124306) c3(6134) c4(32248, 45305, 58362, 19191, 71419) c5(bP, d, ak, bb, pG, dA, du, dv, T, dx, iv, bq, at, e); #c1(LDB3) c2(NP_001073583) c3(6135) c4(32249, 45306, 58363, 19192, 71420) c5(bgc, bra, f, kG, h, bYL, mR, bYM, aOI, WG, cg, cK, oD, aWu, sK); #c1(LDHA) c2(NP_001128711) c3(6136) c4(32250, 45307, 58364, 19193, 71421) c5(A, aw, b, X, pR, bYN, tR, kB, O, bw, ey, pz, y, jh, jT, vC, f, F, q, bu, do, mR, B, cB, cs, bv, oD, av, u, oP, I, cV, fO, bp, ad, dU, jo, T, ff, ar, cK, by, eQ, ag, bq, at, wX, cl, pv); #c1(LDHAL6B) c2(NPJ49972) c3(6137) c4(32251, 45308, 58365, 19194, 71422) c5(u); #c1(LDHB) c2(NP_002291) c3(6138) c4(32252, 45309, 58366, 19195, 71423) c5(A, aw, b, dB, tR, kY, wX, pz, y, jh, co, ni, B, q, ar, cs, bm, yJ, bp, ad, u, eQ, jR, bxG, ji); #c1(LDHC) c2(NP_059144) c3(6139) c4(32253, 45310, 58367, 19196, 71424) c5(NT, am, b, aZ, fy, pv); #c1(LDHD) c2(NP_705690) c3(6140) c4(32254, 45311, 58368, 19197, 71425) c5(em, co, fs, V, b, fi, ady, eu, ad, gX, T, pu, cs, x, ct, U, fy, baL); #c1(LDLRAD3) c2(NP_777562) c3(6141) c4(32255, 45312, 58369, 19198, 71426) c5(IV, cz); #c1(LDLRAD4) c2(NP_001003674) c3(6142) c4(32256, 45313, 58370, 19199, 71427) c5(Eo, bj, di, dA); #c1(LDLR) c2(NP_000518) c3(6143) c4(32257, 45314, 58371, 19200, 71428) c5(dx, en, tC, bYU, aN, eH, w, hM, bcf, Gk, bNP, aK, O, cp, dv, cy, Vx, XZ, dl, dD, n, azZ, aC, op, du, gJ, bYT, Gl, dL, gt, dS, Ic, os, aah, i, fN, bq, aA, bYR, bP, gE, Kt, dE, rd, fw, bo, bf, et, HI, U, aaw, y, ed, eD, f, cs, mm, bm, ZL, em, bYS, V, ae, nl, v, Fy, eX, dO, Oa, PY, dY, Im, wl, on, ap, bW, wm, b, jJ, eR, au, bYQ, AI, fD, aO, GE, bsL, bb, oB, vf, q, ac, jG, bYO, u, rX, o, wR, fs, I, gL, ad, wL, ao, LO, ch, gl, tb, Bm, th, I, bL, A, eZ, ZQ, gw, mW, di, C, eO, al, qG, m, qs, sG, h, fa, az, aE, aPA, ev, ma, ez, cV, J, dt, P, II, gF, bYP, aM, aLj, arq, ii, Ic, vW, auy, IN, at, bca); #c1(LD0C1) c2(NP_036449) c3(6144) c4(32258, 45315, 58372, 19201, 71429) c5(d, b, ag, cT, di, bw, e); #c1(LD0C1L) c2(NP_115663) c3(6145) c4(32259, 45316, 58373, 19202, 71430) c5(IV); #c1(LEAP2) c2(NP_443203) c3(6146) c4(32260, 45317, 58374, 19203, 71431) c5(P, pi); #c1(LECT1) c2(NP_001011705) c3(6147) c4(32261, 45318, 58375, 19204, 71432) c5(Qv, aw, b, vd, X, es, kB, aC, av); #c1(LECT2) c2(NP_002293) c3(6148) c4(32262, 45319, 58376, 19205, 71433) c5(jB, aC, adK, q, gE, aA, aG, bm, aT, gO); #c1(LEF1) c2(NP_001124185) c3(6149) c4(32263, 45320, 58377, 19206, 71434) c5(A, iL, b, cs, oX, C, aES, et, U, pz, oZ, y, bYV, m, co, aX, pp, ag, t, h, f, q, jV, bu, cU, hN, B, hb, iv, u, n, gG, V, hf, LR, J, ad, G, T, Qt, x, cr, iA, by, iw, jT, oW, hX, bjF, ie, iZ, aY, cT, CL, oY, ael, apU); #c1(LEFTY1) c2(NP_066277) c3(6150) c4(32264, 45321, 58378, 19207, 71435) c5(u, b); #c1(LEFTY2) c2(NP_001165896) c3(6151) c4(32265, 45322, 58379, 19208, 71436) c5(Ci, aua, AK, ar, eG, fp); #c1(LEKR1) c2(NP_001004316) c3(6152) c4(32266, 45323, 58380, 19209, 71437) c5(aV, bj); #c1(LEMD2) c2(NP_001137416) c3(6153) c4(32267, 45324, 58381, 19210, 71438) c5(m); #c1(LEMD3) c2(NP_055134) c3(6154) c4(32268, 45325, 58382, 19211, 71439) c5(blK, mk, ID, zM, bYW, aSN, No, bYX, bIT); #c1(LEO1) c2(NP_001273359) c3(6155) c4(32269, 45326, 58383, 19212, 71440) c5(h); #c1(LEP) c2(NP_000221) c3(6156) c4(32270, 45327, 58384, 19213, 71441) c5(dx, gK, by, en, aw, aeB, dD, ud, dB, aE, aN, eH, w, hM, ak, cO, baB, bf, O, aK, e, xl, cp, bYY, bQ, cy, qc, t, bba, bx, fP, om, do, jm, fH, si, bad, g, mz, eg, aqQ, C, p, yL, du, gm, bp, azo, jF, od, Gl, vM, x, hR, dL, kN, pq, wh, aV, fN, Dz, bY, tO, yE, i, dc, bSp, aA, Ah, bT, ib, Mb, bP, cC, td, iF, X, bjN, LM, rd, pX, ix, mA, bW, HI, U, TD, G, cM, bQL, co, pp, Dq, f, cs, akf, bu, Em, B, iv, av, fy, bm, ye, em, V, Bs, nl, cx, cd, bSL, gF, ad, dv, eX, bt, ar, Hh, bd, fJ, W, dO, ajo, py, aY, jA, nc, Fy, in, uK, rh, gA, sH, qO, UT, jP, fD, aG, aGU, b, ami, aF, jg, jJ, QY, DC, A, sU, z, aoi, ey, gZ, iA, d, Ag, btB, bb, eA, cz, q, ap, NJ, DZ, ff, hb, bYZ, jG, aM, u, nj, o, wR, da, kF, jE, I, UK, el, gL, eu, aHG, uQ, ct, aeC, et, Qx, Ha, P, jH, ao, mD, hX, ch, eQ, OV, he, dh, ih, aaf, rv, I, vZ, uE, Gn, bL, bCb, aiF, Nf, bo, sv, FE, IE, di, HS, JC, gE, al, hP, Ic, m, qs, aX, h, bQJ, blh, oE, cU, aC, Dd, y, cB, UV, ZU, aq, Ry, iq, ma, hW, cV, Be, sj, be, Dw, J, dt, jo, T, fO, aos, jl, Bb, Ap, qT, jT, aHE, ii, agl, hq, US, uG, Af, bh, at, eG, gl); #c1(LEPROTL1) c2(NP_001121680) c3(6157) c4(32271, 45328, 58385, 19214, 71442) c5(aA, fl); #c1(LETM1) c2(NP_036450) c3(6158) c4(32272, 45329, 58386, 19215, 71443) c5(co, S, nU, q, bp, axK, hS, fy, KE, AP, yv); #c1(LETMD1) c2(NP_001230618) c3(6159) c4(32273, 45330, 58387, 19216, 71444) c5(V, b, re, J, T, iT, O, U, u, y); #c1(LEUTX) c2(NP_001137304) c3(6160) c4(32274, 45331, 58388, 19217, 71445) c5(h); #c1(LFNG) c2(NP_001035257) c3(6161) c4(32275, 45332, 58389, 19218, 71446) c5(AY, u, bZa); #c1(LGALS12) c2(NP_001136007) c3(6162) c4(32276, 45333, 58390, 19219, 71447) c5(fy, b); #c1(LGALS13) c2(NP_037400) c3(6163) c4(32277, 45334, 58391, 19220, 71448) c5(gG, hq, cs, b, Tq, sH, hV, q, ad, A, od, B, cO, Bb, Tv, bm); #c1(LGALS14) c2(NP_064514) c3(6164) c4(32278, 45335, 58392, 19221, 71449) c5(fh, bb, Jy, jH, hY, bK, jU, aCD, cJ, aPu, bk, bq, at, CG, O, ap); #c1(LGALS16) c2(NP_001177370) c3(6165) c4(32279, 45336, 58393, 19222, 71450) c5(gG, b, Tq, hV, q, cO, Tv, bm); #c1(LGALS1) c2(NP_002296) c3(6166) c4(32280, 45337, 58394, 19223, 71451) c5(B, aw, gG, Vz, w, bf, e, O, cy, kJ, gB, yh, dl, fH, Hs, g, og, aC, sH, gm, fO, od, fx, jT, gg, ag, i, sa, X, arQ, mA, vp, U, y, co, pp, f, bu, cs, av, fy, iT, V, fJ, auK, ji, re, b, aF, Hr, d, PK, hV, q, u, da, ad, vw, ao, Eu, iR, eQ, iq, xU, fl, A, pR, HJ, pD, ds, C, jw, JK, aX, Ec, kn, F, oE, cV, be, Fs, J, P, T, II, jl, by, iB); #c1(LGALS2) c2(NP_006489) c3(6167) c4(32281, 45338, 58395, 19224, 71452) c5(fh, by, bb, ae, dP, aC, eX, fP, fw, bu, eW, T, xa, fD, bq, di, jU, at, aDt, aO, ap); #c1(LGALS3BP) c2(NP_005558) c3(6168) c4(32282, 45339, 58396, 19225, 71453) c5(A, b, X, ZM, gE, U, e, y, d, co, B, bu, cs, u, V, cV, aC, bp, by, P, x, ad, Pw, wV, wP); #c1(LGALS3) c2(NP_001170859) c3(6169) c4(32283, 45340, 58397, 19226, 71454) c5(dx, gK, B, aw, gG, dB, HG, bvH, w, cO, vp, O, dv, cy, IZ, iR, bnh, FN, bZb, g, og, arp, aC, du, gm, bp, Jj, x, fx, av, ag, cT, i, bq, aA, Dr, fi, cY, iP, jz, Bg, bf, bw, U, y, co, yE, f, bu, gX, k, cs, oD, gg, fy, bm, iT, iF, Bd, V, cK, aH, dP, Le, tl, ap, b, Mz, ic, z, aO, bb, jd, re, hV, q, jV, ra, ajJ, ar, yW, Tv, u, dh, fh, il, LR, aJX, gL, ad, jG, Ut, jH, ao, nV, ch, iq, xU, Bm, fl, yA, af, A, sO, di, C, iL, DK, jQ, m, aX, Qm, h, F, gT, ik, aE, fU, cV, J, W, T, j, by, aM, mb, Tq, fP, bh, at, Bi, rb, gl); #c1(LGALS4) c2(NP_006140) c3(6170) c4(32284, 45341, 58398, 19227, 71455) c5(en, aw, b, X, A, iL, gE, U, y, co, h, B, q, ar, av, u, fi, V, W, T, ao, YA, eG); #c1(LGALS7B) c2(NP_001035972) c3(6171) c4(32285, 45342, 58399, 19228, 71456) c5(d, tp, jT, aX, b, cV, an, re, bu, as, T, iT, i, cs, ajw, fx, by, u, e, y); #c1(LGALS8) c2(NP_006490) c3(6172) c4(32286, 45343, 58400, 19229, 71457) c5(A, b, B, co, T, hA, QJ, Up); #c1(LGALS9) c2(NP_002299) c3(6I73) c4(32287, 45344, 58401, 19230, 71458) c5(JH, Kt, b, jz, pD, NH, iL, eM, vp, U, e, y, jQ, d, aX, bX, q, bu, eE, ajJ, cs, fH, jG, u, jZ, aC, be, fO, ad, bR, P, T, IO, aCP, by, fJ, jU, jH, zE, NG, hq, bY, xU, gd, pH); #c1(LGALSL) c2(NP_054900) c3(6174) c4(32288, 45345, 58402, 19231, 71459) c5(B, b, X, dB, A, O, co, f, F, bu, ar, y, av, fy, u, ff, fU, cV, aC, bp, by, jo, qp, zM, ag, vJ, hd); #c1(LGI1) c2(NP_005088) c3(6175) c4(32289, 45346, 58403, 19232, 71460) c5(bZg, k, hY, bZc, bZd, HG, hS, w, gZ, cM, oy, jh, avQ, f, iZ, O, IL, CG, yJ, cV, bK, dt, T, bZe, ahT, FZ, g, hT, xo, bZf, dc, aY); #c1(LGI2) c2(NP_060646) c3(6176) c4(32290, 45347, 58404, 19233, 71461) c5(IL, hS, at); #c1(LGI4) c2(NP_644813) c3(6177) c4(32291, 45348, 58405, 19234, 71462) c5(akA, hS, CG, Id); #c1(LGMN) c2(NP_005597) c3(6178) c4(32292, 45349, 58406, 19235, 71463) c5(dx, sa, A, aw, b, asx, X, D, U, ajT, dv, f, q, bu, ky, B, av, aV, dh, GI, V, du, by, FZ, OI, Mq); #c1(LGR4) c2(NP_060960) c3(6179) c4(32293, 45350, 58407, 19236, 71464) c5(V, b, nU, bu, T, aqS, U, by, kl); #c1(LGR5) c2(NP_001264155) c3(6180) c4(32294, 45351, 58408, 19237, 71465) c5(aw, b, bx, w, bf, U, hP, O, oy, il, LI, q, bu, ik, cs, ar, g, V, I, aeM, bZh, ad, W, P, T, x, by, Oi, aA, at, iE); #c1(LGR6) c2(NP_001017403) c3(6181) c4(32295, 45352, 58409, 19238, 71466) c5(am, w, e, y, bbg, bZi, Jq, cU, u, d, hW, dn, I, Fw, avo, P, T, cy, bfD, eN, qp, ag, agc, aA, aX); #c1(LGSN) c2(NP_001137412) c3(6182) c4(32296, 45353, 58410, 19239, 71467) c5(co, b, asY, q, aFe, Um, bq); #c1(LHB) c2(NP_000885) c3(6183) c4(32297, 45354, 58411, 19240, 71468) c5(pM, o, A, kF, am, eG, avW, US, bZj, cz, di, y, UT, jw, Ap, u, biS, afm); #c1(LHCGR) c2(NP_000224) c3(6184) c4(32298, 45355, 58412, 19241, 71469) c5(An, b, afg, X, Lv, jj, jy, A, aoi, bbz, jw, y, bbg, bQ, bZi, am, UZ, wP, BI, bSX, PK, B, UV, bZk, cU, age, bZm, tg, av, u, o, vR, kF, fD, alX, vN, p, Fw, wV, vF, W, Hq, T, Ca, bb, cz, bZn, US, bZI, ck, eQ, yy, aga, Af, agc, PH, aA, afm); #c1(LHFP) c2(XP_011533163) c3(6185) c4(32299, 45356, 58413, 19242, 71470) c5(da, aHE, b, Qu, DC, vY, di, O, Xx, at, ib); #c1(LHFPL1) c2(XP_011529245) c3(6186) c4(32300, 45357, 58414, 19243, 71471) c5(vY); #c1(LHFPL2) c2(NP_005770) c3(6187) c4(32301, 45358, 58415, 19244, 71472) c5(fl); #c1(LHFPL3) c2(NP_945351) c3(6188) c4(32302, 45359, 58416, 19245, 71473) c5(bb, b, re, cz, w, di, aA, iT); #c1(LHFPL4) c2(XP_011531995) c3(6189) c4(32303, 45360, 58417, 19246, 71474) c5(re, iT, b); #c1(LHFPL5) c2(NP_872354) c3(6190) c4(32304, 45361, 58418, 19247, 71475) c5(bxr, bZo, Bx); #c1(LHPP) c2(NP_001161352) c3(6191) c4(32305, 45362, 58419, 19248, 71476) c5(cA); #c1(LHX1) c2(XP_011545112) c3(6192) c4(32306, 45363, 58420, 19249, 71477) c5(UF, bxK, b, bfV, dB); #c1(LHX2) c2(NP_004780) c3(6193) c4(32307, 45364, 58421, 19250, 71478) c5(b, aC, u, gv, mD, bh, jG, kD, biS, y, pq); #c1(LHX3) c2(NP_055379) c3(6194) c4(32308, 45365, 58422, 19251, 71479) c5(bBN, akh, bZp, acK, na, bHI, aA); #c1(LHX4) c2(NP_203129) c3(6195) c4(32309, 45366, 58423, 19252, 71480) c5(bZq, t, acK, uH, G, bHI, jG, biS); #c1(LHX5) c2(NP_071758) c3(6196) c4(32310, 45367, 58424, 19253, 71481) c5(bf); #c1(LHX6) c2(NP_001229262) c3(6197) c4(32311, 45368, 58425, 19254, 71482) c5(co, zb, b); #c1(LHX9) c2(NP_001014434) c3(6198) c4(32312, 45369, 58426, 19255, 71483) c5(O, k); #c1(LIAS) c2(NP_006850) c3(6199) c4(32313, 45370, 58427, 19256, 71484) c5(ake, MS, abu, i, I, bZs, f, ih, hS, bZr, bf, fx, Vn, aM); #c1(LIF) c2(XP_011528474) c3(6200) c4(32314, 45371, 58428, 19257, 71485) c5(dx, dB, w, cO, bf, e, O, dv, cy, cl, oJ, g, aC, du, ft, od, Jj, Lw, jT, fp, wh, fc, hn, OJ, ag, xb, fl, X, jz, wy, VG, y, co, uj, f, N, cs, av, bm, if, nl, bQ, PY, jR, yq, b, aO, d, Sa, bb, aWa, q, es, QE, u, fh, kF, I, ao, fr, ana, D, lv, jw, jQ, aX, h, M, n, UF, aV, HI, cV, ui, be, J, W, jo, T, nP, ac, aM, Kj, hq, iB, eG); #c1(LIFR) c2(XP_011512344) c3(6201) c4(32315, 45372, 58429, 19258, 71486) c5(A, b, cO, VG, U, y, cy, f, q, aWa, mR, cl, cs, av, bm, kF, V, be, J, ad, P, T, Jj, bZt, u, jR, fl); #c1(LIG1) c2(NP_001275992) c3(6202) c4(32316, 45373, 58430, 19259, 71487) c5(g, co, jl, pp, b, jd, fj, dB, Qz, ip, ag, bp, i, I, av, u, O); #c1(LIG3) c2(XP_005258027) c3(6203) c4(32317, 45374, 58431, 19260, 71488) c5(jh, ma, jl, V, ip, GK, GM, GB, ag, ik, y, i, I, bw, av, aV, u, fx, Fg, eq); #c1(LIG4) c2(XP_005254115) c3(6204) c4(32318, 45375, 58432, 19261, 71489) c5(Dr, QD, A, jT, b, Zx, F, eu, bZv, O, w, jR, eO, ajw, bf, U, e, cM, iy, d, co, aX, pp, ag, jd, t, h, f, CR, q, fy, gX, ar, y, cs, bw, av, aV, u, iT, g, V, wU, aC, hZ, bZu, fO, J, Qz, gv, dt, pr, bTu, Kv, QZ, cy, ad, aM, WZ, W, ao, nV, ip, iR, Dj, gd, cT, i, CV, bh, X, jl, qO); #c1(LILRA1) c2(NP_006854) c3(6205) c4(32319, 45376, 58433, 19262, 71490) c5(aC, m, et, aYA, gE); #c1(LILRA2) c2(NP_006857) c3(6206) c4(32320, 45377, 58434, 19263, 71491) c5(m, im, aC, KM, gE, aYA); #c1(LILRA3) c2(NP_001166125) c3(6207) c4(32321, 45378, 58435, 19264, 71492) c5(fc, aC, aV, gn, gE); #c1(LILRA4) c2(NP_036408) c3(6208) c4(32322, 45379, 58436, 19265, 71493) c5(cT, vQ); #c1(LILRA5) c2(NP_067073) c3(6209) c4(32323, 45380, 58437, 19266, 71494) c5(yh, Ck, gE); #c1(LILRB1) c2(NP_001075107) c3(6210) c4(32324, 45381, 58438, 19267, 71495) c5(en, b, bx, bWQ, aSB, w, bf, U, hP, y, m, co, BL, LI, DG, h, B, q, bu, X, O, A, cs, av, fy, u, gl, iT, V, I, aC, gL, ad, P, T, by, ac, aM, Ck, fG, ag, fP, aA, re); #c1(LILRB2) c2(NP_001265333) c3(6211) c4(32325, 45382, 58439, 19268, 71496) c5(m, fl, b, aC, h, W, P, fy); #c1(LILRB3) c2(XP_006726238) c3(6212) c4(32326, 45383, 58440, 19269, 71497) c5(LR, aZ); #c1(LILRB4) c2(XP_011546956) c3(6213) c4(32327, 45384, 58441, 19270, 71498) c5(jH, b, m, eu, mW, fP, bw, gl, ac); #c1(LILRB5) c2(NP_001074911) c3(6214) c4(32328, 45385, 58442, 19271, 71499) c5(fl); #c1(LIM2) c2(NP_001155220) c3(6215) c4(32329, 45386, 58443, 19272, 71500) c5(bZw, J); #c1(LIMAI) c2(NP_001230704) c3(6216) c4(32330, 45387, 58444, 19273, 71501) c5(A, aw, b, f, B, u, y); #c1(LIMCHI) c2(NP_001106188) c3(6217) c4(32331, 45388, 58445, 19274, 71502) c5(IV); #c1(LIMDI) c2(NP_055055) c3(6218) c4(32332, 45389, 58446, 19275, 71503) c5(d, co, b, ip, F, bp, u, e); #c1(LIMD2) c2(NP_085053) c3(6219) c4(32333, 45390, 58447, 19276, 71504) c5(u, cs, aw, y, ad); #c1(LIMKI) c2(NP_001191355) c3(6220) c4(32334, 45391, 58448, 19277, 71505) c5(eX, b, fr, mk, A, sF, xw, y, Co, bb, B, fy, u, fh, Qz, ft, IX, P, T, alM, iD, fw); #c1(LIMK2) c2(NP_001026971) c3(6221) c4(32335, 45392, 58449, 19278, 71506) c5(bP, NT, am, b, cV, f, wn, fD, U, jU, V); #c1(LIMS1) c2(NP_001180411) c3(6222) c4(32336, 45393, 58450, 19279, 71507) c5(d, IO, b, h, Hs, et, e, O); #c1(LIMS2) c2(NP_001129509) c3(6223) c4(32337, 45394, 58451, 19280, 71508) c5(bu); #c1(LIN28B) c2(NP_001004317) c3(6224) c4(32338, 45395, 58452, 19281, 71509) c5(aw, b, Zx, VG, bf, U, e, y, d, f, q, X, cs, av, fy, bm, fe, V, cV, ad, aM, u, bCb, jR, gd, xr, aA); #c1(LIN52) c2(NP_001019845) c3(6225) c4(32339, 45396, 58453, 19282, 71510) c5(at); #c1(LIN7A) c2(NP_004655) c3(6226) c4(32340, 45397, 58454, 19283, 71511) c5(Ag, aev, nU, T, Af, agL); #c1(LIN7B) c2(NP_071448) c3(6227) c4(32341, 45398, 58455, 19284, 71512) c5(rQ); #c1(LIN7C) c2(NP_060832) c3(6228) c4(32342, 45399, 58456, 19285, 71513) c5(d, aA, dj, I, e); #c1(UN9) c2(NP_001257338) c3(6229) c4(32343, 45400, 58457, 19286, 71514) c5(g, atK, cB, hR, u, y); #c1(LING01) c2(NP_001288126) c3(6230) c4(32344, 45401, 58458, 19287, 71515) c5(xg, GJ, bj, aV, er); #c1(LING02) c2(XP_011516032) c3(6231) c4(32345, 45402, 58459, 19288, 71516) c5(bb, dA, bm, xq, bq, aA, GJ, bj, Fg); #c1(LING04) c2(NP_001004432) c3(6232) c4(32346, 45403, 58460, 19289, 71517) c5(GJ, byO); #c1(LINS) c2(NP_001035706) c3(6233) c4(32347, 45404, 58461, 19290, 71518) c5(QZ, nU, bZx); #c1(LIPA) c2(NP_000226) c3(6234) c4(32348, 45405, 58462, 19291, 71519) c5(dx, fl, eZ, dD, eH, eY, iL, e, d, dv, dN, t, aEU, ar, bZy, o, aKN, du, LG, P, G, bq, aA, at, on, ap); #c1(LIPC) c2(XP_005254429) c3(6235) c4(32349, 45406, 58463, 19292, 71520) c5(dx, bL, bZz, Ym, Tl, bZA, aF, dD, ZG, eR, eH, vY, hM, eO, GV, bf, U, fD, ZH, oy, dv, bb, wd, yl, eX, AK, dl, aW, alx, fy, Uy, ZQ, o, ZL, mz, awy, V, I, sH, du, cx, dK, bd, Fy, aE, bq, jl, gF, hR, et, aM, ao, dO, dS, oo, ch, Ic, P, fw, tO, dh, dX, i, fN, I, di, aA, at, ap); #c1(LIPE) c2(NP_005348) c3(6236) c4(32350, 45407, 58464, 19293, 71521) c5(dx, b, QY, rd, wn, hM, U, ey, bQ, am, eX, q, bm, NT, kF, V, I, sH, du, cx, Fy, dv, aoT, Hh, gF, hR, tS, ii, bk, aA, at); #c1(LIPF) c2(NP_001185757) c3(6237) c4(32351, 45408, 58465, 19294, 71522) c5(eY, u, aKN, y); #c1(LIPG) c2(NP_006024) c3(6238) c4(32352, 45409, 58466, 19295, 71523) c5(dx, bL, id, dD, ZG, wy, di, oy, dv, eX, I, du, dK, P, aR, jC, qD, dS, mA, fD, bq, aA, at, ap); #c1(LIPH) c2(NP_640341) c3(6239) c4(32353, 45410, 58467, 19296, 71524) c5(Ym, bZA, yl, bZD, bZC, bZB); #c1(LIPI) c2(NP_001289927) c3(6240) c4(32354, 45411, 58468, 19297, 71525) c5(Tk, bZE, b); #c1(LIPN) c2(NP_001095939) c3(6241) c4(32355, 45412, 58469, 19298, 71526) c5(bw); #c1(LIPTI) c2(NP_057013) c3(6242) c4(32356, 45413, 58470, 19299, 71527) c5(ake, aF); #c1(LIPT2) c2(NP_001138341) c3(6243) c4(32357, 45414, 58471, 19300, 71528) c5(dA); #c1(LITAF) c2(NP_001129945) c3(6244) c4(32358, 45415, 58472, 19301, 71529) c5(aNN, ux, fl, b, cG, X, eR, Od, MC, qa, di, bf, U, kV, fx, y, bZE, wr, fr, wW, iv, av, u, ahe, pW, FD, V, el, yO, gm, YI, dt, P, T, ct, J, ac, xV, PL, iR, aE, Fg, i, afq, I, at, MQ, zD); #c1(LIX1) c2(NP_694966) c3(6245) c4(32359, 45416, 58473, 19302, 71530) c5(kz); #c1 (LLGL1) c2(NP_004131) c3(6246) c4(32360, 45417, 58474, 19303, 71531) c5(ih, pk, aX, V, b, Yk, h, q, bfX, W, T, alM, aFE, J, U, u, iA); #c1(LLGL2) c2(NP_001015002) c3(6247) c4(32361, 45418, 58475, 19304, 71532) c5(bb, b, aO, u, y, fh); #c1(LMAN1) c2(NP_005561) c3(6248) c4(32362, 45419, 58476, 19305, 71533) c5(fl, acm, cG, aE, qz, iL, ps, m, bqE, ae, Oj, gL, W, T, aUJ, hR, bpY, eN, nk, fP, aUR, at, ap); #c1(LMAN1L) c2(NP_068591) c3(6249) c4(32363, 45420, 58477, 19306, 71534) c5(qa); #c1 (LMAN2L) c2(NP_001135764) c3(6250) c4(32364, 45421, 58478, 19307, 71535) c5(ak, dB); #c1(LMBR1) c2(NP_071903) c3(6251) c4(32365, 45422, 58479, 19308, 71536) c5(atj, bZI, aoG, bZH, arm, Ak, bZG, bDn, bZJ, zW); #c1(LMBRD1) c2(NP_060838) c3(6252) c4(32366, 45423, 58480, 19309, 71537) c5(bZK); #c1(LMBRD2) c2(NP_001007528) c3(6253) c4(32367, 45424, 58481, 19310, 71538) c5(t); #c1(LMCD1) c2(NP_001265162) c3(6254) c4(32368, 45425, 58482, 19311, 71539) c5(BO, f, q); #c1(LMF1) c2(NP_073610) c3(6255) c4(32369, 45426, 58483, 19312, 71540) c5(bn, wm, bZL, ZJ, Hh, ac); #c1 (LMLN) c2(NP_001129521) c3(6256) c4(32370, 45427, 58484, 19313, 71541) c5(A, kE, Ob, F, DQ, dB, Ip, w, rv, EG, Eh, U, Uq, vl, y, jh, aDi, co, aX, bTc, asy, h, B, bOx, q, bu, ar, oJ, qw, NB, fy, u, iT, da, PJ, fU, V, ae, kt, J, by, wh, T, II, asz, OA, b, an, qp, eV, qG, PY, dY, aDE, ag, agw, acF, xX, VT, eG, re, aDD, ap); #c1(LMNA) c2(NP_001244303) c3(6257) c4(32371, 45428, 58485, 19314, 71542) c5(dx, ml, pV, dN, gG, dB, dv, cO, aw, bZS, xl, gO, bQ, t, Li, nm, kz, mR, aak, mz, IO, bZU, nl, du, gm, aiL, hR, gg, VQ, bgc, aPc, aaz, bAU, mx, fD, aA, bT, Mb, Dr, sm, cG, fE, bZR, bf, U, y, rN, co, DG, cK, f, beP, cc, Kb, bZT, B, oD, hj, bma, em, V, v, afn, afz, bNM, eX, rT, Hh, azC, EE, ji, aHB, b, bL, uC, QY, AA, Lg, gF, aoa, bb, Iz, jV, QX, mL, ar, YU, jG, sK, u, o, PJ, Ik, kF, I, qL, sX, avo, dT, by, Rk, G, rw, uQ, Nh, rO, GW, DP, aWN, art, iR, aCp, bAF, mA, na, fl, af, BK, ats, KG, bZM, A, asx, xj, gw, FM, bZO, di, iL, bZQ, bxN, bZP, jb, m, adx, cr, or, bLu, pC, Gw, cB, qB, aV, kG, cV, Be, J, dt, P, T, bZN, nP, AP, ac, aM, wU, jT, agl, Y, aTs, avB, aWz, anz, at); #c1(LMNBI) c2(NP_005564) c3(6258) c4(32372, 45429, 58486, 19315, 71543) c5(dx, ml, fl, b, QY, kV, dv, f, g, bZW, aV, bm, bZV, cJ, du, jE, v, bel, rT, an, dO, Ic, ag, fl); #c1(LMNB2) c2(NP_116126) c3(6259) c4(32373, 45430, 58487, 19316, 71544) c5(aSV, AD, wB, BR, FM, wd, ml, KU, bd, jV, bu, xQ, fD, Hh, KY, by, et, Mb); #c1(LMNTD1) c2(NP_001139199) c3(6260) c4(32374, 45431, 58488, 19317, 71545) c5(cO, Bm, dA); #c1(LMO1) c2(NP_001257357) c3(6261) c4(32375, 45432, 58489, 19318, 71546) c5(oy, G, V, b, u, t, cV, jz, J, fw, cT, Iv, iv, bf, U, apT, y, jQ); #c1(LMO2) c2(NP_001135787) c3(6262) c4(32376, 45433, 58490, 19319, 71547) c5(A, b, jz, eu, Iv, y, jQ, Ml, t, h, B, M, jS, cB, iv, HE, u, cV, qL, gm, bp, J, G, fH, pw, jT, fJ, ag, i, I); #c1(LMO3) c2(NP_001001395) c3(6263) c4(32377, 45434, 58491, 19320, 71548) c5(f, b, bZX, bMH, jJ, GF, aWt, co, ak, hB, ar, zb, bZY, QJ, hW, cV, Jt, aqi, bdz, Wj, Sp, Ew, fy, amD, Eo, aop, ji, aA, aUr, Gn); #c1(LMO7) c2(NP_005349) c3(6264) c4(32378, 45435, 58492, 19321, 71549) c5(oy, oD, A, aE, b); #c1(LMOD1) c2(NP_036266) c3(6265) c4(32379, 45436, 58493, 19322, 71550) c5(acE, ii, bj, i, aE, aaR, I, iu, eG); #c1(LMOD3) c2(NP_001291347) c3(6266) c4(32380, 45437, 58494, 19323, 71551) c5(AC); #c1(LMTK2) c2(NP_055731) c3(6267) c4(32381, 45438, 58495, 19324, 71552) c5(Eo, ji, A, ar, B); #c1(LMTK3) c2(NP_001073903) c3(6268) c4(32382, 45439, 58496, 19325, 71553) c5(by, u, y, bu); #c1(LMX1A) c2(NP_001167540) c3(6269) c4(32383, 45440, 58497, 19326, 71554) c5(aw, I, X, re, bu, Eo, di, i, av, by, bj, fx, iT, cp); #c1(LMX1B) c2(NP_001167617) c3(6270) c4(32384, 45441, 58498, 19327, 71555) c5(AI, b, X, Nq, eH, caa, Ni, xg, cA, bj, qr, bbL, av, CH, Yj, fe, hW, ez, dA, tz, cz, et, pG, byr, er, bUt, bZZ, iV, Ns, sU); #c1(LNPEP) c2(NP_005566) c3(6271) c4(32385, 45442, 58499, 19328, 71556) c5(aw, b, X, dB, di, Ku, gE, bf, U, al, y, Ne, awa, cy, aej, wP, uj, IO, q, cU, ar, ff, cs, av, u, sH, oN, Bc, da, si, V, I, aC, ui, fl, ad, ee, P, od, aM, wV, dP, bm, eB, gA, Af, awb, avZ, aA, ap); #c1(LNX1) c2(NP_116011) c3(6272) c4(32386, 45443, 58500, 19329, 71557) c5(oy, ml, w, Eo, aaB, cab, Io, sD, ha, O, Gn); #c1(LNX2) c2(NP_699202) c3(6273) c4(32387, 45444, 58501, 19330, 71558) c5(bq, U, jT, V); #c1(LOC100288966) c2(NP_001244291) c3(6274) c4(32388, 45445, 58502, 19331, 71559) c5(A, b, X, B, ck, av, u, y); #c1 (LOC101060321) c2(NP_001278391) c3(6275) c4(32389, 45446, 58503, 19332, 71560) c5(A, B); #c1 (LOC102723475) c2(XP_006724009) c3(6276) c4(32390, 45447, 58504, 19333, 71561) c5(bUC); #c1 (LOC102723996) c2(XP_006723962) c3(6277) c4(32391, 45448, 58505, 19334, 71562) c5(WH, aX, Kt, DG, NG, aC, h, sS, J, BL, bu, jH, aaZ, NH, pH, PI, by, aE, O, cy); #c1(LOC102724127) c2(XP_011544335) c3(6278) c4(32392, 45449, 58506, 19335, 71563) c5(b); #c1 (LOC102724560) c2(XP_011544402) c3(6279) c4(32393, 45450, 58507, 19336, 71564) c5(bP, bL, IJ, nU, fO, dN, fN, X, aF, aBX, Nr, jK, aBV, xf, sF, dx, ct, bf, U, ex, hP, aO, jl, co, bb, b, pp, Qm, ni, h, f, q, bu, eE, tE, A, cs, nA, av, u, o, sE, si, V, gJ, du, aza, J, Zr, ad, dt, vc, dv, T, bp, be, fx, cz, dL, aM, jg, aq, bm, fw, B, by, jd, fP, Nn, i, aBY, bh, aA, at, mo, vj, y, ap); #c1(LOC102724770) c2(XP_006724997) c3(6280) c4(32394, 45451, 58508, 19337, 71565) c5(ih, afb, K, cz); #c1(LOC102725016) c2(XP_006725712) c3(6281) c4(32395, 45452, 58509, 19338, 71566) c5(vQ); #c1 (LOC102725035) c2(XP_006726376) c3(6282) c4(32396, 45453, 58510, 19339, 71567) c5(LR); #c1(LOC400499) c2(XP_006721060) c3(6283) c4(32397, 45454, 58511, 19340, 71568) c5(at); #c1(LOC400927-CSNKIE) c2(NP_001276841) c3(6284) c4(32398, 45455, 58512, 19341, 71569) c5(A, b, aqu, ak, he, NJ, B, amb, u, y, aWt); #c1(LOC645177) c2(XP_011519208) c3(6285) c4(32399, 45456, 58513, 19342, 71570) c5(bq); #c1(LONP1) c2(NP_001263408) c3(6286) c4(32400, 45457, 58514, 19343, 71571) c5(vq, A, yn, b, GD, rR, gw, sv, z, w, Iv, bRc, cO, bf, e, y, d, jh, ag, co, bi, kJ, h, f, F, bu, B, cs, CL, fy, u, dh, fh, aP, Mi, gm, fO, J, IR, IX, P, T, fH, Hh, by, fJ, aM, jT, cac, hX, cT, IS, cK); #c1(LONRF1) c2(NP_689484) c3(6287) c4(32401, 45458, 58515, 19344, 71572) c5(oy, U); #c1(LOR) c2(NP_000418) c3(6288) c4(32402, 45459, 58516, 19345, 71573) c5(arM, d, bCu, bVx, b, fq, cn, bod, e, da, mk, jz, ic, Xx, Jk, jQ, bT, dw); #c1(LOXHD1) c2(NP_001138944) c3(6289) c4(32403, 45460, 58517, 19346, 71574) c5(cad, LK, bCN); #c1(LOX) c2(NP_002308) c3(6290) c4(32404, 45461, 58518, 19347, 71575) c5(dx, B, dN, dD, cae, w, lu, cU, Ux, pz, e, U, cp, bQ, Vx, alx, jm, R, du, Ij, bp, ft, vc, x, fx, hR, av, su, jE, we, ag, i, bT, Nn, cY, mk, sF, bw, U, y, ed, co, sT, pp, f, bu, cs, gg, fy, bm, em, V, v, cd, dv, jC, dy, fK, ap, wj, b, caf, ha, d, jh, ala, dw, g, es, X, vu, u, dr, amO, aly, sz, qL, by, ct, ao, aOB, bL, A, fd, fr, di, alu, iL, gE, aX, Ex, Jf, Jk, xt, P, T, fO, ad, js, zG, at); #c1(LOXL1) c2(NP_005567) c3(6291) c4(32405, 45462, 58519, 19348, 71576) c5(lg, b, wj, sF, Ux, y, brG, sr, f, md, qr, vu, aW, Jf, xt, gg, u, cag, ez, fx, er, bEV, i, ap); #c1(LOXL2) c2(NP_002309) c3(6292) c4(32406, 45463, 58520, 19349, 71577) c5(aw, b, gG, sF, iL, gE, U, e, y, d, jh, bu, vu, ar, ik, gg, QJ, u, V, il, by, T, x, mO, wU, Tu, Ol, fK, bT); #c1(LOXL3) c2(NP_001276093) c3(6293) c4(32407, 45464, 58521, 19350, 71578) c5(T, u, y, OI, sF); #c1(LOXL4) c2(NP_115587) c3(6294) c4(32408, 45465, 58522, 19351, 71579) c5(d, b, eG, F, IX, T, sF, i, fx, Co, u, e, y); #c1(LPA) c2(NP_005568) c3(6295) c4(32409, 45466, 58523, 19352, 71580) c5(bP, bL, wa, gk, MZ, b, X, dD, ZG, eR, eH, vY, id, di, sF, dx, eO, wf, bf, U, bu, hP, fD, aO, gs, dv, bb, ml, B, q, jV, cah, dl, fr, y, A, cs, av, aV, u, wY, o, fh, aE, du, nf, V, I, aC, sH, LR, bd, cd, ad, P, nk, T, eS, acD, x, cy, fx, ft, et, aA, eN, bvH, an, dO, tl, dS, bm, Ic, nJ, tO, by, gd, cT, xb, i, bg, al, at, on, ap); #c1(LPAR1) c2(XP_005251839) c3(6296) c4(32410, 45467, 58524, 19353, 71581) c5(wa, Fd, b, cG, X, dB, bvH, A, dV, O, bw, U, cM, m, co, ag, h, f, q, bu, fr, dZ, y, cs, av, u, ma, V, I, aC, LR, ad, W, x, by, ft, AP, gg, aY, B, ih, gd, xr, dc, at); #c1(LPAR2) c2(XP_011526723) c3(6297) c4(32411, 45468, 58525, 19354, 71582) c5(ak, b, yu, eu, O, hS, yD, w, di, yx, yn, cO, O, A, yv, y, yy, qs, co, aX, I, ag, yl, re, f, F, ys, oE, yp, X, yF, B, cB, cs, aD, yA, av, yB, u, el, iT, V, VD, qL, nW, fO, yz, ad, P, cU, yk, bp, uw, x, cy, iA, jv, jC, gg, yG, ym, yr, gd, cT, gu, il, aC, T, aA, yn); #c1(LPAR3) c2(XP_011539451) c3(6298) c4(32412, 45469, 58526, 19355, 71583) c5(A, b, X, eu, w, O, e, y, d, aX, re, B, q, Jq, cs, av, u, aE, iT, hW, V, I, aC, Fw, ad, P, cy, eN, qp, bm, ag, dn, aA, at, eG); #c1(LPAR6) c2(NP_001155970) c3(6299) c4(32413, 45470, 58527, 19356, 71584) c5(jH, caj, Ym, b, bZA, yl, aey, cai, i, alx, fx); #c1(LPCAT1) c2(NP_079106) c3(6300) c4(32414, 45471, 58528, 19357, 71585) c5(bq, bm, g); #c1(LPCAT2) c2(NP_060309) c3(6301) c4(32415, 45472, 58529, 19358, 71586) c5(O, kF, V, b); #c1(LPCAT3) c2(NP_005759) c3(6302) c4(32416, 45473, 58530, 19359, 71587) c5(qs, di, q); #c1(LPCAT4) c2(NP_705841) c3(6303) c4(32417, 45474, 58531, 19360, 71588) c5(U, V); #c1(LPGAT1) c2(NP_055688) c3(6304) c4(32418, 45475, 58532, 19361, 71589) c5(cA, aA, fl); #c1(LPIN1) c2(NP_001248356) c3(6305) c4(32419, 45476, 58533, 19362, 71590) c5(f, b, di, yn, aoK, cak, dL, re, ak, as, iT, em, jB, kF, I, an, bTj, eX, Hh, gF, GW, Y, ch, fD, fN, aA, ap); #c1(LPIN2) c2(NP_055461) c3(6306) c4(32420, 45477, 58534, 19363, 71591) c5(em, cal, I, bvK, adH, bw, aA, pg); #c1(LPL) c2(NP_000228) c3(6307) c4(32421, 45478, 58535, 19364, 71592) c5(dx, dM, dD, aN, eH, bn, bf, eP, aK, aGC, dv, et, dI, Zl, jm, mR, ju, mz, sH, du, aaq, bp, gY, QY, x, hR, dL, dS, fN, tO, cT, ZJ, i, Hd, bq, aA, ug, id, td, wK, He, wd, ZG, wy, rd, pX, ZH, wP, B, bu, oD, mm, fy, bm, em, bYS, V, v, wV, Fy, eX, Vm, cK, baL, cap, oo, P, dY, vH, gA, T, aau, ap, aan, afE, uy, wm, b, fQ, eR, vY, z, cao, ey, fD, aO, Ag, Er, bb, om, aam, bX, q, dQ, aJ, sR, Km, ar, u, dh, o, fh, Tl, jj, I, fz, dK, aoT, uw, can, Ha, jH, ao, RT, ch, eQ, mA, aE, bHY, bpF, ZL, th, I, vZ, bL, A, gU, fr, gE, di, fw, eO, aW, oy, m, qs, aX, wG, avW, az, bZL, ev, Ry, fk, fU, bd, dt, ZK, cam, gL, jl, gF, ft, aM, Ic, fP, Af, at); #c1(LPO) c2(NP_001153574) c3(6308) c4(32422, 45479, 58536, 19365, 71593) c5(g, u, kC, rB, bj, y); #c1(LPP) c2(NP_001161143) c3(6309) c4(32423, 45480, 58537, 19366, 71594) c5(B, b, ig, A, di, bo, U, e, y, d, bQ, aX, h, f, cU, qB, oD, u, aE, ax, kF, V, dA, iv, cy, oV, dH, aHE, bus, ib); #c1(LPPR2) c2(NP_001164106) c3(6310) c4(32424, 45481, 58538, 19367, 71595) c5(ahc, bjy, aBt, bjx, caq); #c1(LPPR4) c2(XP_011540800) c3(6311) c4(32425, 45482, 58539, 19368, 71596) c5(b, TU, f, ag, u, y); #c1(LPXN) c2(NP_001137467) c3(6312) c4(32426, 45483, 58540, 19369, 71597) c5(A, h, B, ar, ew, jT); #c1(LRAT) c2(NP_001288574) c3(6313) c4(32427, 45484, 58541, 19370, 71598) c5(pk, A, car, b, nQ, aX, ml, B, DO, cat, cas, nW, fC, i, nE, aTd, nR, Nx, OZ, o); #c1(LRBA) c2(NP_006717) c3(6314) c4(32428, 45485, 58542, 19371, 71599) c5(cau, aw, b, dA); #c1(LRCH1) c2(NP_001157683) c3(6315) c4(32429, 45486, 58543, 19372, 71600) c5(W, kB, U, T, V); #c1(LRCH4) c2(NP_002310) c3(6316) c4(32430, 45487, 58544, 19373, 71601) c5(iP, b); #c1(LRFN2) c2(NP_065788) c3(6317) c4(32431, 45488, 58545, 19374, 71602) c5(qf, ik); #c1 (LRFN5) c2(NP_689660) c3(6318) c4(32432, 45489, 58546, 19375, 71603) c5(eo); #c1(LRG1) c2(NP_443204) c3(6319) c4(32433, 45490, 58547, 19376, 71604) c5(tp, b, cV, aC, cU, iA, jU, jH); #c1(LRGUK) c2(NP_653249) c3(6320) c4(32434, 45491, 58548, 19377, 71605) c5(oy, I, eO); #c1(LRIF1) c2(XP_011540070) c3(6321) c4(32435, 45492, 58549, 19378, 71606) c5(fs); #c1(LRIG1) c2(NP_056356) c3(6322) c4(32436, 45493, 58550, 19379, 71607) c5(A, b, k, X, dB, w, U, iA, O, d, co, B, e, cO, y, av, u, V, W, Ql, fx, cT, i, at); #c1(LRIG3) c2(NP_001129523) c3(6323) c4(32437, 45494, 58551, 19380, 71608) c5(g, iF, awX, b, jh, ag, w, O, i, cO, fx, u, y, cq); #c1(LRIT1) c2(NP_056428) c3(6324) c4(32438, 45495, 58552, 19381, 71609) c5(aX, aGt, Fw, nl, aZB, JC, aZD, yC); #c1(LRIT3) c2(NP_940908) c3(6325) c4(32439, 45496, 58553, 19382, 71610) c5(cav, oy); #c1(LRMP) c2(NP_006143) c3(6326) c4(32440, 45497, 58554, 19383, 71611) c5(ji, co, ar, bp, bg); #c1(LRP10) c2(NP_054764) c3(6327) c4(32441, 45498, 58555, 19384, 71612) c5(o, cV); #c1(LRP12) c2(NP_001129175) c3(6328) c4(32442, 45499, 58556, 19385, 71613) c5(Ge, il, V, b, Gf, er, q, ad, cs, bq, U, u, y); #c1(LRP1B) c2(NP_061027) c3(6329) c4(32443, 45500, 58557, 19386, 71614) c5(oy, d, aX, b, dA, cV, jh, dB, caw, e, vL, cp); #c1(LRP1) c2(NP_002323) c3(6330) c4(32444, 45501, 58558, 19387, 71615) c5(dx, bL, vf, b, X, cs, jz, aN, eH, w, di, Iv, cA, bW, O, jQ, A, jD, y, cp, cU, wo, co, aX, sG, t, h, f, q, es, QP, ar, B, iv, av, fy, u, dh, o, G, fU, I, cV, aC, du, fO, v, bp, xs, QP, axl, dv, T, cd, bq, J, yG, aL, nV, dS, bm, Bu, P, vW, eB, Fv, cax, ji, aA, at); #c1(LRP2BP) c2(NP_060879) c3(6331) c4(32445, 45502, 58559, 19388, 71616) c5(r0); #c1(LRP2) c2(NP_004516) c3(6332) c4(32446, 45503, 58560, 19389, 71617) c5(jJ, A, td, b, dD, dB, aN, eC, WA, di, bNP, aw, aK, aNQ, y, awl, aTd, ag, ni, AP, amK, B, wN, aC, ff, cay, as, TW, u, jF, o, fD, cV, an, aPA, aZp, ft, P, pt, IH, bKB, et, eH, aai, ch, iq, zM, na, arA, vJ, bM); #c1(LRP4) c2(NP_002325) c3(6333) c4(32447, 45504, 58561, 19390, 71618) c5(xQ, xz, jT, or, cV, cp, Ak, aEa, cT, zM, aUC, iB, aOz, aUA, o, aG); #c1(LRP5) c2(NP_002326) c3(6334) c4(32448, 45505, 58562, 19391, 71619) c5(dx, wa, aAV, AI, b, akl, fr, ia, dD, eu, HC, A, yU, caA, bW, HJ, bf, aW, cp, bsL, zM, dv, bb, t, ml, f, arm, nv, cd, jF, byn, B, aRY, YR, Tr, aSi, aE, o, nl, kF, V, Eg, aC, nl, du, fO, caC, ft, dt, arg, eX, bfP, Tp, zl, ac, aM, aoO, jH, jT, at, caD, azr, hyp, caB, bHj, th, aof, et, bYQ, i, bg, I, di, aA, caz, caE, arJ, bef); #c1(LRP6) c2(NP_002327) c3(6335) c4(32449, 45506, 58563, 19392, 71620) c5(caG, caE, aAZ, arm, yU, kY, wf, y, cp, jh, b, eX, q, aW, aRY, u, aE, o, fs, V, Eg, jH, eF, azr, i, I, at, kD, arJ); #c1(LRPAP1) c2(NP_002328) c3(6336) c4(32450, 45507, 58564, 19393, 71621) c5(A, cal, b, X, pR, dB, eC, au, hM, bD, cp, co, bb, VD, B, q, bu, az, Ch, av, Uy, o, caH, aC, qC, v, j, T, aeC, nV, Bu, os, bFg, I, i, bq); #c1(LRPPRC) c2(NP_573566) c3(6337) c4(32451, 45508, 58565, 19394, 71622) c5(ake, f, b, bx, X, cO, YB, z, aGX, bmo, y, jR, aX, ag, t, h, B, q, yE, bu, caJ, jU, iv, mR, av, u, o, g, gG, rN, I, aC, bj, be, v, fO, J, dt, P, II, ar, by, ac, yG, acU, bm, G, Jj, gd, fP, bq, aA, re, pv); #c1(LRR1) c2(NP_689542) c3(6338) c4(32452, 45509, 58566, 19395, 71623) c5(yY, pV, gB); #c1(LRRC15) c2(NP_001128529) c3(6339) c4(32453, 45510, 58567, 19396, 71624) c5(b, Be, YA, gL, qL, o, u, y); #c1(LRRC16A) c2(NP_001167448) c3(6340) c4(32454, 45511, 58568, 19397, 71625) c5(nX); #c1(LRRC16B) c2(NP_612369) c3(6341) c4(32455, 45512, 58569, 19398, 71626) c5(kF); #c1(LRRC17) c2(NP_005815) c3(6342) c4(32456, 45513, 58570, 19399, 71627) c5(J); #c1(LRRC18) c2(XP_011538131) c3(6343) c4(32457, 45514, 58571, 19400, 71628) c5(m, dA); #c1(LRRC1) c2(NP_060684) c3(6344) c4(32458, 45515, 58572, 19401, 71629) c5(di); #c1(LRRC20) c2(NP_001265141) c3(6345) c4(32459, 45516, 58573, 19402, 71630) c5(m, at); #c1(LRRC26) c2(NP_001013675) c3(6346) c4(32460, 45517, 58574, 19403, 71631) c5(A, u, y, b, B); #c1(LRRC30) c2(NP_001099051) c3(6347) c4(32461, 45518, 58575, 19404, 71632) c5(cV); #c1(LRRC32) c2(XP_005273959) c3(6348) c4(32462, 45519, 58576, 19405, 71633) c5(aDY, aIE, aDX, ow, Xx); #c1(LRRC37A) c2(NP_055649) c3(6349) c4(32463, 45520, 58577, 19406, 71634) c5(nU); #c1(LRRC37B) c2(NP_443120) c3(6350) c4(32464, 45521, 58578, 19407, 71635) c5(xr, xJ, AP, or); #c1(LRRC39) c2(XP_011538980) c3(6351) c4(32465, 45522, 58579, 19408, 71636) c5(cK, f, o); #c1(LRRC49) c2(NP_060161) c3(6352) c4(32466, 45523, 58580, 19409, 71637) c5(u, y); #c1(LRRC4B) c2(XP_011525822) c3(6353) c4(32467, 45524, 58581, 19410, 71638) c5(dA); #c1(LRRC4C) c2(NP_001245348) c3(6354) c4(32468, 45525, 58582, 19411, 71639) c5(cy, td); #c1(LRRC4) c2(XP_011514763) c3(6355) c4(32469, 45526, 58583, 19412, 71640) c5(g, ao, A, Mi, B, QI, jo, w, ff, O, u, y); #c1(LRRC52) c2(NP_001005214) c3(6356) c4(32470, 45527, 58584, 19413, 71641) c5(di, cp); #c1(LRRC59) c2(NP_060979) c3(6357) c4(32471, 45528, 58585, 19414, 71642) c5(co, cr, ad, fl, cs, ct, cq); #c1(LRRC61) c2(XP_011514822) c3(6358) c4(32472, 45529, 58586, 19415, 71643) c5(fP); #c1(LRRC63) c2(NP_001269389) c3(6359) c4(32473, 45530, 58587, 19416, 71644) c5(sX); #c1(LRRC69) c2(NP_001123362) c3(6360) c4(32474, 45531, 58588, 19417, 71645) c5(cV, cO); #c1(LRRC6) c2(NP_036604) c3(6361) c4(32475, 45532, 58589, 19418, 71646) c5(MW, CI, caK, Pu); #c1(LRRC74A) c2(NP_919263) c3(6362) c4(32476, 45533, 58590, 19419, 71647) c5(at); #c1(LRRC7) c2(XP_011540138) c3(6363) c4(32477, 45534, 58591, 19420, 71648) c5(di, xl, fl, bM, aE, dd); #c1(LRRC8A) c2(NP_062540) c3(6364) c4(32478, 45535, 58592, 19421, 71649) c5(caL, Zg); #c1(LRRC8C) c2(XP_011540584) c3(6365) c4(32479, 45536, 58593, 19422, 71650) c5(ak); #c1(LRRCC1) c2(NP_208325) c3(6366) c4(32480, 45537, 58594, 19423, 71651) c5(aF, sE, Zr, Zm); #c1(LRRFIP1) c2(NP_001131022) c3(6367) c4(32481, 45538, 58595, 19424, 71652) c5(bb, V, w, T, bq, U, eF); #c1(LRRFIP2) c2(NP_001127841) c3(6368) c4(32482, 45539, 58596, 19425, 71653) c5(Ce, b); #c1(LRRK1) c2(XP_011520315) c3(6369) c4(32483, 45540, 58597, 19426, 71654) c5(bj, amc); #c1(LRRK2) c2(NP_940980) c3(6370) c4(32484, 45541, 58598, 19427, 71655) c5(acE, bUg, id, bS, b, asx, abo, caM, dB, bg, HS, ai, xw, bj, y, Jy, ec, caN, f, acO, NJ, afl, OA, Wy, u, o, hW, nQ, afx, GS, v, Oc, GR, aj, jU, ao, amc, acN, xM, HN, fP, Bm, cV, Xf, bM, yA, GJ, eG); #c1(LRRN1) c2(NP_065924) c3(6371) c4(32485, 45542, 58599, 19428, 71656) c5(oy, ho, b, cV); #c1(LRRN2) c2(NP_006329) c3(6372) c4(32486, 45543, 58600, 19429, 71657) c5(qP, w, cy, fW, O); #c1(LRRN3) c2(NP_001093128) c3(6373) c4(32487, 45544, 58601, 19430, 71658) c5(oy, Wk, b, cV); #c1(LRRN4) c2(NP_689824) c3(6374) c4(32488, 45545, 58602, 19431, 71659) c5(ho, iP, b); #c1(LRRTM1) c2(NP_849161) c3(6375) c4(32489, 45546, 58603, 19432, 71660) c5(to, FD, ao, cy, yQ, bu, jN, ho); #c1(LRRTM2) c2(NP_056379) c3(6376) c4(32490, 45547, 58604, 19433, 71661) c5(n); #c1(LRRTM3) c2(NP_821079) c3(6377) c4(32491, 45548, 58605, 19434, 71662) c5(Wk, gk, o); #c1(LRRTM4) c2(NP_001128217) c3(6378) c4(32492, 45549, 58606, 19435, 71663) c5(dA); #c1(LRSAM1) c2(NP_001177652) c3(6379) c4(32493, 45550, 58607, 19436, 71664) c5(qt, cG, caO, dt, II, fD, Iv); #c1(LRTM1) c2(NP_001291318) c3(6380) c4(32494, 45551, 58608, 19437, 71665) c5(bq, at, I); #c1(LRTOMT) c2(NP_001138779) c3(6381) c4(32495, 45552, 58609, 19438, 71666) c5(caP, u, y, Bx); #c1(LSAMP) c2(NP_002329) c3(6382) c4(32496, 45553, 58610, 19439, 71667) c5(dx, by, en, b, fr, pR, iU, tR, w, cA, wX, aEe, cM, AX, bu, dQ, awF, awq, V, apx, du, dB, YI, W, P, II, Ny, ft, ih, ji, at, alw); #c1(LSMI1) c2(NP_775762) c3(6383) c4(32497, 45554, 58611, 19440, 71668) c5(bq); #c1(LSMI) c2(NP_055277) c3(6384) c4(32498, 45555, 58612, 19441, 71669) c5(A, iP, B, ag, co, y, bw, u, ac); #c1(LSM2) c2(NP_067000) c3(6385) c4(32499, 45556, 58613, 19442, 71670) c5(m, RD, b, aVR, aq, nW, P, caQ, aHc, vc, kz, fl, zk, Aj, ne, u, zp); #c1(LSM3) c2(NP_055278) c3(6386) c4(32500, 45557, 58614, 19443, 71671) c5(Eo); #c1(LSM4) c2(NP_036453) c3(6387) c4(32501, 45558, 58615, 19444, 71672) c5(B, b, X, dB, A, O, co, f, F, bu, ar, y, av, fy, u, ff, fU, cV, aC, bp, by, jo, qp, zM, ag, hd); #c1(LSM5) c2(NP_036454) c3(6388) c4(32502, 45559, 58616, 19445, 71673) c5(kF); #c1(LSM6) c2(NP_009011) c3(6389) c4(32503, 45560, 58617, 19446, 71674) c5(0T); #c1(LSM7) c2(NP_057283) c3(6390) c4(32504, 45561, 58618, 19447, 71675) c5(b); #c1(LSP1) c2(NP_001013273) c3(6391) c4(32505, 45562, 58619, 19448, 71676) c5(jH, co, aX, b, vd, k, ag, fv, PT, mm, jl, u, y); #c1(LSR)

c2(NP_001247418) c3(6392) c4(32506, 45563, 58620, 19449, 71677) c5(Ag, b, uj, ui, ad, Be, T, Af, cs, x, u, y); #c1(LSS) c2(NP_001001438) c3(6393) c4(32507, 45564, 58621, 19450, 71678) c5(d, iH, aai, agQ, ep, e); #c1(LST1) c2(NP_995309) c3(6394) c4(32508, 45565, 58622, 19451, 71679) c5(da, m, vg, ae, aiT, aF, vS, gL, HJ, mk, vc, tG, aE, pW); #c1(LTA4H) c2(NP_000886) c3(6395) c4(32509, 45566, 58623, 19452, 71680) c5(dx, A, caS, tC, iU, caT, eO, e, cM, d, dv, bb, B, ar, aO, nO, jG, fh, HI, du, bd, eX, caR, cy, qe, nk, dP, acN, aY, ag, Bm, dc, bq, at, ap); #c1(LTA) c2(XP_011512920) c3(6396) c4(32510, 45567, 58624, 19453, 71681) c5(bck, dx, eX, pV, Io, bx, iU, aPi, Ka, eH, eW, sJ, bn, hM, bzL, cO, aw, eP, OH, e, cp, gM, dv, cy, caW, t, AX, iT, caV, jm, mR, aMq, aD, fH, pq, gl, ha, aBs, aC, sH, du, fO, bEk, bp, gY, ME, hR, dH, dS, fc, OR, IK, tO, ag, cT, axC, bk, i, pt, aA, rn, id, aPm, jz, ig, ix, Xc, aFX, vp, U, sN, y, tp, co, pw, DM, B, aDD, fb, bu, Em, kN, ji, pW, em, V, ae, fl, byO, gv, gF, fg, ar, cl, iA, BV, fJ, eF, aY, eA, fw, aYE, aDE, gA, iu, oM, apT, Dg, ap, WH, ck, b, aF, wn, caU, yU, ic, z, aMI, ey, pl, aO, d, dl, wZ, qH, bb, aiT, re, vf, dQ, tg, asv, jG, HL, u, nj, ri, fh, da, sz, I, im, kt, LR, fz, gL, by, Fo, mW, aZ, yG, jH, ao, rQ, eV, axA, fD, eQ, hT, mA, aE, gd, aaM, Bm, bq, I, zD, bL, A, bf, gU, HJ, gN, wf, bPx, di, qX, iL, gE, caX, al, xe, vl, jQ, m, qs, o, aX, or, ty, sG, wG, h, cU, ik, n, qB, Jk, aV, jZ, ax, be, gm, W, P, ti, j, Im, aDA, jl, Bb, ac, aM, jT, ce, eG, Ic, vS, vW, DI, fP, bHV, iB, at, Nu, gf); #c1(LTB4R2) c2(NP_062813) c3(6397) c4(32511, 45568, 58625, 19454, 71682) c5(dx, A, b, X, DT, NH, eO, y, dv, bb, B, fv, aD, iR, be, aC, du, cy, fx, NG, u, ag, i, Xz); #c1(LTB4R) c2(NP_001137391) c3(6398) c4(32512, 45569, 58626, 19455, 71683) c5(dx, bL, X, aF, z, alV, Ku, eO, bW, dv, bb, ag, bw, av, iR, o, fh, wF, du, aC, be, cd, P, cy, gg, gd, i); #c1(LTB) c2(NP_002332) c3(6399) c4(32513, 45570, 58627, 19456, 71684) c5(dx, b, ag, DT, caT, eP, eV, m, bb, hm, t, h, f, g, fH, jG, bm, fh, be, si, ae, im, aC, du, J, BV, P, cy, jT, fJ, Lc, acN, G, gd, cT, TQ, I, bq, at); #c1(LTBP1) c2(NP_000618) c3(6400) c4(32514, 45571, 58628, 19457, 71685) c5(GK, b, X, iG, al, bj, bb, ip, ik, oJ, av, u, V, LR, cd, GB, wh, Iz, uJ, GM, bh, at); #c1(LTBP2) c2(NP_000419) c3(6401) c4(32515, 45572, 58629, 19458, 71686) c5(wj, EH, DQ, cba, DS, aef, vR, JZ, iG, cO, aI, U, jh, caY, bb, aNT, q, qr, oJ, cag, ez, wo, fO, aX, wh, gE, iP, caZ, er, bh, Iz, Ep); #c1(LTBP3) c2(NP_001123616) c3(6402) c4(32516, 45573, 58630, 19459, 71687) c5(EH, iP, DS, iG, cO, al, U, jh, aX, aNT, cbb, aef, HP, cag, ez, wo, cd, fO, AP, cba, er, bh, Iz, Ep); #c1(LTBP4) c2(NP_001036009) c3(6403) c4(32517, 45574, 58631, 19460, 71688) c5(bL, sF, bW, al, U, xl, d, c, aX, e, ik, ar, u, vR, V, il, ebe, cd, T, oD, cbd, I, bh); #c1(LTBR) c2(NP_001257916) c3(6404) c4(32518, 45575, 58632, 19461, 71689) c5(dx, A, JH, b, qd, X, aF, sE, aE, mk, Bd, NH, nI, bw, bf, fR, eD, aYA, eh, OR, arR, aHr, dv, aX, px, pp, h, gz, ahd, cy, eE, y, aMq, gg, zQ, u, dh, TP, da, du, adK, bfU, ae, B, aC, jD, awD, ao, fO, J, dt, im, jG, T, aos, bb, jT, pi, av, be, aM, aGc, M, aZg, aCx, NG, aq, Ic, uH, ag, cT, pH, aA, zD, iu, gf, ap); #c1(LTC4S) c2(NP_665874) c3(6405) c4(32519, 45576, 58633, 19462, 71690) c5(Ka, Kc, vZ, eO, bkc, aO, gM, cy, dl, bI, fH, jG, dh, o, fh, tY, I, TK, aD, ti, rw, bb, cbe, fJ, ac, hU, TN, I, bq, at, ap); #c1(LTF) c2(NP_001186078) c3(6406) c4(32520, 45577, 58634, 19463, 71691) c5(A, aw, b, xa, In, eu, fl, ku, BH, vl, y, cp, co, aX, pp, DM, B, cU, aKt, iv, jG, fy, u, TP, mz, fU, rN, aPQ, sH, gL, T, Zr, x, cy, aA, pq, jH, bm, tO, abf, kC, DI, bBy, aBz, fl, ael, bp, eG, aG); #c1(LTK) c2(NP_001129157) c3(6407) c4(32521, 45578, 58635, 19464, 71692) c5(ac, m, kF, J, b); #c1(LUC7L3) c2(NP_057508) c3(6408) c4(32522, 45579, 58636, 19465, 71693) c5(V, b, F, do, cI, cO, U); #c1(LUC7L)

c2(NP_060502) c3(6409) c4(32523, 45580, 58637, 19466, 71694) c5(Fh, qw, pg); #c1(LUM) c2(NP_002336) c3(6410) c4(32524, 45581, 58638, 19467, 71695) c5(Dr, gE, b, cY, cO, Iu, z, Jb, bw, U, fD, y, d, m, co, aX, zJ, cK, e, fr, ar, O, cs, fv, u, iT, fi, oa, V, Bs, kJ, ad, asO, Il, rO, aeC, ft, dS, Bu, mA, ag, Yv, ji, at, aG); #c1(LURAP1L) c2(NP_981948) c3(6411) c4(32525, 45582, 58639, 19468, 71696) c5(at); #c1(LUZP4) c2(NP_057467) c3(6412) c4(32526, 45583, 58640, 19469, 71697) c5(ck, fO, WP); #c1(LUZP6) c2(NP_001122091) c3(6413) c4(32527, 45584, 58641, 19470, 71698) c5(A, B); #c1(LVRN) c2(NP_776161) c3(6414) c4(32528, 45585, 58642, 19471, 71699) c5(aC, di, gA, aX, sH); #c1(LXN) c2(NP_064554) c3(6415) c4(32529, 45586, 58643, 19472, 71700) c5(B, b, aoG, aiW, eH, ga, eM, O, Co, A, y, jT, aX, aK, f, IW, bu, cO, X, cM, av, u, oJ, aC, J, cz, IX, T, wt, iA, by, wh, hX, aQM, ih); #c1(LYGD) c2(NP_003686) c3(6416) c4(32530, 45587, 58644, 19473, 71701) c5(F, ar); #c1(LY6E) c2(NP_001120685) c3(6417) c4(32531, 45588, 58645, 19474, 71702) c5(en, b, amf, KN, A, siI, bw, kV, dl, m, bb, nQ, zo, B, amg, q, NJ, Kz, KL, adP, aPM, OA, aV, ame, EX, amd, Ir, Kx, alX, GS, v, bN, rw, x, akV, kS, ac, ao, amc, KR, cH, zp, o, aBz, bM, GJ); #c1(LY6G5B) c2(NP_067044) c3(6418) c4(32532, 45589, 58646, 19475, 71703) c5(m, bb, ap, bq, at, aE, fh); #c1(LY6G5C) c2(NP_079538) c3(6419) c4(32533, 45590, 58647, 19476, 71704) c5(aC, m, aW); #c1(LY6G6C) c2(NP_079537) c3(6420) c4(32534, 45591, 58648, 19477, 71705) c5(aC, m, bd, fO); #c1(LY6G6F) c2(NP_001003693) c3(6421) c4(32535, 45592, 58649, 19478, 71706) c5(m, ai, aW); #c1(LY6K) c2(NP_059997) c3(6422) c4(32536, 45593, 58650, 19479, 71707) c5(d, ck, il, b, F, bu, e, T, fy, i, ik, aA, by, u, fx, y); #c1(LY75-CD302) c2(NP_001185688) c3(6423) c4(32537, 45594, 58651, 19480, 71708) c5(aX, X, P, mR, cO, av, hR); #c1(LY75) c2(NP_002340) c3(6424) c4(32538, 45595, 58652, 19481, 71709) c5(aX, X, P, mR, fH, cO, pw, av, hR, fJ); #c1(LY86) c2(NP_004262) c3(6425) c4(32539, 45596, 58653, 19482, 71710) c5(qf, at, cy, mm, vd); #c1(LY96) c2(NP_001182726) c3(6426) c4(32540, 45597, 58654, 19483, 71711) c5(nk, I, aF, aFy, gL, bu, aDL, w, T, vB, fP, U, pi, gf); #c1(LY9) c2(NP_001028839) c3(6427) c4(32541, 45598, 58655, 19484, 71712) c5(m, q, fO); #c1(LYL1) c2(XP_006722815) c3(6428) c4(32542, 45599, 58656, 19485, 71713) c5(b, h, hg, ie, gm, nO, n, iv, nO, J, jT, ci); #c1(LYN) c2(NP_001104567) c3(6429) c4(32543, 45600, 58657, 19486, 71714) c5(b, iP, w, oR, Iv, U, O, bkK, h, y, jG, u, V, m, gm, J, P, jT, jH, ie, bJb, eG); #c1(LYNX1) c2(NP_803253) c3(6430) c4(32544, 45601, 58658, 19487, 71715) c5(da, u, JH, T); #c1(LYPD1) c2(NP_653187) c3(6431) c4(32545, 45602, 58659, 19488, 71716) c5(rQ); #c1(LYPD2) c2(NP_991108) c3(6432) c4(32546, 45603, 58660, 19489, 71717) c5(Eo); #c1(LYPD3) c2(NP_055215) c3(6433) c4(32547, 45604, 58661, 19490, 71718) c5(d, jh, aX, V, b, bp, ar, aw, U, u, e); #c1(LYPD4) c2(NP_001278348) c3(6434) c4(32548, 45605, 58662, 19491, 71719) c5(A, b, X, Nm, co, re, B, y, cB, cs, av, u, wY, iT, n, cbf, ad, fx, mO, ag, i, at); #c1(LYPD5) c2(NP_001026919) c3(6435) c4(32549, 45606, 58663, 19492, 71720) c5(A, aX, V, b, B, gm, bu, ag, T, fy, iL, ar, U, by, u, y); #c1(LYPD6) c2(NP_001182614) c3(6436) c4(32550, 45607, 58664, 19493, 71721) c5(cbg); #c1(LYPD8) c2(NP_001078943) c3(6437) c4(32551, 45608, 58665, 19494, 71722) c5(be, jV); #c1(LYPLA1) c2(NP_001266286) c3(6438) c4(32552, 45609, 58666, 19495, 71723) c5(dx, fl, du, ne, dv, bf, aM); #c1(LYPLAL1) c2(NP_001287699) c3(6439) c4(32553, 45610, 58667, 19496, 71724) c5(bf, aA, Bu, dL, fN); #c1(LYRM1)

c2(NP_001289765) c3(6440) c4(32554, 45611, 58668, 19497, 71725) c5(aA); #c1(LYRM4) c2(NP_001158312) c3(6441) c4(32555, 45612, 58669, 19498, 71726) c5(oy, jH, cbh, cV, f, fP); #c1(LYRM7) c2(NP_859056) c3(6442) c4(32556, 45613, 58670, 19499, 71727) c5(hT); #c1 (LYRM9) c2(NP_001070148) c3(6443) c4(32557, 45614, 58671, 19500, 71728) c5(fO, cy); #c1(LYST) c2(NP_001288294) c3(6444) c4(32558, 45615, 58672, 19501, 71729) c5(IY, sk, wj, IZ, dP, yX, pS, NG, v, XP, NH, cO, pH, cbe); #c1(LYVE1) c2(NP_006682) c3(6445) c4(32559, 45616, 58673, 19502, 71730) c5(A, b, F, Ka, O, JC, z, VJ, U, y, brG, aX, f, blN, q, vQ, B, bm, g, V, bPN, gv, T, jl, jE, u, PS, bh); #c1(LYZ) c2(NP_000230) c3(6446) c4(32560, 45617, 58674, 19503, 71731) c5(dx, iU, AI, Kt, sE, gn, eH, ig, di, z, bf, chi, aK, O, ed, dv, h, f, q, akf, aYd, baz, ar, fM, bm, o, le, YV, aC, sH, du, BV, W, P, aQN, et, by, et, bu, be, aM, jH, jT, qt, amj, ZI, iV, tO, amX, fP, aT, Xe, bRg); #c1(LYZL1) c2(NP_115906) c3(6447) c4(32561, 45618, 58675, 19504, 71732) c5(bf, aM); #c1(LYZL2) c2(NP_898881) c3(6448) c4(32562, 45619, 58676, 19505, 71733) c5(kC, aW); #c1(LYZL6) c2(NP_001186880) c3(6449) c4(32563, 45620, 58677, 19506, 71734) c5(bq); #c1(LZTFL1) c2(NP_001263307) c3(6450) c4(32564, 45621, 58678, 19507, 71735) c5(b, by, ix, bu, TD, zW); #c1(LZTR1) c2(NP_006758) c3(6451) c4(32565, 45622, 58679, 19508, 71736) c5(oy, ayo, bb, LI, cbj, w); #c1 (LZTS1) c2(XP_011542689) c3(6452) c4(32566, 45623, 58680, 19509, 71737) c5(GK, A, GM, b, X, Bg, jC, bf, e, y, oy, co, aX, ip, ak, bu, ik, B, ar, av, u, d, by, GB, T, bb, fx, iR, he, TD, i, at); #c1(M6PR) c2(NP_001193953) c3(6453) c4(32567, 45624, 58681, 19510, 71738) c5(A, dB, gL, bu, di, o); #c1(MAATS1) c2(NP_203528) c3(6454) c4(32568, 45625, 58682, 19511, 71739) c5(gL); #c1(MAB21L1) c2(NP_005575) c3(6455) c4(32569, 45626, 58683, 19512, 71740) c5(bK); #c1(MAB21L2) c2(NP_006430) c3(6456) c4(32570, 45627, 58684, 19513, 71741) c5(aC, cp); #c1 (MAB21L3) c2(XP_011538928) c3(6457) c4(32571, 45628, 58685, 19514, 71742) c5(bq); #c1(MACC1) c2(NP_877439) c3(6458) c4(32572, 45629, 58686, 19515, 71743) c5(by, aw, b, k, X, Vz, jc, U, y, re, q, bu, fr, ar, O, cs, av, u, iT, is, V, ft, Dt, gv, T, ji, ad, bh, at); #c1(MACROD1) c2(NP_054786) c3(6459) c4(32573, 45630, 58687, 19516, 71744) c5(cU, iA, u, J, y); #c1(MACROD2) c2(NP_001028259) c3(6460) c4(32574, 45631, 58688, 19517, 71745) c5(oy, qf, ao, bu, by, cz, bUk, bq, IV, at, bj, aA, cM); #c1(MAD1L1) c2(NP_001291452) c3(6461) c4(32575, 45632, 58689, 19518, 71746) c5(A, b, X, dB, w, U, y, co, aX, pp, h, ak, q, do, jT, n, iv, pB, av, u, fU, hW, V, cV, cs, ad, W, T, ny, by, Lt, jE, bm, jR, bq, ci); #c1 (MAD2L1BP) c2(NP_001003690) c3(6462) c4(32576, 45633, 58690, 19519, 71747) c5(aeK, bMm, aw, cG, bld, QY, qZ, cN, q, VI, kz, bhn, nI, bN, dt, bYD, ac, xV, cbk, bMi, Y, aCp, cb, xP); #c1(MAD2L1) c2(NP_002349) c3(6463) c4(32577, 45634, 58691, 19520, 71748) c5(Dr, fl, aw, b, X, pR, U, e, y, d, jh, co, q, bu, fr, ar, ff, cB, cs, av, fy, iR, Fg, bm, kF, V, qL, nI, bp, ft, jo, aiL, fx, by, jH, nV, u, i, T, Mp); #c1(MAD2L2) c2(XP_011538809) c3(6464) c4(32578, 45635, 58692, 19521, 71749) c5(IO, V, b, aq, dB, ad, cs, U, BV, u, av, y); #c1(MADCAM1) c2(NP_570116) c3(6465) c4(32579, 45636, 58693, 19522, 71750) c5(jH, Xy, bx, jz, Iv, gC, cbI, aE, jU, jQ); #c1(MADD) c2(NP_569831) c3(6466) c4(32580, 45637, 58694, 19523, 71751) c5(BO, nV, I, b, cV, hV, ig, cT, xi, vZ, bf, at, ra, o, aM); #c1(MAEA) c2(NP_001017405) c3(6467) c4(32581, 45638, 58695, 19524, 71752) c5(dx, dv, du, I); #c1(MAEL) c2(NP_001273306) c3(6468) c4(32582, 45639, 58696, 19525, 71753) c5(V, X, di, av, U, cp); #c1(MAF1) c2(NP_115648) c3(6469) c4(32583, 45640, 58697, 19526, 71754) c5(w, f); #c1(MAFA) c2(NP_963883) c3(6470) c4(32584, 45641, 58698, 19527, 71755) c5(yV, I, bf, ey, aE, aM); #c1(MAFB) c2(NP_005452) c3(6471) c4(32585, 45642, 58699, 19528, 71756) c5(cbm, or, I, dA, aC, anb, Nq, fO, Ns, bw, jT); #c1(MAFF) c2(NP_001155045) c3(6472) c4(32586, 45643, 58700, 19529, 71757) c5(aX); #c1 (MAFG) c2(XP_011521881) c3(6473) c4(32587, 45644, 58701, 19530, 71758) c5(gD, co, V); #c1(MAF) c2(NP_001026974) c3(6474) c4(32588, 45645, 58702, 19531, 71759) c5(dx, b, anb, rd, cA, aW, dv, I, kH, gD, Yk, VD, cbn, bVK, du, bd, fO, cz, iD, aSS, aoA, bq, aA, at); #c1(MAFK) c2(XP_006715836) c3(6475) c4(32589, 45646, 58703, 19532, 71760) c5(wa, aX, jd, f, q, fO, J, jF, n, iv, aA, fy); #c1(MAGEA10) c2(NP_001011543) c3(6476) c4(32590, 45647, 58704, 19533, 71761) c5(aX); #c1(MAGEA11) c2(NP_001011544) c3(6477) c4(32591, 45648, 58705, 19534, 71762) c5(A, B, b); #c1(MAGEA12) c2(NP_001159858) c3(6478) c4(32592, 45649, 58706, 19535, 71763) c5(d, aX, e); #c1(MAGEA1) c2(NP_004979) c3(6479) c4(32593, 45650, 58707, 19536, 71764) c5(A, aw, b, X, ck, Iv, et, e, y, d, yg, aX, wP, F, q, bu, ND, aJ, av, fy, u, cV, J, bp, by, T, fO, aoO, wV, iR, DO, avl, cT, w); #c1(MAGEA2B) c2(NP_705692) c3(6480) c4(32594, 45651, 58708, 19537, 71765) c5(ck, aX, AZ, DO, co, O, jC, ac); #c1(MAGEA3) c2(NP_005353) c3(6481) c4(32595, 45652, 58709, 19538, 71766) c5(A, aw, b, cY, ck, iL, z, et, bw, hP, e, y, d, yg, co, aX, kJ, B, F, q, bu, X, aoQ, aJ, ik, av, u, aHK, wP, fU, il, cV, J, bp, by, T, II, fx, wV, ag, bk, i); #c1(MAGEA4) c2(NP_001011549) c3(6482) c4(32596, 45653, 58710, 19539, 71767) c5(d, A, aX, ck, QB, q, bp, co, T, aJ, ar, fy, iR, e); #c1(MAGEA6) c2(NP_005354) c3(6483) c4(32597, 45654, 58711, 19540, 71768) c5(d, en, aX, dB, e); #c1(MAGEA9) c2(NP_005356) c3(6484) c4(32598, 45655, 58712, 19541, 71769) c5(dB, i); #c1(MAGEB17) c2(NP_001264236) c3(6485) c4(32599, 45656, 58713, 19542, 71770) c5(111); #c1(MAGEB1) c2(NP_803134) c3(6486) c4(32600, 45657, 58714, 19543, 71771) c5(aX); #c1(MAGEB2) c2(NP_002355) c3(6487) c4(32601, 45658, 58715, 19544, 71772) c5(F, aX, dB, m); #c1(MAGEB6) c2(NP_775794) c3(6488) c4(32602, 45659, 58716, 19545, 71773) c5(d, py, by, Oi, bu, e); #c1(MAGEC1) c2(NP_005453) c3(6489) c4(32603, 45660, 58717, 19546, 71774) c5(d, co, aX, b, cY, bah, B, fO, A, ck, fy, u, e); #c1(MAGEC2) c2(NP_057333) c3(6490) c4(32604, 45661, 58718, 19547, 71775) c5(oy, d, wV, co, aX, V, b, HI, cY, q, jH, wP, ck, T, ar, U, u, e, y, ap); #c1(MAGEC3) c2(NP_619647) c3(6491) c4(32605, 45662, 58719, 19548, 71776) c5(Ez, zl, b); #c1(MAGED1) c2(NP_001005332) c3(6492) c4(32606, 45663, 58720, 19549, 71777) c5(g, A, aX, b, aY, cz, ih, ag, T, O, rv, dc, bw, aA, bdV, cM); #c1(MAGED2) c2(NP_055414) c3(6493) c4(32607, 45664, 58721, 19550, 71778) c5(aX, X, bu, T, av, cbo, u, y); #c1(MAGED4B) c2(NP_110428) c3(6494) c4(32608, 45665, 58722, 19551, 71779) c5(ck, aw, b, X, dB, w, Iv, ot, O, yg, aX, F, g, ND, y, av, fy, iR, cV, J, bp, by, T, fO, aoO, u, DO, avl, cT); #c1(MAGED4) c2(NP_001092270) c3(6495) c4(32609, 45666, 58723, 19552, 71780) c5(ck, aw, b, X, dB, w, Iv, ot, O, yg, aX, F, g, ND, y, av, fy, iR, cV, J, bp, by, T, fO, aoO, u, DO, avl, cT); #c1(MAGEE1) c2(NP_065983) c3(6496) c4(32610, 45667, 58724, 19553, 71781) c5(dx, id, b, zH, w, di, y, dv, aX, f, bu, mR, nA, u, dh, I, aC, du, by, bb, fx, aBy, zl, er, aE, ag, i, qh, at, ap); #c1(MAGEH1) c2(NP_054780) c3(6497) c4(32611, 45668, 58725, 19554, 71782) c5(aX, f, ag, P, fH, fJ); #c1(MA-GEL2) c2(NP_061939) c3(6498) c4(32612, 45669, 58726, 19555, 71783) c5(dj, rQ, aX, S, cz, rv, hW, aA, TD, cbp);

c1(MAG) c2(NP_001186145) c3(6499) c4(32613, 45670, 58727, 19556, 71784) c5(bg, co, bb, cG, cbq, Y, MO, dt, cJ, ala, ds, cbr, sR, bw, aT, aV, bj, ov, O); #c1(MAGI1) c2(NP_001028229) c3(6500) c4(32614, 45671, 58728, 19557, 71785) c5(ak, aw, b, X, pR, iP, jz, eu, anF, oi, ic, iG, y, jQ, co, aX, jd, f, q, ND, ff, n, av, u, EM, te, gG, dB, anD, jo, VP, jC, anG, DD, anE, Nu, rb); #c1(MAGI2) c2(NP_001288057) c3(6501) c4(32615, 45672, 58729, 19558, 71786) c5(jH, co, aX, nQ, ig, wG, hS, P, dv, fP, rb, ji, ag, dl); #c1(MAGI3) c2(XP_011539510) c3(6502) c4(32616, 45673, 58730, 19559, 71787) c5(ii, ad, hM, cs, x, ar, iu); #c1(MAGT1) c2(NP_115497) c3(6503) c4(32617, 45674, 58731, 19560, 71788) c5(nO, b, cY, Id, wn, w, kY, z, A, y, MT, co, aX, h, f, g, M, kz, B, cs, fH, zQ, u, iT, n, alR, be, LR, J, fO, T, eg, jT, fJ, jE, cbt, bm, PY, ag, oi, cbs, re); #c1(MAK16) c2(NP_115898) c3(6504) c4(32618, 45675, 58732, 19561, 71789) c5(by, en, iL, b, dB, wy, AA, hS, w, brZ, kY, O, jy, bw, ai, bu, A, e, y, cy, d, ed, co, aX, bj, aEz, f, el, q, es, Vr, kz, mR, B, iv, Tk, QJ, u, nz, o, sz, fU, si, jE, ae, m, bK, Ua, cs, v, j, J, P, T, aj, fy, rO, aro, ad, xx, fM, ao, KK, bm, Jh, ag, cz, jT, fl, QP, nU); #c1(MAK) c2(NP_005897) c3(6505) c4(32619, 45676, 58733, 19562, 71790) c5(A, nQ, ml, B, cbu, ea, nW); #c1(MAL) c2(NP_002362) c3(6506) c4(32620, 45677, 58734, 19563, 71791) c5(jK, A, b, X, hP, e, y, d, il, ip, h, F, q, bu, ik, fH, av, aq, iT, alc, bm, ae, aC, J, by, W, P, T, Jp, fJ, ale, u, ag, aA, re); #c1(MALL) c2(NP_005425) c3(6507) c4(32621, 45678, 58735, 19564, 71792) c5(W, cs, ad); #c1(MALRD1) c2(NP_001135780) c3(6508) c4(32622, 45679, 58736, 19565, 71793) c5(td, Ks, nl, di, cO, bf, aA, o); #c1(MALT1) c2(NP_006776) c3(6509) c4(32623, 45680, 58737, 19566, 71794) c5(pm, b, bx, asi, iX, gN, sJ, Ou, cbv, bu, Dv, aJH, aV, bm, ask, Ov, gm, fO, T, bt, jT, aqa, To, ash); #c1(MAML1) c2(NP_055572) c3(6510) c4(32624, 45681, 58738, 19567, 71795) c5(jh, re, dB, jo, ff, pR, iT); #c1(MAML2) c2(NP_115803) c3(6511) c4(32625, 45682, 58739, 19568, 71796) c5(d, jp, e, aw, aWp, b, t, h, aWq, agh, ahQ, Ty, cT, cbx, n, cbw, bg, aeC, jT, ci); #c1(MAML3) c2(NP_061187) c3(6512) c4(32626, 45683, 58740, 19569, 71797) c5(cr, rb); #c1(MAMLD1) c2(NP_001170936) c3(6513) c4(32627, 45684, 58741, 19570, 71798) c5(cbz, afg, NI, VI, afi, xP, PH, cby); #c1(MANIA1) c2(NP_005898) c3(6514) c4(32628, 45685, 58742, 19571, 71799) c5(P, fl, I, eq); #c1(MANIB1) c2(NP_057303) c3(6515) c4(32629, 45686, 58743, 19572, 71800) c5(f, bi, b, nU, q, aDu, cbA, Td, bm); #c1(MAN2A1) c2(NP_002363) c3(6516) c4(32630, 45687, 58744, 19573, 71801) c5(m, cy, I, t, Dj, od, Fg); #c1(MAN2A2) c2(NP_006113) c3(6517) c4(32631, 45688, 58745, 19574, 71802) c5(0); #c1(MAN2B1) c2(NP_000519) c3(6518) c4(32632, 45689, 58746, 19575, 71803) c5(cbB, fl, LG); #c1(MAN2C1) c2(NP_001243423) c3(6519) c4(32633, 45690, 58747, 19576, 71804) c5(BO, A, T, B, il); #c1(MANBA) c2(NP_005899) c3(6520) c4(32634, 45691, 58748, 19577, 71805) c5(cbD, V, b, dA, cbC, LG, bf, U, aV); #c1(MANEA) c2(NP_078917) c3(6521) c4(32635, 45692, 58749, 19578, 71806) c5(kF, IV, dd, Fg, Wf); #c1(MANF) c2(NP_006001) c3(6522) c4(32636, 45693, 58750, 19579, 71807) c5(ma, b, ag, f, dB, hS, A, cV, cO, bw, at, bj); #c1(MANSC1) c2(NP_060520) c3(6523) c4(32637, 45694, 58751, 19580, 71808) c5(A, B); #c1(MADA) c2(NP_000231) c3(6524) c4(32638, 45695, 58752, 19581, 71809) c5(amC, dx, f, dN, Gm, gG, ns, nm, nt, nq, nr, nn, bf, no, np, bhZ, dv, zo, qc, buH, do, jm, byn, zb, aVF, IV, Yk, HX, nz, du, cbE, ME, aTY, GI, Lb, ro, aqw, cbH, i, dc, GF, aA, nX, ux, bS, aPm, hS, amh, wX, cA, cM, TC, ak, Go, B, oD, hj, nu, Fp, Js, eX, rV, zf, acd, aY, KD, HZ, gA, cbG, jP, ap, vf, b, jJ, aUm, qa, cbF, gZ, abq, wZ, bb, nU, aaE, q, dW, ND, NJ, vu, aUb, qu, Gj, o, I, qA, cz, G, eQ, he, ih, HV, ahm, cbI, FY, bL, Ib, A, gU, Pa, tR, aqV, bj, c, Wj, ob, sG, bxf, wr, aqE, oE, iZ, wW, aqz, aq, dj, hW, cV, Sw, aqR, gF, vv, to, at, hq, vW, RB, eG); #c1(MAOB) c2(NP_000889) c3(6525) c4(32639, 45696, 58753, 19582, 71810) c5(bL, Ib, ak, dN, aPm, bg, gB, w, z, cA, abq, cM, bhZ, wZ, zo, sG, bj, nU, Vd, o, dj, hW, I, HX, qA, HV, nu, v, cz, fq, cV, x, vv, rQ, re, f, aY, dc, eG); #c1(MAP10) c2(NP_061963) c3(6526) c4(32640, 45697, 58754, 19583, 71811) c5(cO); #c1(MAP1A) c2(NP_002364) c3(6527) c4(32641, 45698, 58755, 19584, 71812) c5(cbJ); #c1(MAP1B) c2(NP_005900) c3(6528) c4(32642, 45699, 58756, 19585, 71813) c5(kz, an, bxA, hM, cV); #c1(MAP1LC3A) c2(NP_115903) c3(6529) c4(32643, 45700, 58757, 19586, 71814) c5(DG, u, q, gL, T, kY, ji, at, hP, y); #c1(MAP1LC3B2) c2(NP_001078950) c3(6530) c4(32644, 45701, 58758, 19587, 71815) c5(ie); #c1(MAP1LC3B) c2(NP_073729) c3(6531) c4(32645, 45702, 58759, 19588, 71816) c5(f, b, nO, fr, aF, pR, nU, ft, rQ, fP, fy, kY, nP, at, u, rr, y); #c1(MAP1S) c2(NP_060644) c3(6532) c4(32646, 45703, 58760, 19589, 71817) c5(u, h, jV, P, bj, iu, y); #c1(MAP2) c2(NP_001034627) c3(6533) c4(32647, 45704, 58761, 19590, 71818) c5(GS, asx, cY, DO, oa, aNH, aN, oH, kB, Bg, cbK, cA, O, e, aW, d, jR, aX, ak, iZ, k, y, jq, aV, u, Qx, o, fh, iF, dj, ma, ae, cV, sB, MO, P, cz, aec, HL, gp, fc, HN, fw, HB); #c1(MAP2K1) c2(NP_002746) c3(6534) c4(32648, 45705, 58762, 19591, 71819) c5(B, gG, dB, qP, e, O, aEx, zi, t, kP, jM, gI, aC, bp, baa, fx, jE, ag, cT, w, i, nU, cY, iP, U, y, co, sT, f, bu, cs, av, fy, bm, V, ze, Qt, gt, jR, ji, hV, b, xg, Gi, d, aua, g, jV, QE, ar, ff, jG, u, dh, o, fh, fs, cbL, ad, G, nV, dn, zD, A, IO, k, gw, mW, ajT, aW, m, aX, or, h, M, Eg, J, dU, jo, T, cr, fM, sK, Oi, X, eG); #c1(MAP2K2) c2(NP_109587) c3(6535) c4(32649, 45706, 58763, 19592, 71820) c5(aua, b, X, gw, U, xw, hP, O, co, aX, or, nU, g, ar, kP, cs, av, o, gG, V, ze, S, cbM, bp, ad, zi, Qt, cr, jH, baa, jR, ag, QI, dn, at, rb); #c1(MAP2K3) c2(NP_002747) c3(6536) c4(32650, 45707, 58764, 19593, 71821) c5(be, Ob, aC, ch, ml, f, q, bp, O, cO, fy, aA, at, u, y); #c1(MAP2K4) c2(NP_001268364) c3(6537) c4(32651, 45708, 58765, 19594, 71822) c5(An, tr, b, X, MS, A, vZ, O, bw, O, y, co, aX, h, f, bu, cO, fr, ar, B, av, fy, u, dh, cl, V, dA, aC, bp, ft, T, cV, x, bb, iA, by, JY, agQ, ag, ji, aA, at); #c1(MAP2K5) c2(NP_001193733) c3(6538) c4(32652, 45709, 58766, 19595, 71823) c5(bP, bL, A, aw, b, y, zo, B, mR, cM, hb, u, zb, dA, Jt, awu, xq, T, aY, jR, ih, fD, dc, aA); #c1(MAP2K6) c2(NP_002749) c3(6539) c4(32653, 45710, 58767, 19596, 71824) c5(en, si, X, ch, cK, f, ad, aC, co, ds, cs, x, bq, av, fy, dh, be); #c1(MAP2K7) c2(NP_001284484) c3(6540) c4(32654, 45711, 58768, 19597, 71825) c5(en, EM, gG, HG, w, cO, O, zi, cy, auW, cl, jM, eq, aC, el, iv, bp, x, fx, DO, yE, cT, i, pJ, cY, afY, kY, cA, bw, O, Oh, y, co, RD, ag, f, N, bu, gX, B, cs, av, fy, bm, V, bt, jC, ack, QG, Oa, nJ, tl, ji, b, Pv, Og, jh, hV, g, jV, X, ar, ff, Gj, iR, kP, QL, fs, BT, j, ad, iD, jG, jH, nV, u, agb, fg, fl, zD, A, k, jR, aX, h, F, cV, J, QI, T, fO, ej, aur, nP, by, gp, Jh, Af, eG); #c1(MAP3K10) c2(NP_002437) c3(6541) c4(32655, 45712, 58769, 19598, 71826) c5(pw, kJ, t, ad, ih, ag, G, cs, Oi, fy, u, y); #c1(MAP3K11) c2(NP_002410) c3(6542) c4(32656, 45713, 58770, 19599, 71827) c5(A, b, X, gE, U, hP, y, bb, f, B, cs, av, u, dh, fh, V, v, ad, P, T, fw, Oi); #c1(MAP3K12) c2(NP_006292) c3(6543) c4(32657, 45714, 58771, 19600, 71828) c5(jB, V, Tq, t, cV, gm, G, n, cO, jG, u, y); #c1(MAP3K13) c2(NP_001229246) c3(6544) c4(32658, 45715, 58772, 19601, 71829) c5(l, u, V, y, cO); #c1(MAP3K14) c2(XP_011523743) c3(6545) c4(32659, 45716, 58773, 19602, 71830) c5(A, bS, b, u, gn, MS, iG, bf, y, co, aX, f, g, fy, bm, og, aC, fO, jT, aM, ag, alQ, ag, fl, bT); #c1(MAP3K19) c2(NP_001018054) c3(6546) c4(32660, 45717, 58774, 19603, 71831) c5(ba, gm, aW, iv); #c1(MAP3KI) c2(NP_005912) c3(6547) c4(32661, 45718, 58775, 19604, 71832) c5(A, b, gE, X, yn, bw, y, tp, co, aX, f, g, bu, cU, fv, B, av, UR, aE, wp, Ag, aC, avo, bp, u, iA, by, jH, cbN, hq, ag); #c1(MAP3K2) c2(NP_006600) c3(6548) c4(32662, 45719, 58776, 19605, 71833) c5(aC, T, b); #c1(MAP3K3) c2(NP_002392) c3(6549) c4(32663, 45720, 58777, 19606, 71834) c5(b, X, f, ik, av, u, y); #c1(MAP3K4) c2(NP_005913) c3(6550) c4(32664, 45721, 58778, 19607, 71835) c5(iA, aew); #c1(MAP3K5) c2(NP_005914) c3(6551) c4(32665, 45722, 58779, 71836) c5(dx, mZ, fr, A, b, cY, bo, O, xa, aM, bw, bf, ey, bj, e, y, d, dv, aX, h, f, F, q, bu, M, X, pP, xl, cs, iJ, av, aV, u, dh, be, fs, I, B, aMH, ft, du, v, fO, J, bm, cV, bb, fx, ad, jU, HL, ao, ch, fw, xU, by, ag, i, aC, aA, jl, cK, ap); #c1(MAP3K6) c2(NP_001284538) c3(6552) c4(32666, 45723, 58780, 19609, 71837) c5(si); #c1(MAP3K7CL) c2(NP_001273546) c3(6553) c4(32667, 45724, 58781, 19610, 71838) c5(u, y); #c1(MAP3K7) c2(NP_003179) c3(6554) c4(32668, 45725, 58782, 19611, 71839) c5(bm, A, b, sO, bsC, sE, LM, ig, fl, cbO, e, y, d, jh, co, aX, h, B, g, X, do, jU, iv, fH, av, bsA, fe, dA, Dg, J, fO, ad, T, fx, jT, fj, su, Zn, u, mb, hT, Nq, ag, fP, i, bjF, bq); #c1(MAP3K8) c2(XP_005252421) c3(6555) c4(32669, 45726, 58783, 19612, 71840) c5(hV, aw, b, cE, X, pR, gG, dB, A, ak, O, U, y, ez, hh, qf, co, aX, ml, f, F, q, bu, B, cs, av, ji, u, Ac, q, iF, pw, ma, V, Eg, Um, Fs, bp, ad, sf, T, fO, bB, Fr, iA, by, jU, JY, ao, ck, bm, K, cT, Bx, bgo, nU, aA, at); #c1(MAP3K9) c2(NP_001271159) c3(6556) c4(32670, 45727, 58784, 19613, 71841) c5(aX, il, cY, f, ad, ik, cs); #c1(MAP4) c2(NP_001127836) c3(6557) c4(32671, 45728, 58785, 19614, 71842) c5(oy, fx, gm, i, ap); #c1(MAP4KI) c2(NP_001036065) c3(6558) c4(32672, 45729, 58786, 19615, 71843) c5(m, f, jR, ag, vZ, cs, bw, T, aW); #c1(MAP4K2) c2(NP_004570) c3(6559) c4(32673, 45730, 58787, 19616, 71844) c5(nX, eX, bAk, I, mB, f, mA, dh, gF, mx, aE, di, Bm, bw, bf, ey, bze, aM); #c1(MAP4K3) c2(NP_001257354) c3(6560) c4(32674, 45731, 58788, 19617, 71845) c5(m, ao, aC, mv, mW, xU, mC, ho, gl); #c1(MAP4K4) c2(NP_001229488) c3(6561) c4(32675, 45732, 58789, 19618, 71846) c5(mz, jT, co, aX, I, b, bm, g, fO, bS, ag, og, T, iL, iG, bf, fy, u, y, aM); #c1(MAP4K5) c2(XP_006720076) c3(6562) c4(32676, 45733, 58790, 19619, 71847) c5(bP, I, fN, eX, jz, jQ, fD, cO, bf, ey, at, aA, aM); #c1(MAP6) c2(NPJ49052) c3(6563) c4(32677, 45734, 58791, 19620, 71848) c5(mz, I, X, jG, gd, jS, bf, av, aM, O, FY); #c1(MAP7) c2(NP_001185540) c3(6564) c4(32678, 45735, 58792, 19621, 71849) c5(x, g, b); #c1(MAP9) c2(NP_001034669) c3(6565) c4(32679, 45736, 58793, 19622, 71850) c5(P); #c1(MAPK10) c2(NP_002744) c3(6566) c4(32680, 45737, 58794, 19623, 71851) c5(g, f, cy, IG, nU, F, cbP, X, P, T, av, hT); #c1(MAPK11) c2(NP_002742) c3(6567) c4(32681, 45738, 58795, 19624, 71852) c5(aC, f, q, J, P, w, cK, fy); #c1(MAPK12) c2(NP_001290181) c3(6568) c4(32682, 45739, 58796, 19625, 71853) c5(d, co, aX, b, ad, T, cs, u, e, y); #c1(MAPK13) c2(NP_002745) c3(6569) c4(32683, 45740, 58797, 19626, 71854) c5(gB, f, aC, gG, P, sp, oi, bjq); #c1(MAPK14) c2(NP_001306) c3(6570) c4(32684, 45741, 58798, 19627, 71855) c5(dx, en, dN, gG, dB, aN, Od, w, cO, bf, aK, e, O, RR, dv, cy, Ob, gB, do, kz, cl, Pv, Hs, n, mz, Oe, aC, du, aB, gm, bp, ft, x, fx, YY, gs, ag, cT, bk, i, dc, av, fO, X, vD, LM, mk, bw, U, cM, V, co, DM, f, bu, B, cs, av, fy, bm, iT, iF, rN, ae, NZ, BV, aDI, bt, cK, Eh, aY, Oa, yM, zS, b, aF, Of, ic, NY, ey, gZ, d, fv, re, g, yp, dQ, ar, jG, u, dh, o, da, iP, il, gL, ad, CZ, jU, ao, nV, kB, HN, xU, I, yA, Jh, A, k, fr, pD, di, iL, gE, al, jx, asN, aX, I, h, F, Aq, M, ik, y, fP, aV, ma, cV, be, J, Oc, P, T, II, ji, gF, by, fM, aM, wU, jT, MU, mb, j, jN, iB, at, eG, ja); #c1(MAPK15) c2(NP_620590) c3(6571) c4(32685, 45742, 58799, 19628, 71856) c5(u, y); #c1(MAPK1) c2(NP_620407) c3(6572) c4(32686, 45743, 58800, 19629, 71857) c5(dx, jp, by, en, axx, dN, gG, dB, aE, HG, Od, w, dd, ak, cO, JH, e, O, cp, yg, dv, cy, Ob, kJ, kB, t, fP, do, kz, mR, cl, Pv, aD, wh, Hs, gl, oJ, Oe, eg, aC, nl, bvP, du, aB, gm, bp, ft, cV, x, fx, jT, ata, xO, cbQ, fc, aEs, kM, DO, K, aeR, ag, cT, gP, bk, i, dc, pt, aA, fl, fO, fi, cY, afY, iP, LM, kP, pF, mk, bf, cA, bw, U, agb, cM, rN, co, Oc, RD, ip, yE, DM, f, cs, bu, gX, cbR, B, iv, av, fy, bm, iT, yJ, iF, V, ae, Bs, NZ, n, BV, IR, zi, bt, ar, iy, iA, pJ, W, iY, QG, Oa, P, jR, cK, cz, yM, zS, aG, afb, b, aF, Of, aoP, oR, jC, NY, ey, gZ, aO, d, jh, fv, MX, re, hV, g, jV, X, jm, dQ, ff, hb, cbS, Gj, u, dh, o, fh, QL, jj, jE, I, gL, eu, IX, CZ, iD, HE, jG, jU, hue, jH, nV, hU, hS, hX, ch, py, HN, xU, IS, bq, yA, af, Jh, zD, da, A, iL, k, fr, gw, BP, Xl, mW, rU, di, HS, pu, gE, ji, al, hP, vl, jx, m, bFF, aX, il, Qm, fq, h, F, auV, cU, ik, y, fM, XH, aV, aeS, fU, hW, Eg, Xn, be, J, dt, gj, jo, QI, T, II, bEw, oM, jl, nP, ad, ac, wU, qp, js, aAu, mb, G, j, iB, Oi, at, eG, ja, rb); #c1(MAPK3) c2(NP_001035145) c3(6573) c4(32687, 45744, 58801, 19630, 71858) c5(dx, jp, by, f, axx, iD, Ob, gG, eu, aDg, w, dd, bW, OH, e, O, cp, dv, cy, kJ, eE, asA, mR, fH, n, mz, eg, bnR, du, fO, gm, bp, ft, x, fx, jT, dL, aw, ami, sS, aEs, DO, ag, cT, i, dc, bg, X, iP, LM, ix, iG, IW, bw, U, cM, co, sT, ip, ak, bu, B, cs, av, fy, bm, yJ, V, ze, cd, IR, zi, eX, Qt, jC, fJ, OW, aY, er, jR, jd, aG, b, fN, aF, yU, cK, d, MX, k, q, jV, ra, ar, ff, hb, jG, u, ov, o, fh, da, BT, gL, cz, IX, Ca, aZ, et, bZn, kM, IS, A, qd, fr, pR, rU, HS, wf, sx, eh, jx, cr, LI, kn, h, F, cU, aC, ik, y, fQ, fU, E, cV, J, W, P, T, j, aX, ad, ata, Yv, iB, Oi, at, eG, rb); #c1(MAPKG) c2(XP_005254596) c3(6574) c4(32688, 45745, 58802, 19631, 71859) c5(d, co, aX, b, T, e); #c1(MAPK7) c2(NP_002740) c3(6575) c4(32689, 45746, 58803, 19632, 71860) c5(dx, bL, B, b, fr, pR, iP, dv, A, iG, bf, hP, e, y, d, co, dN, f, q, M, cM, cs, fH, gg, u, ft, du, J, bp, ad, bQ, T, fO, Qt, fx, cz, fJ, aM, jR, i, ap); #c1(MAPK8) c2(NP_001265477) c3(6576) c4(32690, 45747, 58804, 19633, 71861) c5(by, ml, en, cO, bf, O, e, xl, cy, cl, Hs, cc, g, aGW, aC, fO, gm, bp, ft, x, ca, jT, dL, jE, qt, fc, bm, ag, cT, w, Hd, pt, aA, iF, X, iP, kB, fU, bW, U, arW, y, V, co, f, bu, B, cs, av, fy, Zn, em, rN, Bs, v, cd, eX, cf, Oa, P, jR, cbT, oM, fW, b, fN, aF, z, ey, d, hb, Dx, q, es, ff, jG, u, dh, o, fh, PJ, fs, I, gL, cz, En, aZ, iO, jU, ao, HN, Dj, aE, gd, xa, Lq, A, k, fr, di, C, iL, hP, jx, aX, bj, h, M, n, cB, fP, aV, jZ, ma, cV, Be, be, J, jo, T, bkj, jl, gF, ad, aRI, aM, Lc, Kj, mb, aDd, ci, zM, XH, fQ, Di, at, MO); #c1(MAPK8IP1) c2(NP_005447) c3(6577) c4(32691, 45748, 58805, 19634, 71862) c5(fe, ck, I, fr, ft, A, mD, bf, o, aM); #c1(MAPK8IP2) c2(NP_036456) c3(6578) c4(32692, 45749, 58806, 19635, 71863) c5(re, xw, fM, iT, cz); #c1(MAPK8IP3) c2(NP_001035529) c3(6579) c4(32693, 45750, 58807, 19636, 71864) c5(g, ma, kF, ak, b); #c1(MAPK9) c2(NP_001128516) c3(6580) c4(32694, 45751, 58808, 19637, 71865) c5(f, b, k, w, ic, cO, A, e, y, d, co, B, q, M, O, bK, av, u, dh, ma, cV, aC, Bs, cs, v, fO, J, P, T, x, gF, ad, jG, fU, ao, Kj, aA); #c1(MAPKAP1) c2(NP_001006618) c3(6581) c4(32695, 45752, 58809, 19638, 71866) c5(awV, aIU, hb, b, kW, fO, f, dB, g, Ns, J, zM, P, II, QJ, Nq, O); #c1(MAPKAPK2) c2(NP_004750) c3(6582) c4(32696, 45753, 58810, 19639, 71867) c5(da, co, b, kJ, uj, ui, f, fM, fO, ag, A, B, i, aC, fx, fy, u, o); #c1(MAPKAPK3) c2(NP_001230855) c3(6583) c4(32697, 45754, 58811, 19640, 71868) c5(al, f, vQ); #c1(MAPKBPI) c2(NP_001122080) c3(6584) c4(32698, 45755, 58812, 19641, 71869) c5(ac); #c1(MAPRE1) c2(NP_036457) c3(6585) c4(32699, 45756, 58813, 19642, 71870) c5(co, aw, V, b, q, fy, oO, et, at, u, y); #c1(MAPRE2) c2(NP_001137298) c3(6586) c4(32700, 45757, 58814, 19643, 71871) c5(d, KM, fy, aw, b, nQ, ag, ml, e, q, J, nE, yn, oO, ct, U, cp, bj, nW, V); #c1(MAPRE3) c2(NP_001289979) c3(6587) c4(32701, 45758, 58815, 19644, 71872) c5(g, aeQ, kF, b, ayr, nW, Bu, jR, bu, by, yw, lk); #c1(MAPT) c2(NP_001116538) c3(6588) c4(32702, 45759, 58816, 19645, 71873) c5(dx, ak, lr, aWS, aN, xb, GF, aK, tF, t, dZ, oN, g, bK, du, ee, ME, od, cV, OA, cbY, IN, bq, GJ, cbU, bS, X, cbV, hS, dV, bOZ, ai, xw, y, xR, dg, DG, cbX, f, agU, bu, aaZ, cc, aaR, oD, av, cbZ, GS, v, kp, buO, aY, PY, aca, ap, bUn, b, abo, cbW, bg, KN, vY, cbK, ee, nO, Kz, u, o, fh, bmJ, el, gL, by, G, ct, ao, hT, HN, he, ee, aPs, acE, eZ, FE, abr, cca, bj, or, xJ, Vr, nl, aya, aV, aq, AS, afx, acX, J, dt, GR, aj, Sp, eJ, Y, xM, eB, aal, bM, aT); #c1(MARCI) c2(NP_073583) c3(6589) c4(32703, 45760, 58817, 19646, 71874) c5(xq, qt, cO); #c1(MARC2) c2(XP_011507986) c3(6590) c4(32704, 45761, 58818, 19647, 71875) c5(anC, xq, Ij, aeg); #c1(MARCHI) c2(NP_001159845) c3(6591) c4(32705, 45762, 58819, 19648, 71876) c5(bb, I, X, avu, fP, bq, av); #c1(MARCH2) c2(NP_001005415) c3(6592) c4(32706, 45763, 58820, 19649, 71877) c5(b); #c1(MARCH5) c2(NP_060294) c3(6593) c4(32707, 45764, 58821, 19650, 71878) c5(ak, b, dA); #c1(MARCH6) c2(NP_005876) c3(6594) c4(32708, 45765, 58822, 19651, 71879) c5(by, bu, eX, dA); #c1 (MARCH7) c2(NP_001269735) c3(6595) c4(32709, 45766, 58823, 19652, 71880) c5(fl, J); #c1(MARCH8) c2(NP_001002266) c3(6596) c4(32710, 45767, 58824, 19653, 71881) c5(b, I, t, F, dB, q, ad, cU, ag, cT, ik, cs, gD, G, iA); #c1(MARCKS) c2(NP_002347) c3(6597) c4(32711, 45768, 58825, 19654, 71882) c5(eX, b, gG, od, w, C, O, U, y, co, aX, f, g, vQ, ar, cM, cs, u, n, V, cV, gv, P, T, cy, jE, aY, bm, os, fl, bk, dc, bh, mo, rb); #c1(MARCO) c2(NP_006761) c3(6598) c4(32712, 45769, 58826, 19655, 71883) c5(azt, da, bb, aC, fq, iU, lm, pi); #c1(MARK1) c2(NP_001273055) c3(6599) c4(32713, 45770, 58827, 19656, 71884) c5(azt, og, b, dA, cz, MS, bu); #c1(MARK2) c2(NP_001034558) c3(6600) c4(32714, 45771, 58828, 19657, 71885) c5(B, gG, dB, vB, w, e, zi, cy, cl, gl, aC, nx, wo, fO, x, jT, av, sS, ag, bk, Kt, cY, hS, kY, et, bw, U, y, co, f, bu, cs, gg, fy, iT, V, eX, fw, b, MS, d, Pk, nU, q, X, ar, u, dh, o, l, el, LR, ad, aZ, uw, hT, HN, Ox, gd, I, blg, A, bWE, mW, Iv, gE, al, bj, m, gs, aX, h, F, M, ans, aq, be, J, dt, P, Ql, T, Il, by, iv, at, rb); #c1(MARK3) c2(NP_001122390) c3(6601) c4(32715, 45772, 58829, 19658, 71886) c5(kX, aA, cp, aG); #c1(MARK4) c2(NP_001186796) c3(6602) c4(32716, 45773, 58830, 19659, 71887) c5(MS, w, O, o); #c1(MARS2) c2(NP_612404) c3(6603) c4(32717, 45774, 58831, 19660, 71888) c5(ccb); #c1(MARS) c2(NP_004981) c3(6604) c4(32718, 45775, 58832, 19661, 71889) c5(bL, ccc, A); #c1(MARVELDI) c2(NP_13672) c3(6605) c4(32719, 45776, 58833, 19662, 71890) c5(u, q, y, Le); #c1(MARVELD2) c2(NP_001231663) c3(6606) c4(32720, 45777, 58834, 19663, 71891) c5(ccd, TD, Bx); #c1(MARVELD3) c2(NP_001017967) c3(6607) c4(32721, 45778, 58835, 19664, 71892) c5(ag, ar, b); #c1(MASI) c2(NP_002368) c3(6608) c4(32722, 45779, 58836, 19665, 71893) c5(gK, b, bL, aF, jz, bci, aWm, di, sF, cO, O, xl, jQ, cy, sT, fq, sO, mR, sP, pP, aE, I, fx, k, et, su, eq, KK, dP, ch, er, HR, i, aA, hT, vL, ap); #c1(MASIL) c2(NP_443199) c3(6609) c4(32723, 45780, 58837, 19666, 71894) c5(bf, m, aM); #c1(MASP1) c2(NP_001027019) c3(6610) c4(32724, 45781, 58838, 19667, 71895) c5(A, b, z, gE, bf, U, e, aW, d, B, aTO, aV, o, V, be, aTP, AP, aM, QJ, i, I, Xe);

c1(MAST2) c2(XP_011539364) c3(6611) c4(32725, 45782, 58839, 19668, 71896) c5(w, u, y); #c1(MAST4) c2(NP_001158136) c3(6612) c4(32726, 45783, 58840, 19669, 71897) c5(1); #c1(MASTL) c2(NP_001165774) c3(6613) c4(32727, 45784, 58841, 19670, 71898) c5(Wn, Ei); #c1(MATIA) c2(XP_005269899) c3(6614) c4(32728, 45785, 58842, 19671, 71899) c5(mZ, KS, A, b, fN, sa, aBV, di, y, IJ, rY, ni, f, g, se, B, u, em, I, cV, gv, sf, T, bb, dL, jE, aaa, bFJ, bm, hT, Ng, ag, Ns, bFI, sc, bh, Nn, ap); #c1 (MAT2A) c2(NP_005902) c3(6615) c4(32729, 45786, 58843, 19672, 71900) c5(lJ, fl, V, b, cV, jE, bm, Nq, dB, q, ad, Ns, T, iL, cs, x, u); #c1(MAT2B) c2(NP_037415) c3(6616) c4(32730, 45787, 58844, 19673, 71901) c5(qf, vs, ap, cV, bq, Nq, q, sv, Ns, di, IJ, cO, bf, hR, bm, dh, aW, aM); #c1(MATK) c2(NP_002369) c3(6617) c4(32731, 45788, 58845, 19674, 71902) c5(g, co, b, k, f, J, ag, w, cV, x, aA, jT, u, y); #c1(MATN2) c2(NP_002371) c3(6618) c4(32732, 45789, 58846, 19675, 71903) c5(EM, HG, q, k); #c1 (MATN3) c2(NP_002372) c3(6619) c4(32733, 45790, 58847, 19676, 71904) c5(rM, cce, rP, ccf, ID, Dz, f, Dw, rJ, zM, kB, rL, rH); #c1(MATR3) c2(NP_001181883) c3(6620) c4(32734, 45791, 58848, 19677, 71905) c5(WG, nl, jj, P, cch, i, jk, I, oD, ccg, aq, xl, n); #c1(MAU2) c2(NP_056144) c3(6621) c4(32735, 45792, 58849, 19678, 71906) c5(d, co, aX, b, re, F, aNS, nT, e); #c1(MAVS) c2(NP_001193420) c3(6622) c4(32736, 45793, 58850, 19679, 71907) c5(cck, en, b, X, mW, gE, al, y, m, Ei, aX, ajd, DM, hN, dQ, cci, av, aV, u, gl, Dg, gL, pF, aFj, II, cy, ccj); #c1(MAX) c2(NP_002373) c3(6623) c4(32737, 45794, 58851, 19680, 71908) c5(fU, V, b, cV, uj, ui, eX, bp, py, anG, ar, jR, O, Eg, eF); #c1(MAZ) c2(NP_001036004) c3(6624) c4(32738, 45795, 58852, 19681, 71909) c5(dx, be, gG, bxC, Nw, h, du, cz, dv, P, w, Pv, VP, bf, aT, u, LP, y, aM); #c1(MB21D1) c2(NP_612450) c3(6625) c4(32739, 45796, 58853, 19682, 71910) c5(ol, he); #c1(MB2ID2) c2(NP_848591) c3(6626) c4(32740, 45797, 58854, 19683, 71911) c5(dA); #c1 (MBD1) c2(NP_001191065) c3(6627) c4(32741, 45798, 58855, 19684, 71912) c5(A, pV, b, vZ, bw, co, ip, B, ar, cs, oO, av, Qx, eg, si, gB, iv, bp, cz, T, ny, FG, nV, BX, TD, ag, cT); #c1(MBD2) c2(NP_003918) c3(6628) c4(32742, 45799, 58856, 19685, 71913) c5(by, A, jT, b, X, ey, mW, kB, w, di, iL, U, ft, oO, y, jx, jh, biX, co, BL, kJ, h, B, q, jV, bu, fr, ar, O, iv, n, av, QJ, u, gl, ccl, g, bm, V, bcU, cV, Be, nz, cs, Ij, j, J, W, T, aZ, jl, fx, ad, fp, avY, HL, jE, fy, arY, iR, nJ, m, aNP, i, I, vZ, cl); #c1(MBD3) c2(NP_001268382) c3(6629) c4(32743, 45800, 58857, 19686, 71914) c5(co, pV, b, bx, jV, cz, vZ, qB, fy); #c1(MBD3L2) c2(NP_653215) c3(6630) c4(32744, 45801, 58858, 19687, 71915) c5(bu); #c1(MBD4) c2(NP_001263199) c3(6631) c4(32745, 45802, 58859, 19688, 71916) c5(by, A, b, X, jt, U, bu, hP, y, jh, co, aX, B, es, Em, ar, O, cs, EG, aV, u, V, m, aC, j, cz, W, bp, x, ad, av, fy, jR, ag, i, I); #c1(MBD5) c2(NP_060798) c3(6632) c4(32746, 45803, 58860, 19689, 71917) c5(nO, S, ccm, ak, q, cz, ih, hS, rQ, afb, bb); #c1(MBD6) c2(NP_443129) c3(6633) c4(32747, 45804, 58861, 19690, 71918) c5(ac, cz); #c1(MB) c2(XP_005261662) c3(6634) c4(32748, 45805, 58862, 19691, 71919) c5(ccn, OG, b, pR, dB, xl, aNQ, y, jx, c, co, pw, kW, jd, f, ar, cl, nl, oD, fy, u, rP, cV, Bs, jo, T, aH, bq, at, BK); #c1(MBIP) c2(NP_001138363) c3(6635) c4(32749, 45806, 58863, 19692, 71920) c5(u, y); #c1(MBL2) c2(XP_011538118) c3(6636) c4(32750, 45807, 58864, 19693, 71921) c5(avO, dx, by, en, axx, bPH, bx, aem, sE, rr, iU, aE, Ka, eW, sJ, w, hM, ku, aEK, pV, O, bu, OH, xl, ccy, fl, dv, cy, t, AX, aDx, bOx, Pn, iT, dl, ix, hN, jD, aD, Zv, gl, aoc, jH, aDk, nl, yL, du, fO, sy, avb, gY, vc, xO, vM, gt, jT, cct, aw, dH, aFy, aV, aZS, iL, dS, aei, bm, bMf, acs, tO, aEL, fc, cT, rt, pH, bk, i, aC, bg, aA, bT, bae, aWj, bla, id, td, Kt, kN, X, z, wF, Kc, mk, ax, NH, mA, bf, U, Jo, acF, y, aMm, co, BL, fm, pp, cce, DM, f, aWQ, ii, pi, ky, cs, JX, aDM, UM, av, fy, aOS, pW, aFi, aBv, nl, yV, ae, vr, yY, RY, ajl, Dp, gv, vm, pq, bks, bt, yc, aEP, pi, akG, sT, ecu, dO, Eh, Bm, aos, Oa, P, dY, aYE, aDL, aFW, gA, iu, bsl, aoh, bee, gB, fW, ij, aG, aFI, WH, hV, ny, b, bL, sH, aF, atU, vY, A, NU, tG, boq, aAL, IS, LP, jh, qH, bb, re, qd, q, ap, acO, bsf, dQ, ac, tg, as, ajJ, pY, dh, o, fh, aNu, PJ, tw, sQ, Zz, I, im, ir, kt, ht, gL, ad, ccq, CM, G, wu, bPF, mW, aZ, bn, et, aeo, iw, nV, eV, ig, fD, u, eQ, ccs, aOg, Ht, fu, yr, gd, kC, aFm, aFk, zO, hip, I, Vs, zH, aCL, QU, bNT, Ic, vg, xu, gU, xa, bvu, fw, gn, gN, ccx, di, axu, bTh, gE, aZR, al, bj, vl, Kp, Io, oy, vH, V, jl, aej, sS, ty, aQk, wG, h, ox, abh, bsm, ccp, aW, bK, ccv, apW, jZ, iq, ccw, ccr, ma, adK, aFV, aPQ, m, an, sj, aWg, be, Fs, J, fl, Ej, iB, axl, Ei, II, bh, aDA, Bb, Pk, ge, aM, nk, bnn, zE, NG, vu, hq, MP, tA, aBF, Dl, fP, fq, atR, tk, aT, at, Nu, gf); #c1(MBNLI) c2(NP_066368) c3(6637) c4(32751, 45808, 58865, 19694, 71922) c5(fl, el, az, au, bzu, oD, Pk); #c1(MBNL2) c2(NP_659002) c3(6638) c4(32752, 45809, 58866, 19695, 71923) c5(oD, el, mo, bf); #c1(MBOAT1) c2(NP_001073949) c3(6639) c4(32753, 45810, 58867, 19696, 71924) c5(dA); #c1(MBOAT2) c2(NP_620154) c3(6640) c4(32754, 45811, 58868, 19697, 71925) c5(U, V); #c1(MBOAT4) c2(XP_011542911) c3(6641) c4(32755, 45812, 58869, 19698, 71926) c5(em, I, f, jJ, bt, aA, u, y); #c1(MBP) c2(NP_001020252) c3(6642) c4(32756, 45813, 58870, 19699, 71927) c5(mZ, ach, en, kE, cG, vD, iU, aN, aaO, qQ, w, vZ, dV, iL, fg, aK, jD, O, ajb, ny, m, bb, LI, oj, Kp, h, k, q, bu, dZ, A, p, pB, alb, u, jZ, o, ccz, bm, si, ez, ccA, ajc, aC, hZ, GS, Fs, v, Dq, J, bel, CM, ME, bmV, bks, OB, cy, cz, HL, P, aL, aV, nb, IS, iy, fc, ch, vc, dY, ex, by, iZ, NU, fl, t, iB, bq, jl, ccB, aBF, Jo); #c1(MBTD1) c2(XP_005257525) c3(6643) c4(32757, 45814, 58871, 19700, 71928) c5(g, Tw); #c1(MBTPS1) c2(NP_003782) c3(6644) c4(32758, 45815, 58872, 19701, 71929) c5(dx, en, b, w, bo, A, y, dv, aX, pp, et, Dq, f, q, B, hV, gg, aV, u, dL, bm, du, II, AP, jU, nV, fc, hip, ccC, ex, cT, fP, fN, ji); #c1(MBTPS2) c2(NP_056968) c3(6645) c4(32759, 45816, 58873, 19702, 71930) c5(aTp, dt, aOB, ccJ, ccF, ccG, ccD, cn, f, g, bgr, ccE, mk, ccl, Ni, bXB, alU, acR, ccK, ccH); #c1(MC1R) c2(NP_002377) c3(6646) c4(32760, 45817, 58874, 19703, 71931) c5(Dr, QD, A, pV, b, bHB, iP, mk, aie, ic, cO, auc, ccN, bj, e, y, ccP, d, aPN, jl, aX, adr, hV, bsr, ND, ra, ccL, boq, B, ccM, qB, fH, aV, u, aly, aeM, aub, da, aJV, aif, jC, yA, nV, st, DO, hn, ccO, ih, fJ, agw, tl, aA, Vs); #c1(MC2R) c2(NP_001278840) c3(6647) c4(32761, 45818, 58875, 19704, 71932) c5(f, Ir, b, jj, rd, A, di, bz, Pl, bD, dl, Hq, abe, Nd, jk, ak, Jq, ff, iz, u, aVS, I, vN, W, jo, T, qT, bgu, axG, OS, OW, yE, avP, Vs, aWt); #c1(MC3R) c2(NP_063941) c3(6648) c4(32762, 45819, 58876, 19705, 71933) c5(mz, iU, rd, hS, di, bf, ccQ, y, aCV, rh, eX, aQd, u, Hb, I, jJ, gF, aM, akA, bVn, aA, Vs, ap); #c1(MC4R) c2(NP_005903) c3(6649) c4(32763, 45820, 58877, 19706, 71934) c5(dx, eX, jT, b, em, jJ, rd, di, bf, U, hP, iA, aW, oy, co, aX, rh, dl, f, cU, aQd, y, bYO, u, wR, Hb, kF, V, I, dA, Fb, du, cx, J, gF, dv, x, cy, qg, MO, aM, bSr, gs, EZ, mz, aaf, fN, aoq, ih, vF, aeB, aA, Vs); #c1(MC5R) c2(NP_005904) c3(6650) c4(32764, 45821, 58878, 19707, 71935) c5(ccR, yQ, I, ak, rd, aA, Vs, rn); #c1(MCAM) c2(NP_006491) c3(6651) c4(32765, 45822, 58879, 19708, 71936) c5(A, b, cY, Ev, iP, eu, Hj, mk, aEO, iG, jC, pz, y, ND, LS, f, N, cy, tv, X, ar, B, Vk, av, aV, u, ff, rN, aC, jo, cU, T, aZ, aX, iA, pi, of, Vb, DO, gd, fg, zO, fD, I, ccS, pv); #c1(MCAT) c2(NP_055322) c3(6652) c4(32766, 45823, 58880, 19709, 71937) c5(dx, f, b, dB, vY, w, z, bf, O, A, y, dv, bOn, B, q, aW, cs, u, jZ, jB, I, cV, qL, du, v, ad, P, jT, fM, aM, nV, ni, ap); #c1(MCCCI) c2(NP_064551) c3(6653) c4(32767, 45824, 58881, 19710, 71938) c5(bj, eV, ae); #c1(MCCC2) c2(NP_071415) c3(6654) c4(32768, 45825, 58882, 19711, 71939) c5(ccU, kC, bb, ccT, ku); #c1(MCCDI) c2(NP_001011700) c3(6655) c4(32769, 45826, 58883, 19712, 71940) c5(da, m, aV, ix, aiT); #c1(MCC) c2(NP_001078846) c3(6656) c4(32770, 45827, 58884, 19713, 71941) c5(by, nU, b, dB, A, iL, et, U, Oh, e, y, d, co, bb, nC, B, q, bu, eE, ar, cs, aD, fy, u, fU, V, Zg, bp, gv, W, Ce, T, Qt, cy, cz, Yp, qt, pp, ag, bh, Mp); #c1(MCEE) c2(NPJI5990) c3(6657) c4(32771, 45828, 58885, 19714, 71942) c5(ccV, GU); #c1(MCF2) c2(NP_001093325) c3(6658) c4(32772, 45829, 58886, 19715, 71943) c5(oy, ae, OJ, bgP, vu, Fg, yq, wy, y); #c1(MCF2L2) c2(NP_055893) c3(6659) c4(32773, 45830, 58887, 19716, 71944) c5(ccW, kF, I, yp, dZ, ix, dV, fD, aE); #c1(MCF2L) c2(NP_001106203) c3(6660) c4(32774, 45831, 58888, 19717, 71945) c5(b, ag, an, dB, ni, P, WA, iL, as, bM, u, aNQ, y, ap); #c1(MCFD2) c2(NP_001164979) c3(6661) c4(32775, 45832, 58889, 19718, 71946) c5(wV, acm, ps, qz, Oj, wP, aUJ, aUR, ccX, eN, bgE, bpY); #c1(MCHRI) c2(NP_005288) c3(6662) c4(32776, 45833, 58890, 19719, 71947) c5(ak, pV, ns, nm, nt, ng, nr, nn, no, np, cM, aX, f, vu, qB, da, dj, I, cV, W, aY, dc, aA); #c1(MCHR2) c2(NP_001035269) c3(6663) c4(32777, 45834, 58891, 19720, 71948) c5(aeB, ns, nm, nt, ng, nr, nn, aLH, no, np, abm, BL, Ig, rh, ak, Fg, Id, hW, qb, W, dU, Ca, gD, Ew, rd, ag, aA, ap); #c1(MCIDAS) c2(NP_001177716) c3(6664) c4(32778, 45835, 58892, 19721, 71949) c5(f, yO, bg, tF, aal, PV, o, fh); #c1(MCMI0) c2(NP_060988) c3(6665) c4(32779, 45836, 58893, 19722, 71950) c5(fh, qf, bb, b, I, jh, re, bq, at, iT, ap); #c1(MCM2) c2(NP_004517) c3(6666) c4(32780, 45837, 58894, 19723, 71951) c5(A, aw, b, X, aGu, dB, aqt, bkA, U, y, E, jT, aX, aJK, jd, t, h, f, F, q, Uq, ar, B, cB, iv, n, av, fy, u, iT, ff, fe, kF, V, I, cs, fO, gv, W, P, T, pD, x, ad, iw, iR, jR, cT, i, azb, bh, re); #c1(MCM3AP) c2(XP_006724127) c3(6667) c4(32781, 45838, 58895, 19724, 71952) c5(aX, b, cG, fH, jT, fJ, O); #c1(MCM3) c2(NP_001257401) c3(6668) c4(32782, 45839, 58896, 19725, 71953) c5(g, aX, b, jd, NZ, DO, q, jR, J, P, T, u); #c1(MCM4) c2(NP_877423) c3(6669) c4(32783, 45840, 58897, 19726, 71954) c5(jR, b, jd, ccY, re, DO, J, fO, cT, bO, ar, iT, cB, fy, u, Ld, pg); #c1(MCM5) c2(NP_006730) c3(6670) c4(32784, 45841, 58898, 19727, 71955) c5(cW, A, aw, il, b, jd, re, hV, fO, mk, cT, ar, B, i, x, fx, aoK, u, akn); #c1(MCM6) c2(NP_005906) c3(6671) c4(32785, 45842, 58899, 19728, 71956) c5(aAZ, jT, X, dB, jd, T, ff, aMh, aMi, u); #c1(MCM7) c2(NP_005907) c3(6672) c4(32786, 45843, 58900, 19729, 71957) c5(by, f, aw, b, dB, pD, A, bkA, U, Uq, fx, y, jx, d, E, YX, aJK, jd, t, h, hV, e, q, bu, cU, aJQ, B, cB, iv, ar, av, fy, u, iT, ff, fe, kF, V, cV, cs, n, j, gv, W, P, T, fO, iA, ad, iw, jT, ii, cz, iR, DO, jR, ag, cT, i, azb, bh, re); #c1(MCM8) c2(NP_001268449) c3(6673) c4(32787, 45844, 58901, 19730, 71958) c5(aC, od, he, aX, fi); #c1 (MCM9) c2(NP_060166) c3(6674) c4(32788, 45845, 58902, 19731, 71959) c5(g); #c1(MCMBP) c2(NP_001243307) c3(6675) c4(32789, 45846, 58903, 19732, 71960) c5(oy); #c1(MCOLN1) c2(NP_065394) c3(6676) c4(32790, 45847, 58904, 19733, 71961) c5(bfg, asx, bK, LG, tz, v, AG, P, dR, xl); #c1(MCOLN3) c2(XP_011540041) c3(6677) c4(32791, 45848, 58905, 19734, 71962) c5(aQp); #c1(MCPHI) c2(NP_001166045) c3(6678) c4(32792, 45849, 58906, 19735, 71963) c5(dx, b, X, w, bw, O, y, dv, nU, ccZ, gL, hN, ar, ait, av, u, GS, cV, Be, du, cz, ais, T, QZ, WS, fM, pb, iw, rQ, zE, ag, oi, alX, at); #c1(MCRS1) c2(NP_001012300) c3(6679) c4(32793, 45850, 58907, 19736, 71964) c5(co, V, b, f, w, Pl, U, fy, aq, O); #c1(MCTP1) c2(NP_001002796) c3(6680) c4(32794, 45851, 58908, 19737, 71965) c5(bq, ak, dA); #c1(MCTP2) c2(NP_001153115) c3(6681) c4(32795, 45852, 58909, 19738, 71966) c5(bP, dA, aY, Ks, ix, GF, fD, cA, bq, aA, at); #c1(MCTS1) c2(NP_001131026) c3(6682) c4(32796, 45853, 58910, 19739, 71967) c5(B, b, hY, w, A, O, co, Ec, f, fr, y, u, cV, gm, fO, ft, T, gF, jT, fM, cf, fP, mD); #c1(MCU) c2(NP_001257608) c3(6683) c4(32797, 45854, 58911, 19740, 71968) c5(cda, b); #c1(MCUR1) c2(NP_001026883) c3(6684) c4(32798, 45855, 58912, 19741, 71969) c5(fl); #c1(MDC1) c2(NP_055456) c3(6685) c4(32799, 45856, 58913, 19742, 71970) c5(m, A, b, cT, ix, ar, bw); #c1 (MDFIC) c2(NP_001159817) c3(6686) c4(32800, 45857, 58914, 19743, 71971) c5(aci); #c1(MDFI) c2(NP_001287733) c3(6687) c4(32801, 45858, 58915, 19744, 71972) c5(ap); #c1(MDGA1) c2(NP_705691) c3(6688) c4(32802, 45859, 58916, 19745, 71973) c5(cA, ak); #c1(MDGA2) c2(NP_001106970) c3(6689) c4(32803, 45860, 58917, 19746, 71974) c5(oy, m, Et, cz, agT, aC, akp); #c1(MDH1) c2(NP_001186040) c3(6690) c4(32804, 45861, 58918, 19747, 71975) c5(ao, w, di); #c1(MDH2) c2(NP_005909) c3(6691) c4(32805, 45862, 58919, 19748, 71976) c5(Ag, A, js, b, bx, B, yp, P, T, Af, cO, bq, Gj, fh); #c1(MDK) c2(NP_001257481) c3(6692) c4(32806, 45863, 58920, 19749, 71977) c5(Dr, by, A, aw, b, k, X, afY, i, wy, aZE, YO, w, dV, iG, O, U, G, Tj, y, Zz, d, jR, cn, bk, kJ, jd, t, re, f, e, q, yE, bu, fr, EM, dZ, ik, B, cs, as, av, fy, u, dh, ajz, R, g, wK, o, fe, V, cV, an, be, fz, ad, W, aiJ, fl, T, iD, ji, x, og, iA, ft, fp, P, bq, iT, fx, fw, agb, ih, ag, cT, oN, tl, aDw, aC, mD, fh, eG); #c1(MDM1) c2(NP_001191957) c3(6693) c4(32807, 45864, 58921, 19750, 71978) c5(bf, ak, aW, nQ, at); #c1(MDM2) c2(NP_001138809) c3(6694) c4(32808, 45865, 58922, 19751, 71979) c5(dx, jp, ml, pV, iD, rR, EM, gG, dB, Ip, w, hC, aw, jq, e, O, M, dv, b, kJ, t, axd, Gp, iZ, cl, cdc, QB, fH, amq, Zv, R, TV, WZ, og, bwZ, aC, Xc, du, yO, gm, bp, ft, GK, iJ, Ce, od, vM, x, fx, jT, fp, cq, wh, BX, aEs, Qk, azy, DO, ag, cT, qP, iT, i, dc, jl, ib, Dr, GD, fO, kN, cY, afY, iP, jz, eu, wy, afR, GM, kY, IW, bw, U, cdf, cM, tp, Nm, co, ip, wP, f, bbG, bu, B, cs, Qw, av, fy, bm, kQ, QD, jM, jB, V, jh, Bs, n, Qz, gv, bt, bny, jC, iA, bUR, fj, GQ, aJh, py, aY, QG, jo, jR, Le, fG, jd, tl, ji, pv, ck, ny, am, zH, aF, anb, Hr, Qy, QR, cdi, ic, z, aiR, pF, jQ, BQ, Mr, d, Ag, Iz, QO, Bc, re, hV, PA, q, es, aug, OC, ar, ac, VM, cdb, fv, jG, Tv, u, ff, PJ, fs, jE, il, gL, nJ, gL, ad, alT, vS, pD, rB, oi, aeC, agh, yG, P, iw, wV, nV, kB, iR, Dj, Sk, cX, agf, dn, I, yA, af, cdh, g, ede, A, IO, iG, k, fr, Lv, bn, HJ, gN, BY, QQ, iL, zK, al, Bz, yw, iK, jx, QV, aX, LI, ty, bn, h, F, jA, cU, hN, ik, y, cB, gB, fM, QJ, jZ, jH, cV, YR, edd, Fs, J, po, GB, dU, ajF, T, II, Ez, cdg, nP, by, bjs, qT, aqa, aHE, Ic, G, hq, rb, bHV, bh, X, ja, iE); #c1(MDM4) c2(NP_001191100) c3(6695) c4(32809, 45866, 58923, 19752, 71980) c5(jp, hg, aw, dB, w, e, O, t, dn, cl, kX, g, fe, cs, fO, ft, jT, lu, BX, DO, ag, cT, bk, i, bT, if, cY, iP, jz, jf, hS, iG, bo, cA, Iw, U, y, co, ip, f, bu, B, iv, av, fy, bm, fi, V, ny, GQ, iY, b, d, jh, bh, hV, q, X, ar, jG, u, ad, G, iO, nV, A, kY, k, fr, pD, Iv, iM, jQ, aX, h, F, Nm, cB, jx, fU, cV, J, Ix, P, T, by, at, iE); #c1(ME1) c2(NP_002386) c3(6696) c4(32810, 45867, 58924, 19753, 71981) c5(d, co, aX, I, k, aiV, B, jl, q, w, fP, O, A, fy, aA, QJ, u, e, y); #c1(ME2) c2(NP_001161807) c3(6697) c4(32811, 45868, 58925, 19754, 71982) c5(jr, A, aX, k, hY, ak, J, he, fl, fP, B, Wf, CG); #c1(ME3) c2(NP_001155058) c3(6698) c4(32812, 45869, 58926, 19755, 71983) c5(fP, A, aX, B, k); #c1(MEA1) c2(NP_055438) c3(6699) c4(32813, 45870, 58927, 19756, 71984) c5(nP, b); #c1(MECOM) c2(NP_001098547) c3(6700) c4(32814, 45871, 58928, 19757, 71985) c5(fn, b, X, jq, sE, jL, aFe, cO, U, oU, y, py, jh, qf, eM, kJ, t, h, f, N, jV, e, cU, O, cB, iv, oO, av, fy, u, n, cj, d, V, lb, cs, J, ad, hi, P, pt, x, pw, pF, jG, pq, ao, M, pr, hD, ie, G, cT, fg, oM, pJ, ci); #c1(MECP2) c2(NP_001104262) c3(6701) c4(32815, 45872, 58929, 19758, 71986) c5(aw, sE, dd, KF, aev, qc, gl, aC, nx, nz, aqi, bp, cdk, rQ, QZ, aei, m, aVH, dc, aY, oH, hS, U, cC, cM, alS, co, BL, dg, pp, B, bu, gg, fy, V, ae, cdm, IG, cdq, ck, b, au, cdp, aga, Wk, nU, q, NJ, ahh, fv, u, ED, PJ, kt, LR, j, cz, CM, ew, Nh, cdo, KK, aVI, iR, amJ, hT, Qx, ih, IC, rv, ahm, af, FY, aJd, A, gw, mW, vZ, iL, dl, cdn, S, KA, xJ, iZ, y, cdl, bK, bdV, aq, hW, apx, cV, dt, fO, bvz, by, AP, yl, ast, xM, agw, bM, cdj); #c1(MEDI2) c2(NP_005111) c3(6702) c4(32816, 45873, 58930, 19759, 71987) c5(amq, nU, b, alN, apC, ak, jj, cdr, AB, HZ, A, hM, dV, cO, cA, Ji, U, e, cM, ez, d, bUu, QV, bb, cdv, kW, oj, f, q, oJ, ZB, dZ, mg, B, cs, Ig, oD, wh, fy, u, o, awS, aNN, hW, V, fC, Tw, bK, nz, bgW, BC, v, bN, acU, awT, cr, cz, aAl, an, iK, aY, DP, er, mU, he, cdu, na, cdt, cds, cdw, dc, di, cG, vL, dB); #c1(MEDI2L) c2(NP_443728) c3(6703) c4(32817, 45874, 58931, 19760, 71988) c5(oy, ow, di, cV); #c1(MEDI3) c2(NP_005112) c3(6704) c4(32818, 45875, 58932, 19761, 71989) c5(em, wh, cr, f, oJ, aA, oG); #c1(MEDI3L) c2(NP_056150) c3(6705) c4(32819, 45876, 58933, 19762, 71990) c5(aLp, acw, nU, cr); #c1(MEDI4) c2(NP_004220) c3(6706) c4(32820, 45877, 58934, 19763, 71991) c5(eG, P, u, y, m); #c1(MEDI5) c2(NP_001003891) c3(6707) c4(32821, 45878, 58935, 19764, 71992) c5(gG, jh, MT, A, da, b, B, g, K, J, cU, T, afb, cs, Jk, et, ad, IA); #c1(MEDI6) c2(NP_005472) c3(6708) c4(32822, 45879, 58936, 19765, 71993) c5(eG); #c1(MEDI7) c2(NP_004259) c3(6709) c4(32823, 45880, 58937, 19766, 71994) c5(eG, cdx, A, B); #c1(MEDI9) c2(NP_703151) c3(6710) c4(32824, 45881, 58938, 19767, 71995) c5(A, b, fr, B, ft, co, i, ji, fx, fy, u, y); #c1(MEDI) c2(NP_004765) c3(6711) c4(32825, 45882, 58939, 19768, 71996) c5(en, axx, b, X, jt, hS, A, jR, U, bu, y, jx, aX, h, B, q, es, ar, av, fy, u, V, aDM, ad, by, mA, ag, ji, eG); #c1(MED22) c2(NP_598395) c3(6712) c4(32826, 45883, 58940, 19769, 71997) c5(cy); #c1(MED23) c2(NP_001257451) c3(6713) c4(32827, 45884, 58941, 19770, 71998) c5(jh, aX, b, cY, nU, mN, fl, di, cO, mQ, cdy); #c1(MED24) c2(NP_001072986) c3(6714) c4(32828, 45885, 58942, 19771, 71999) c5(cy); #c1(MED25) c2(NPJI2235) c3(6715) c4(32829, 45886, 58943, 19772, 72000) c5(aUa, cG, sG, bAU, aq, Y, q, ac, Pl, bNP, cdz, u, y); #c1(MED28) c2(NP_079481) c3(6716) c4(32830, 45887, 58944, 19773, 72001) c5(A, u, B, y); #c1(MED29) c2(NP_060692) c3(6717) c4(32831, 45888, 58945, 19774, 72002) c5(ag); #c1(MED30) c2(NP_542382) c3(6718) c4(32832, 45889, 58946, 19775, 72003) c5(lo); #c1(MED4) c2(NP_001257558) c3(6719) c4(32833, 45890, 58947, 19776, 72004) c5(eG, cB); #c1(MED6) c2(NP_001271138) c3(6720) c4(32834, 45891, 58948, 19777, 72005) c5(e0); #c1(MED9) c2(NP_060489) c3(6721) c4(32835, 45892, 58949, 19778, 72006) c5(yK, ac); #c1(MEF2A) c2(NP_005578) c3(6722) c4(32836, 45893, 58950, 19779, 72007) c5(cdA, hS, di, cO, bf, y, aoa, bQ, nQ, ml, f, wN, g, mR, sK, u, o, oy, kF, I, bK, el, cz, cK, hR, aM, ch, QG, jR, bq, at, ap); #c1(MEF2B) c2(NP_001139257) c3(6723) c4(32837, 45894, 58951, 19780, 72008) c5(aV); #c1 (MEF2BNB-MEF2B) c2(NP_005910) c3(6724) c4(32838, 45895, 58952, 19781, 72009) c5(aV); #c1(MEF2C) c2(NP_001124477) c3(6725) c4(32839, 45896, 58953, 19782, 72010) c5(nU, WW, xj, cdB, hS, cO, cM, oy, m, S, or, Wk, ml, f, q, M, hb, u, aJd, nQ, bK, aqi, dk, J, cz, P, cK, aFe, ch, aq, agw, I, bq, h, ap); #c1(MEF2D) c2(XP_005245226) c3(6726) c4(32840, 45897, 58954, 19783, 72011) c5(vf, bb, I, b, sG, t, f, q, gm, vW, G, cl, bf, J, bj); #c1(MEFV) c2(NP_000234) c3(6727) c4(32841, 45898, 58955, 19784, 72012) c5(dx, sE, aPi, aWm, w, eD, O, gO, BO, dv, cy, b, dl, do, aC, du, fO, cdF, jT, dH, re, Di, bk, fD, bq, asL, id, td, X, bKn, ix, cdE, y, gd, Dq, f, av, Zn, nl, rT, iV, xe, Om, Im, ci, ij, am, aF, fl, cdD, bQO, agy, cdG, aRr, LP, zc, q, jG, u, o, Ik, fs, VD, im, qJ, pF, jU, jH, hU, aLQ, Zl, El, aof, A, iC, rp, m, or, ty, wG, h, F, M, n, fP, aV, ax, be, dt, P, On, eJ, cdG, pG, I, aT, at, rr); #c1(MEGF10) c2(NP_115822) c3(6728) c4(32842, 45899, 58956, 19785, 72013) c5(At, oD, qf, eG, cdH); #c1(MEGF11) c2(NP_115821) c3(6729) c4(32843, 45900, 58957, 19786, 72014) c5(Eo, bq, at, bb, dA); #c1(MEGF8) c2(NP_001258867) c3(6730) c4(32844, 45901, 58958, 19787, 72015) c5(by, aw, V, b, py, u, f, bDm, q, cdl, ad, bDp, ar, cr, cs, Ph, U, bu, axk, y); #c1(MEGF9) c2(NP_001073966) c3(6731) c4(32845, 45902, 58959, 19788, 72016) c5(u, y); #c1(MEII) c2(NP_689726) c3(6732) c4(32846, 45903, 58960, 19789, 72017) c5(wn); #c1(MEIS1) c2(NP_002389) c3(6733) c4(32847, 45904, 58961, 19790, 72018) c5(bP, A, b, U, y, cr, zo, t, h, B, N, jV, M, zb, iv, u, Fg, n, V, dA, lb, J, awu, G, T, cV, x, hT, fD, ci); #c1(MEIS2) c2(NP_002390) c3(6734) c4(32848, 45905, 58962, 19791, 72019) c5(A, cV, B, dA, qu, rV, ap); #c1(MELK) c2(NP_001243614) c3(6735) c4(32849, 45906, 58963, 19792, 72020) c5(g, by, A, b, k, f, q, Le, gP, w, fl, B, O, bu, u, y); #c1(MEMO1) c2(NP_001131074) c3(6736) c4(32850, 45907, 58964, 19793, 72021) c5(cV); #c1(MEN1) c2(NP_570711) c3(6737) c4(32851, 45908, 58965, 19794, 72022) c5(B, aw, bx, EM, HC, bf, jR, Hq, iy, DE, bll, bZb, jF, avP, bzz, og, vO, vN, ape, bov, azo, Jj, x, fx, jT, HR, wh, cdJ, ag, i, bkv, mD, ib, bP, X, oa, bNB, ig, OO, bw, U, y, co, yE, f, beP, aKF, iv, bv, kN, fy, OT, iT, iF, vR, fD, qq, aTi, VP, cdK, ahT, W, aJX, Fz, anG, nc, cf, aNp, Le, ji, ap, b, jq, Bh, ic, gF, ra, jd, bUJ, re, q, age, ar, RF, Km, fv, u, wR, jj, I, jz, Xu, aHE, ct, Ut, US, nV, hX, aAV, ON, ih, abO, Bm, D, OS, QU, ZB, A, fr, di, Iv, Ld, jQ, aX, yx, gT, Ir, aAO, aAS, cV, YR, J, dt, P, T, bp, nP, ft, aM, qp, ii, TU, OP, zM, aKM, Yv, bll, at); #c1(MEOX1) c2(NP_001035091) c3(6738) c4(32852, 45909, 58966, 19795, 72023) c5(X, gj, av, bAZ, cdL); #c1(MEOX2) c2(NP_005915) c3(6739) c4(32853, 45910, 58967, 19796, 72024) c5(at, q, o); #c1(MEP1A) c2(NP_005579) c3(6740) c4(32854, 45911, 58968, 19797, 72025) c5(x, sG, fP, jH); #c1(MEPE) c2(NP_001171623) c3(6741) c4(32855, 45912, 58969, 19798, 72026) c5(dx, by, B, aw, yj, dD, oz, iX, dB, HG, w, hM, AD, cO, bf, O, KK, pz, e, xl, cp, yg, bLd, dv, iy, kJ, kT, t, gB, yh, IX, mR, wY, bsO, eg, EM, R, g, azZ, aPf, fe, cdS, p, du, xk, ft, Ce, x, YT, fx, jT, OA, bfD, dH, wh, cdR, qt, vz, iL, aei, hx, azy, ie, aeR, ag, cT, pv, cdN, i, Aw, mD, GJ, bP, id, cG, X, aHb, vj, jz, awm, kB, fU, kY, bo, Eh, U, Co, y, co, gd, ak, N, aWQ, bu, bXx, cs, iv, av, fy, bm, iT, cdM, cj, qw, V, jh, nl, aDV, gv, IR, afz, YS, bg, By, cK, iA, bfo, Oc, uM, wp, anG, nJ, fG, cz, aiC, gO, abs, Im, bfN, iu, ci, FG, ap, hV, b, jJ, Hq, Bi, ga, jj, z, jy, re, fD, ao, d, aeQ, wZ, bb, avH, oB, nU, g, jV, acO, bgf, ff, n, ar, jG, u, aE, o, biT, arQ, I, gL, bc, ad, blF, G, wu, rw, et, aeC, kS, nV, ig, iR, Ck, Dj, aof, aer, rv, auM, di, UT, C, azt, bL, A, iG, Lw, k, fr, cdP, cA, BY, hi, dY, JG, gE, Ez, al, jR, axQ, jw, sb, jQ, m, gs, IZ, aX, cdQ, bxB, h, F, cU, aC, oJ, aV, bev, ajt, sk, ax, si, cV, Be, BG, J, W, P, cdO, T, Oi, Ap, fM, aM, eJ, iK, Y, AR, age, bh, at, amK); #c1(MERTK) c2(NP_006334) c3(6742) c4(32856, 45913, 58970, 19799, 72027) c5(dx, fl, b, mW, w, ps, y, m, dv, kn, t, ml, cl, Dc, cdT, aV, u, gl, wY, g, sQ, nR, nQ, nW, du, J, G, T, jT, ac, iw, dO, ie, nJ, nE, Nx, h); #c1(MESDC1) c2(NP_072088) c3(6743) c4(32857, 45914, 58971, 19800, 72028) c5(oy, bq, fx, i); #c1(MESDC2) c2(NP_055969) c3(6744) c4(32858, 45915, 58972, 19801, 72029) c5(sf); #c1(MESP2) c2(NP_001035047) c3(6745) c4(32859, 45916, 58973, 19802, 72030) c5(cdU, bga, bgg); #c1(MEST) c2(NP_001240831) c3(6746) c4(32860, 45917, 58974, 19803, 72031) c5(Me, cg, NT, am, b, X, q, mA, ad, rd, T, mF, i, cs, I, ar, av, ji, u, aA, y); #c1(METAPID) c2(NP_954697) c3(6747) c4(32861, 45918, 58975, 19804, 72032) c5(x, cs, ad); #c1(METAPI) c2(NP_055958) c3(6748) c4(32862, 45919, 58976, 19805, 72033) c5(bf, Xe, aM); #c1(METAP2) c2(NP_006829) c3(6749) c4(32863, 45920, 58977, 19806, 72034) c5(fl, GS, cY, EM, iP, aN, oH, w, jR, y, aX, f, ar, O, gg, aV, u, Qx, o, sB, ae, cV, LR, gm, cz, IR, IX, P, aZ, x, aec, fc, dY, IS); #c1(MET) c2(NP_000236) c3(6750) c4(32864, 45921, 58978, 19807, 72035) c5(gK, KS, B, aw, iD, gG, dB, w, baB, vp, Mn, fx, O, jR, iR, t, e, FN, zb, fH, Hs, Ox, g, eg, aC, ft, ao, bp, iY, rQ, x, aVd, jT, aup, jE, U, Dj, yw, sg, OJ, ag, oi, bk, i, ch, bq, bP, Bt, X, iP, jz, eu, jf, Kc, kB, fU, Ni, iG, cA, bw, vl, y, co, pp, py, adr, f, bu, tv, gX, cs, av, fy, bm, yJ, jM, vR, V, QP, Qz, gv, afz, VP, jC, iA, fJ, JY, aH, gt, Ih, aum, kJ, nJ, Le, ji, kD, Dr, bn, b, fN, Bh, Ji, fD, js, d, jh, SS, eA, hV, q, ar, ff, Xp, u, cl, aNN, aEf, il, aza, j, ad, pF, Sq, Io, Vw, ct, jH, aCq, nV, cdV, Bu, SJ, he, Sk, El, I, bln, A, IO, aov, k, fr, pR, pD, Iv, iL, gE, zK, fs, VJ, jx, aX, h, F, jQ, buk, cU, ik, n, PT, aV, ma, cV, bXf, Fs, J, W, jo, QI, T, fO, nP, cz, aNp, qp, btS, QN, adu, by, XH, jN, Sv, bh, eG, cdW); #c1(METRN) c2(NP_076947) c3(6751) c4(32865, 45922, 58979, 19808, 72036) c5(bK, v); #c1(METTLI3) c2(NP_001007240) c3(6752) c4(32866, 45923, 58980, 19809, 72037) c5(jE, jT, bm, q, b); #c1(METTLI6) c2(NP_076991) c3(6753) c4(32867, 45924, 58981, 19810, 72038) c5(bb, aW); #c1(METTLI7) c2(NP_001025162) c3(6754) c4(32868, 45925, 58982, 19811, 72039) c5(kW); #c1(METTLI8) c2(NP_001307130) c3(6755) c4(32869, 45926, 58983, 19812, 72040) c5(fl, di, aO, cp); #c1(METTL1) c2(NP_005362) c3(6756) c4(32870, 45927, 58984, 19813, 72041) c5(aV, XJ, i); #c1(METTL21A) c2(NP_660323) c3(6757) c4(32871, 45928, 58985, 19814, 72042) c5(dA); #c1(METTL21B) c2(NP_056248) c3(6758) c4(32872, 45929, 58986, 19815, 72043) c5(aV); #c1(METTL21C) c2(NP_001010977) c3(6759) c4(32873, 45930, 58987, 19816, 72044) c5(cp); #c1(METTL24) c2(NP_001116836) c3(6760) c4(32874, 45931, 58988, 19817, 72045) c5(bg); #c1(METTL6) c2(XP_005264927) c3(6761) c4(32875, 45932, 58989, 19818, 72046) c5(co, u); #c1(METTL7A) c2(NP_054752) c3(6762) c4(32876, 45933, 58990, 19819, 72047) c5(eG); #c1(METTL9) c2(NP_001070648) c3(6763) c4(32877, 45934, 58991, 19820, 72048) c5(b, an, re, yn, as, Hh, aoK, iT); #c1(MEX3B) c2(NPJI5622) c3(6764) c4(32878, 45935, 58992, 19821, 72049) c5(dA); #c1(MEX3C) c2(NP_057710) c3(6765) c4(32879, 45936, 58993, 19822, 72050) c5(bq, U, di, V, gs); #c1(MEX3D) c2(NP_001167589) c3(6766) c4(32880, 45937, 58994, 19823, 72051) c5(A, B); #c1(MFAP3) c2(NP_001128509) c3(6767) c4(32881, 45938, 58995, 19824, 72052) c5(dA); #c1(MFAP4) c2(NP_001185624) c3(6768) c4(32882, 45939, 58996, 19825, 72053) c5(X, ap); #c1(MFAP5) c2(NP_001284638) c3(6769) c4(32883, 45940, 58997, 19826, 72054) c5(X, av); #c1(MFGE8) c2(NP_001108086) c3(6770) c4(32884, 45941, 58998, 19827, 72055) c5(dx, b, aF, mW, Ey, O, vl, e, y, d, m, dv, aX, ak, bdv, cM, u, dh, du, v, cz, aiL, fx, qt, gt, ch, gl, aFi, i); #c1(MFHASI) c2(NP_004216) c3(6771) c4(32885, 45942, 58999, 19828, 72056) c5(cdX, GF, gm, ac, eo); #c1(MFI2) c2(NP_005920) c3(6772) c4(32886, 45943, 59000, 19829, 72057) c5(og, aX, b, cY, Xu, aN, ME, cdY, T, bV, bh, yq, OJ, o); #c1(MFNI) c2(XP_005247653) c3(6773) c4(32887, 45944, 59001, 19830, 72058) c5(ao, A, b, B, qr, buB); #c1(MFRP) c2(NP_113G21) c3(6774) c4(32888, 45945, 59002, 19831, 72059) c5(pk, eX, sr, nQ, Pa, ml, Bu, md, nv, cea, aA, ceb, ard, cec, cdZ, nE, bnU, kD, nW, aW); #c1(MFSDII) c2(NP_001229466) c3(6775) c4(32889, 45946, 59003, 19832, 72060) c5(fl); #c1(MFSDI2) c2(NP_778148) c3(6776) c4(32890, 45947, 59004, 19833, 72061) c5(b, cV); #c1(MFSDI) c2(NP_073573) c3(6777) c4(32891, 45948, 59005, 19834, 72062) c5(fl); #c1(MFSD6) c2(NP_060164) c3(6778) c4(32892, 45949, 59006, 19835, 72063) c5(ac, cz); #c1(MFSD7) c2(NP_001281270) c3(6779) c4(32893, 45950, 59007, 19836, 72064) c5(T); #c1(MFSD8) c2(NP_689991) c3(6780) c4(32894, 45951, 59008, 19837, 72065) c5(v, sp, ced, LG); #c1(MGA) c2(NP_001074010) c3(6781) c4(32895, 45952, 59009, 19838, 72066) c5(fU, cT, y, oO, u, rb); #c1(MGAM) c2(NP_004659) c3(6782) c4(32896, 45953, 59010, 19839, 72067) c5(d, fU, b, cT, u, e, y); #c1(MGARP) c2(NP_116012) c3(6783) c4(32897, 45954, 59011, 19840, 72068) c5(aC); #c1(MGATI) c2(XP_011532865) c3(6784) c4(32898, 45955, 59012, 19841, 72069) c5(Ew, A, b, aqu, B, he, ky, bf, aA, aV, u, aE, y, aM); #c1(MGAT2) c2(NP_002399) c3(6785) c4(32899, 45956, 59013, 19842, 72070) c5(cee, aA, eq, em); #c1 (MGAT3) c2(NP_001091740) c3(6786) c4(32900, 45957, 59014, 19843, 72071) c5(aX, bm, q, od, iL, aA, u, y); #c1(MGAT4A) c2(NP_001153626) c3(6787) c4(32901, 45958, 59015, 19844, 72072) c5(em, b, ak, od, bw, aA); #c1(MGAT4B) c2(NP_055090) c3(6788) c4(32902, 45959, 59016, 19845, 72073) c5(bw, od, b); #c1(MGAT4C) c2(NP_037376) c3(6789) c4(32903, 45960, 59017, 19846, 72074) c5(bf); #c1(MGAT5B) c2(NP_001186101) c3(6790) c4(32904, 45961, 59018, 19847, 72075) c5(yJ, by, kF, b, bu); #c1(MGAT5) c2(XP_011509505) c3(6791) c4(32905, 45962, 59019, 19848, 72076) c5(gK, A, alz, b, eu, gZ, bj, y, aX, cV, g, bu, cs, aV, u, fh, dA, aC, a YE, bp, ad, W, T, x, bb, by, JY, jH, abN, i); #c1(MGEA5) c2(NP_001135906) c3(6792) c4(32906, 45963, 59020, 19849, 72077) c5(dx, dM, sO, tR, akR, w, di, Vy, cO, bf, U, A, y, awU, dv, I, jd, B, gX, bHM, OA, bDe, u, mz, ma, V, bCW, hZ, du, LG, v, wX, bDd, et, aM, cef, uJ, bHQ, aDH, bHL, bDD, kA, bq, zS, aA, wz); #c1(MGLL) c2(NP_001003794) c3(6793) c4(32907, 45964, 59021, 19850, 72078) c5(A, V, b, Qf, B, ad, W, aiL, O, cs, U, jN, u, aA, y, cp); #c1(MGME1) c2(NP_443097) c3(6794) c4(32908, 45965, 59022, 19851, 72079) c5(ceg, AB, kW); #c1(MGMT) c2(NP_002403) c3(6795) c4(32909, 45966, 59023, 19852, 72080) c5(YZ, pm, B, aw, EM, iX, Vz, amV, w, rc, e, O, M, dl, jU, Rh, Zv, g, asQ, iv, fO, gm, bp, ft, Ce, Jj, x, fx, jT, Ip, DO, os, ag, gP, i, pt, cY, eu, kY, bw, U, y, co, pw, ip, yE, f, vQ, bu, gX, cs, av, fy, aEs, OT, iT, is, iF, auP, V, cx, Qz, gv, pr, jC, iA, Mp, GB, GQ, bkq, iY, jR, oM, WH, ck, b, jq, anb, oi, ic, z, d, jh, jd, re, hV, q, jV, X, OC, ar, fM, u, il, avo, gL, ad, iD, ct, aeC, Lt, jH, nV, iR, py, jc, GM, dn, I, bUR, GK, A, k, fr, Lv, BY, C, iL, IJ, aX, I, awz, h, F, cU, ik, n, cB, bGF, NO, fU, auU, Fs, J, W, T, aox bh, jl, fT, by, ac, st, awA, E, Oi); #c1(MGP) c2(NP_000891) c3(6796) c4(32910, 45967, 59024, 19853, 72081) c5(dx, bL, acm, b, iC, dB, ceh, w, bf, Iw, rH, rJ, U, y, gO, Ag, dv, aX, f, ar, fH, mm, cp, u, wR, aAU, HI, si, V, sH, du, cej, T, et, fJ, sP, aM, dy, dS, cei, er, tO, Af, fD, bq, at, ap); #c1(MGRN1) c2(NP_001135761) c3(6797) c4(32911, 45968, 59025, 19854, 72082) c5(aX, ic, eo); #c1(MGST1) c2(NP_001247440) c3(6798) c4(32912, 45969, 59026, 19855, 72083) c5(d, co, V, cV, f, F, v, bp, es, GB, e, aW); #c1(MGST2) c2(NP_001191295) c3(6799) c4(32913, 45970, 59027, 19856, 72084) c5(da, bw, jG, JH); #c1(MGST3) c2(NP_004519) c3(6800) c4(32914, 45971, 59028, 19857, 72085) c5(di, o, I, cp); #c1(MIA2) c2(NP_473365) c3(6801) c4(32915, 45972, 59029, 19858, 72086) c5(d, q, z, al, bm, e); #c1(MIA3) c2(NP_001287796) c3(6802) c4(32916, 45973, 59030, 19859, 72087) c5(mz, aX, I, pS, q, Is, yE, cT, mA, bq, at, eG, aE); #c1(MIA) c2(NP_001189482) c3(6803) c4(32917, 45974, 59031, 19860, 72088) c5(b, cY, gG, kB, w, D, bw, e, O, d, co, aX, kJ, re, q, bu, ar, cs, fv, aC, J, by, auf, T, Io, bq, ag, all, I, ji, at); #c1(MIB1) c2(NP_065825) c3(6804) c4(32918, 45975, 59032, 19861, 72089) c5(YZ, aw, cem, EM, awh, dB, HG, w, hC, rc, e, O, avu, cl, acy, g, aHN, fe, aC, Dt, HH, gm, fO, gY, aiL, Jj, avi, fx, jT, fp, bgc, wh, DO, yE, gP, bkQ, i, Dr, apF, X, aGu, kB, bo, U, y, B, bu, aFQ, iJ, av, YV, alf, YS, bt, VP, Fr, OG, b, jq, cK, cek, Ne, d, SI, jd, q, apB, cel, aJN, ar, u, da, fs, bhE, et, WZ, rQ, iR, A, k, fr, bPi, pD, zK, jx, RX, QV, aX, LI, h, cen, cU, oJ, cB, apb, fM, Lg, Fs, W, T, Lj, nP, ft, bjs, Oi, rh); #c1(MIB2) c2(XP_011539035) c3(6805) c4(32919, 45976, 59033, 19862, 72090) c5(W, hV, aX, Iv, fO); #c1(MICA) c2(NP_000238) c3(6806) c4(32920, 45977, 59034, 19863, 72091) c5(B, aw, ox, gG, dB, Ty, w, bf, e, O, gC, fH, Zv, aC, ol, gY, dH, jE, aHc, Qk, ag, bq, asL, ig, ix, U, avy, y, co, pp, f, akf, bu, av, fy, bm, iT, QD, V, nl, aR, xe, anf, iz, iV, a YE, fG, tl, iu, hV, b, wn, au, d, aem, re, gz, q, fJ, acO, ar, yW, u, aE, da, PJ, I, im, LR, by, bIF, et, JH, jH, nV, mA, bxG, Bm, yA, bsk, A, fr, C, iL, gE, bul, m, abe, F, Jk, bFX, aV, jZ, cV, J, P, T, II, aX, ft, aM, nk, fP, IN); #c1(MICAL2) c2(NP_001269592) c3(6807) c4(32921, 45978, 59035, 19864, 72092) c5(A, cy, b, B, bq, bb); #c1(MICALCL) c2(NP_116256) c3(6808) c4(32922, 45979, 59036, 19865, 72093) c5(Fg); #c1(MICB) c2(NP_001276090) c3(6809) c4(32923, 45980, 59037, 19866, 72094) c5(aDx, b, fr, ig, ix, gE, U, bul, jD, y, m, cy, AX, f, q, iT, acO, aE, atT, aV, u, gl, o, da, V, ae, aC, ht, gL, ft, fO, gC, hR, jH, jM, xe, fG, Bm, cK, re); #c1(MICU1) c2(NP_001182447) c3(6810) c4(32924, 45981, 59038, 19867, 72095) c5(bhy, b, xM, xJ, bcK, cen, oD, nP, xl); #c1(MICU3) c2(NP_859074) c3(6811) c4(32925, 45982, 59039, 19868, 72096) c5(td, cV); #c1(MID1) c2(NP_001180206) c3(6812) c4(32926, 45983, 59040, 19869, 72097) c5(A, or, b, fr, f, Nq, ft, Ns, amu, T, B, PH, aRr, cep); #c1(MID2) c2(NP_036348) c3(6813) c4(32927, 45984, 59041, 19870, 72098) c5(amu, av, aRr); #c1 (MIEN1) c2(NP_115715) c3(6814) c4(32928, 45985, 59042, 19871, 72099) c5(A, b, Be, B, bu, u, y, jh); #c1 (MIER2) c2(NP_060020) c3(6815) c4(32929, 45986, 59043, 19872, 72100) c5(rb); #c1(MIER3) c2(NP_001284528) c3(6816) c4(32930, 45987, 59044, 19873, 72101) c5(u, y, b); #c1(MIF) c2(NP_002406) c3(6817) c4(32931, 45988, 59045, 19874, 72102) c5(dx, gK, by, en, JH, Fk, bx, dD, aiW, iU, sJ, w, bf, yi, eD, O, dv, cy, kB, t, AX, Li, pq, gl, oN, g, UQ, aC, sH, du, QC, gY, fx, jT, av, dH, fy, gs, akn, sS, fc, fN, bPO, bY, tO, yE, cT, pW, i, dc, bq, aA, bT, sa, id, kN, X, ig, aFm, y, f, apy, bu, B, cs, bv, UM, mT, brt, uO, bk, QD, SV, ae, eE, v, cd, Io, bt, cK, qH, iV, aZM, mS, ji, iu, ap, bn, b, aF, fl, EG, eV, HQ, Ag, bb, bsa, jd, g, vu, ar, pY, dh, ri, da, P J, kF, I, kt, UG, gL, ad, Fo, mW, aZ, et, jU, JH, ao, hU, mk, fD, u, aE, ih, gd, ix, I, bp, A, Ik, gN, di, xa, iL, Pl, m, aX, wG, aEz, F, UN, bAC, hS, fP, aV, jZ, Yb, aAq, ax, cV, be, bd, W, T, II, cz, aM, at, agl, MU, Jh, j, Af, fq, bRG, aG, eG, gf, rb, gl); #c1(MILR1) c2(XP_011522929) c3(6818) c4(32932, 45989, 59046, 19875, 72103) c5(Vy); #c1(MINA) c2(NP_116167) c3(6819) c4(32933, 45990, 59047, 19876, 72104) c5(d, jT, co, b, dB, QJ, bp, ad, W, T, jR, cs, x, ar, by, u, e, y); #c1(MINK1) c2(NP_001020108) c3(6820) c4(32934, 45991, 59048, 19877, 72105) c5(acE, aX, b, sX, f, MS, P, mL, fl, fs, hR, alQ, mO); #c1(MINPP1) c2(NP_001171588) c3(6821) c4(32935, 45992, 59049, 19878, 72106) c5(nV, Pz, ra, fO, aMP, mk, fl, T); #c1(MIOX) c2(NP_060054) c3(6822) c4(32936, 45993, 59050, 19879, 72107) c5(bf, aE); #c1(MIPEP) c2(NP_005923) c3(6823) c4(32937, 45994, 59051, 19880, 72108) c5(aXG, bL, aDH, bW, b, bx, jz, eu, D, Iv, pu, cO, bf, U, ceq, aO, jQ, co, cy, aoR, h, q, VI, dQ, y, cs, gg, aM, u, jH, LR, V, ae, bwk, aC, aWj, sB, J, j, dB, nd, P, fl, T, fO, jT, aXp, DM, hU, caN, pS, bm, mb, Bu, xU, zM, gd, xP, fP, aBz, bLV, QP, at, BK); #c1(MIP) c2(NP_036196) c3(6824) c4(32938, 45995, 59052, 19881, 72109) c5(aXG, bL, bW, b, bx, aXp, eu, D, Iv, pu, cO, bf, U, ceq, aO, jQ, cy, aoR, oj, h, q, VI, dQ, y, cs, gg, aM, u, jH, LR, V, ae, bwk, aC, jz, aru, sB, J, j, dB, nd, P, fl, T, fO, Zt, jT, cer, DM, hU, caN, pS, bm, mb, aDH, xU, zM, gd, xP, fP, aBz, bLV, QP, aWj, at, BK); #c1(MIPOL1) c2(NP_620059) c3(6825) c4(32939, 45996, 59053, 19882, 72110) c5(bGB, zW); #c1(MIR1-1HG) c2(NP_848558) c3(6826) c4(32940, 45997, 59054, 19883, 72111) c5(di); #c1(MIS188P1) c2(XP_005267890) c3(6827) c4(32941, 45998, 59055, 19884, 72112) c5(bf, at, Em); #c1(MITF) c2(NP_000239) c3(6828) c4(32942, 45999, 59056, 19885, 72113) c5(cev, pV, aJm, cY, zh, ahS, dB, ic, jC, aTh, O, ces, aX, b, pp, ag, ml, f, ceu, ff, qB, Tr, cet, aC, bK, Xu, bjS, dt, jo, ahO, T, Tp, S, cew, arD, aJI, DO, adu, na, aJV, jl, kD); #c1(MIXL1) c2(NP_001269331) c3(6829) c4(32943, 46000, 59057, 19886, 72114) c5(jl, hX, p, pD, vu, fq, fH, jT, fJ); #c1 (MKI67) c2(NP_001139438) c3(6830) c4(32944, 46001, 59058, 19887, 72115) c5(YZ, ml, aw, EM, dB, HG, qP, hC, rc, e, O, avu, cl, jq, acy, g, aHN, aC, Dt, gm, bp, gY, nV, aiL, Jj, x, fx, jT, fp, wh, DO, yE, cT, w, bkQ, i, bq, Dr, fl, apF, X, iP, kB, bo, aJN, U, Oh, y, ip, f, bu, aFQ, B, iJ, av, fy, YV, Bs, bkl, alf, YS, bt, VP, Fr, aJX, iY, ap, apH, OG, An, b, QB, Ne, d, bb, SI, jd, q, apB, cel, ac, ar, u, fh, da, aGu, fs, I, qL, bhE, et, et, yG, rQ, iR, Mp, A, k, fr, bPi, pD, gE, zK, jx, RX, QV, aX, LI, h, cen, cU, ik, oJ, cB, apb, fM, Lg, fU, Fs, W, T, ff, Lj, ft, bjs, Oi, at, rb); #c1(MKKS) c2(NP_061336) c3(6831) c4(32945, 46002, 59059, 19888, 72116) c5(r, rd, di, cey, bf, cr, pp, anR, rh, ml, eX, q, Jf, cs, cex, fO, Nz, aM, vU, TD, bUk, nU, aA); #c1(MKL1) c2(NP_001269589) c3(6832) c4(32946, 46003, 59060, 19889, 72117) c5(bL, jK, b, X, hP, y, il, h, F, q, bu, ik, cB, iv, fH, gg, u, iT, ale, bm, ae, LR, J, by, P, T, Jp, av, ale, aq, fJ, aA, at); #c1(MKL2) c2(NP_054767) c3(6833) c4(32947, 46004, 59061, 19890, 72118) c5(bL, awW, Wk, cz, QZ, aA, ib); #c1(MKLN1) c2(NP_037387) c3(6834) c4(32948, 46005, 59062, 19891, 72119) c5(Eo); #c1(MKNK1) c2(XP_011540651) c3(6835) c4(32949, 46006, 59063, 19892, 72120) c5(b, fd, aC, fO, IY, w, O, fl, IV, u, y, Jd); #c1(MKNK2) c2(NP_060042) c3(6836) c4(32950, 46007, 59064, 19893, 72121) c5(kJ); #c1(MKRN1) c2(NP_001138597) c3(6837) c4(32951, 46008, 59065, 19894, 72122) c5(by, bu); #c1(MKRN3) c2(NP_005655) c3(6838) c4(32952, 46009, 59066, 19895, 72123) c5(ceA, agw, cez, rv, sb); #c1(MKS1) c2(NP_001159399) c3(6839) c4(32953, 46010, 59067, 19896, 72124) c5(d, r, or, aiV, aua, jl, QJ, vU, Nz, w, co, O, fy, e, ceB, TD, u, zW, y, XE); #c1(MLANA) c2(NP_005502) c3(6840) c4(32954, 46011, 59068, 19897, 72125) c5(en, pV, kE, b, cY, eu, ck, ic, bOa, HQ, aX, re, qB, aV, fs, cV, ER, Xu, dB, T, II, jC, asn, kM, SJ, aFX, kD); #c1(MLC1) c2(NP_631941) c3(6841) c4(32955, 46012, 59069, 19898, 72126) c5(ak, rb, sO, cJ, h, ble, N, q, mE, dt, aPu, iv, hb, aNU, T, di, k, u, dh, y); #c1(MLEC) c2(NP_055545) c3(6842) c4(32956, 46013, 59070, 19899, 72127) c5(c0); #c1(MLF1) c2(NP_001123629) c3(6843) c4(32957, 46014, 59071, 19900, 72128) c5(cj, fh, by, bb, b, h, f, J, jV, bu, M, n, bq, at, ci, ap); #c1(MLF2) c2(NP_005430) c3(6844) c4(32958, 46015, 59072, 19901, 72129) c5(A, u, y, iv); #c1(MLH1) c2(NP_000240) c3(6845) c4(32959, 46016, 59073, 19902, 72130) c5(fA, by, B, aw, mi, bx, EM, dB, w, PM, KK, adr, e, Up, DE, kJ, yh, dl, ji, jU, fH, Zv, R, g, fe, anb, gm, bp, gY, Ce, x, fx, jT, kN, aDJ, jE, BX, Yw, aDH, ie, os, ag, cT, aJM, i, pt, YB, Dr, GD, QF, cY, DO, jz, wy, mk, bo, bw, U, Oh, y, tp, co, px, ip, rr, f, LI, agm, bu, O, cs, av, fy, bm, iT, is, fi, aEd, V, ny, Qt, iA, fJ, aEr, dt, aen, af, P, in, Le, tl, oM, An, b, ceC, wn, ceD, ic, Og, jy, bah, Mr, d, jh, re, hV, q, es, X, ar, ff, fE, jG, u, NT, il, qL, el, avo, gL, ad, G, Ca, Vw, et, jf, Lt, jH, wV, nV, ig, iR, jc, Bg, zZ, wP, agf, fl, I, Mp, fj, Iv, A, IO, k, gw, gN, BY, og, C, hP, jx, aX, h, anM, F, jQ, cU, ik, rR, cB, apb, QJ, fU, gO, mD, J, W, jo, T, fO, Ez, Zd, Pk, fM, ava, ck, bV, adu, fP, avx, Oi, eG, iE); #c1(MLH3) c2(NP_055196) c3(6846) c4(32960, 46017, 59074, 19903, 72131) c5(NT, am, b, u, X, ceE, ad, cU, wn, Ce, ik, i, cs, iA, U, hP, av, y, V); #c1(MLKL) c2(NP_001135969) c3(6847) c4(32961, 46018, 59075, 19904, 72132) c5(ceF, fP); #c1(MLLT10) c2(NP_001182555) c3(6848) c4(32962, 46019, 59076, 19905, 72133) c5(FK, jK, aX, V, b, hX, t, h, N, J, fO, jd, M, ajK, G, jL, iv, U, jx, dB); #c1(MLLT1) c2(NP_005925) c3(6849) c4(32963, 46020, 59077, 19906, 72134) c5(fs, lb, t, h, abs, J, jV, M, G, iv, Bz); #c1(MLLT3) c2(NP_001273620) c3(6850) c4(32964, 46021, 59078, 19907, 72135) c5(ceG, b, t, h, ak, jL, J, hS, G, o); #c1 (MLLT4) c2(NP_001035089) c3(6851) c4(32965, 46022, 59079, 19908, 72136) c5(b, h, fl, av, u, y); #c1(MLLT6) c2(NP_005928) c3(6852) c4(32966, 46023, 59080, 19909, 72137) c5(oH, t, h, J, iv); #c1(MLN) c2(NP_001035198) c3(6853) c4(32967, 46024, 59081, 19910, 72138) c5(gM, jH, Pu, abe, fO, m, iu, f, afZ, Jq, MW, ig, o, aZS, aA, yi, u, y); #c1(MLNR) c2(NP_001498) c3(6854) c4(32968, 46025, 59082, 19911, 72139) c5(QZ, FU); #c1(MLPH) C2(NP_001035932) c3(6855) c4(32969, 46026, 59083, 19912, 72140) c5(jd, ceH, A, cz); #c1(MLST8) c2(NP_001186102) c3(6856) c4(32970, 46027, 59084, 19913, 72141) c5(jh, by, adK, b, bu); #c1(MLX) c2(NP_733752) c3(6857) c4(32971, 46028, 59085, 19914, 72142) c5(aA, o); #c1(MLXIP) c2(NP_055753) c3(6858) c4(32972, 46029, 59086, 19915, 72143) c5(aX, I, b, t, F, dB, q, ad, ag, cT, cs, G); #c1(MLXIPL) c2(NP_116569) c3(6859) c4(32973, 46030, 59087, 19916, 72144) c5(eX, b, k, bf, U, ey, y, BM, bb, B, q, u, o, fh, mz, V, I, qL, dK, alM, dL, aM, fN, MP, fD, aA, at, ap); #c1(MLYCD) c2(NP_036345) c3(6860) c4(32974, 46031, 59088, 19917, 72145) c5(Ad, Ae, pp, ni, vG, vU, bKz, hS, wt, IW, vw, cK, aeu, et, o); #c1(MMAA) c2(NP_758454) c3(6861) c4(32975, 46032, 59089, 19918, 72146) c5(cel, ceJ, ceL, bk, ceK); #c1(MMAB) c2(NP_443077) c3(6862) c4(32976, 46033, 59090, 19919, 72147) c5(dx, KG, f, b, WT, fj, eH, sJ, w, bf, Fh, nU, e, y, d, dv, aX, iR, t, aHw, bu, WW, ss, bw, av, aV, u, aE, ceJ, gw, I, cV, WQ, nz, du, dK, by, dt, P, X, pt, cq, jT, bq, aM, WZ, kJ, fc, WV, hT, G, cT, fl, wU, dc, oM, WS, at, kD); #c1(MMADHC) c2(NP_056517) c3(6863) c4(32977, 46034, 59091, 19920, 72148) c5(ceM, A, ceO, ceN, ho, Nn); #c1(MMD2) c2(NP_001094070) c3(6864) c4(32978, 46035, 59092, 19921, 72149) c5(ceP); #c1 (MMD) c2(NP_036461) c3(6865) c4(32979, 46036, 59093, 19922, 72150) c5(bL, bC, bU, fl, bb, b, dA, QJ, Eo, di, Fg, fy, at, iR, xl); #c1(MME) c2(XP_011511160) c3(6866) c4(32980, 46037, 59094, 19923, 72151) c5(dx, gK, aoV, B, aw, gG, dB, aN, cO, aK, O, jT, tX, LN, kJ, t, gB, mR, n, du, gJ, gm, fO, Tw, su, aL, wh, BX, ie, ag, cT, bk, i, aA, jl, ceR, EO, X, vD, eu, bw, U, xw, y, co, f, cs, ky, iv, fy, dX, aEt, eX, iA, aEr, P, gR, kD, ap, afE, b, QB, ceQ, bXG, oR, jy, jh, Q, ar, ff, hb, oO, jG, u, aE, o, I, ad, as, G, Ny, pa, ih, CL, Au, A, sO, pD, di, acH, wf, ajT, Bz, RX, bXN, h, F, cU, oJ, gO, cV, an, J, W, jo, T, II, aX, alt, aT, at); #c1(MMEL1) c2(XP_011540425) c3(6867) c4(32981, 46038, 59095, 19924, 72152) c5(A, b, ee, ig, B, eB, ahd, tF, aC, bf, dH, aV, bT, o, aM); #c1(MMP10) c2(NP_002416) c3(6868) c4(32982, 46039, 59096, 19925, 72153) c5(pm, id, aw, bW, b, X, ic, z, wf, uy, al, e, xl, d, co, bb, kJ, kS, ml, bu, ji, aO, av, fy, aE, rN, aC, sH, be, bp, by, T, cd, Ez, cy, jT, et, jU, jH, aaa, aen, kM, tO, i, bq, bh, yA, at); #c1(MMP11) c2(NP_005931) c3(6869) c4(32983, 46040, 59097, 19926, 72154) c5(dx, GD, aw, Io, b, aGv, i, mW, BY, ic, U, apt, afs, al, y, jb, d, cU, dv, kJ, jd, Bi, DP, e, q, jG, es, aoY, qL, pC, rR, cB, PH, fy, u, gl, R, aal, Bd, aYA, V, im, Be, sH, du, by, m, YS, T, aav, aZ, Oi, fx, bu, JY, aJX, nV, hU, Bu, jh, tO, yy, ag, tl, bh); #c1(MMP12) c2(NP_002417) c3(6870) c4(32984, 46041, 59098, 19927, 72155) c5(dx, aw, iD, Zy, awh, iU, sJ, w, cO, bW, e, O, dv, cy, gB, aC, sH, du, bp, x, fx, nG, sN, ag, i, bq, EO, fl, X, Dy, mk, bli, vl, tO, y, co, bi, ml, eX, bu, bxF, gg, fy, bm, V, cd, dy, py, nJ, gO, ap, aMu, b, Jg, fD, d, bb, aiT, q, QE, ar, Um, u, dr, ahF, qC, j, by, Io, apm, Jl, ao, kB, aE, ih, I, vZ, yA, bL, A, TQ, fr, di, iL, al, U, oy, ox, yw, ik, Jf, aV, ez, be, T, aBW, MU, ajv, fP, bh, at, eG); #c1(MMP13) c2(NP_002418) c3(6871) c4(32985, 46042, 59099, 19928, 72156) c5(dx, gK, ml, aw, Io, dB, cO, bW, pz, e, O, cp, dv, Pv, aC, sH, du, fO, ft, x, fx, gg, tO, i, bq, bT, cY, afY, eu, kB, iG, U, y, V, co, px, pp, f, bu, B, JX, cs, av, bm, rN, cd, aGU, rV, iA, aen, tl, aFI, b, zH, aF, ceS, z, aTF, d, jh, zJ, bX, q, zx, X, ar, u, fh, bU, fs, ahF, il, LR, ad, iD, ceT, jU, DP, nV, iR, agb, Ns, aFi, I, rC, bL, A, qd, fr, iL, al, aW, aX, ceU, ox, be, T, by, AP, at, Nq, amS, fP, rL, E, bh, bPA, eG, gl); #c1(MMP14) c2(NP_004986) c3(6872) c4(32986, 46043, 59100, 19929, 72157) c5(dx, B, aw, ceV, dB, aN, eH, W, ku, cO, bf, aK, e, O, BO, dv, kJ, et, mR, ik, R, g, bJ, aC, yL, du, bp, ft, od, cV, x, fx, Bi, tO, we, ag, cT, i, bq, aA, fl, ceW, X, iP, eu, kB, Bd, iG, bW, bw, U, y, V, tp, co, btS, pz, f, bu, k, cs, av, fy, iT, be, rN, yg, v, cd, gv, VP, cK, iA, uJ, nJ, Le, ji, b, jL, oi, ic, ceX, aTF, fD, d, jh, bb, sO, re, hV, g, ar, n, jG, u, dh, fh, fs, il, j, ad, vw, wd, yG, ao, nV, iR, eQ, py, aE, kC, aaM, I, yA, bL, A, qd, fr, adW, pR, C, iL, gE, al, xe, Xv, aW, aX, I, h, F, Gs, rR, Jf, aV, sH, te, Eg, me, bSD, uF, T, by, aM, MU, mb, hl, bh, at, eG, ja); #c1(MMP15) c2(NP_002419) c3(6873) c4(32987, 46044, 59101, 19930, 72158) c5(b, k, w, cO, al, Le, U, O, btS, re, f, q, fy, iT, ma, V, aC, sH, xe, T, ji, hq, jR, tO, ag, bh, aA, h, rb); #c1(MMP16) c2(NP_005932) c3(6874) c4(32988, 46045, 59102, 19931, 72159) c5(A, IO, k, aF, dB, w, al, O, re, B, q, bu, vu, Qf, o, dA, aC, sH, by, wq, T, YA, tA, tO, aXS, bh); #c1(MMP17) c2(NP_057239) c3(6875) c4(32989, 46046, 59103, 19932, 72160) c5(b, aC, sH, be, tO, T, ar, bh, al, u, ja, y); #c1(MMP19) c2(NP_001259030) c3(6876) c4(32990, 46047, 59104, 19933, 72161) c5(d, da, f, cy, aen, b, aC, sH, LR, e, bte, tO, T, ic, ar, gg, yA, o); #c1(MMP1) c2(NP_002412) c3(6877) c4(32991, 46048, 59105, 19934, 72162) c5(dx, gK, by, B, aw, Io, ig, wN, bao, DT, Ip, eW, w, lu, cO, bf, ra, xl, cp, cU, bQ, cy, Vx, XZ, iR, GW, e, fP, FN, asA, mR, Pv, anL, TP, g, gG, Jf, kM, jH, aC, nl, sH, du, fO, bp, iU, vc, Ce, Gl, fx, jT, akk, wh, aEs, bhN, DO, bY, tO, ag, pH, bk, i, ch, bq, aA, jl, sW, PM, yJ, id, bi, cY, TJ, xg, eu, py, kB, NH, IW, U, y, jb, tp, co, BL, pp, yE, cK, f, vQ, bu, tv, k, O, cs, av, fy, bm, iT, bNa, fi, Bd, V, dA, Bs, cd, gv, bcL, zJ, dv, Jc, eX, bt, VP, gC, JY, qW, dO, iY, vZ, er, P, nJ, xe, vH, kJ, TQ, ji, cfa, fD, fW, ap, aFI, wj, bW, ceY, b, aNq, aF, eR, vY, fl, tG, z, aTF, re, LP, d, jh, aem, bb, eA, vC, bX, hV, PA, q, es, X, ar, uz, fv, u, o, ff, ceZ, tw, kF, I, LR, gL, ad, pQ, aZ, aYw, aTx, kS, Jl, bzv, ao, jM, mk, aRt, eQ, Bu, Dj, cC, gd, aFi, dn, I, di, yA, Xm, aGU, bL, A, iL, qd, fr, pR, gE, asE, bgW, bpE, dY, vg, eO, fs, al, hP, vl, aW, oy, RX, gg, aX, il, bj, Bi, ox, aBd, ny, pC, ik, oJ, Hx, afp, Jk, Jh, aV, HI, ez, F, be, dB, bd, W, bR, jo, T, bkj, Ez, asX, bgw, ft, gN, di, al, sx, aW, aX, I, hP, Bi, ox, aBd, cU, bh, at, eG, gl); #c1(MMP20) c2(NP_004762) c3(6878)

c4(32992, 46049, 59106, 19935, 72163) c5(aC, kC, T, ku, Ur, cfc, bWM); #c1(MMP21) c2(XP_011537559) c3(6879) c4(32993, 46050, 59107, 19936, 72164) c5(b, aGv, aGu, q, ad, mk, T); #c1(MMP24) c2(NP_006681) c3(6880) c4(32994, 46051, 59108, 19937, 72165) c5(bP, fc, w, T, fD, bh, bf, al, aV, aM); #c1(MMP25) c2(NP_071913) c3(6881) c4(32995, 46052, 59109, 19938, 72166) c5(b, qP, ku, al, y, jd, kC, cs, aV, u, g, fs, aC, ad, T, x, Ur, fc, Nq, Ns, w, bh); #c1(MMP26) c2(NP_068573) c3(6882) c4(32996, 46053, 59110, 19939, 72167) c5(A, aw, b, X, mk, bw, e, y, d, jh, co, B, cU, aEs, kF, I, bQ, T, Io, iA, u, zX, at); #c1(MMP28) c2(NP_001027449) c3(6883) c4(32997, 46054, 59111, 19940, 72168) c5(by, fc, ad, T, cs, fP, aV, bu); #c1(MMP2) c2(NP_001121363) c3(6884) c4(32998, 46055, 59112, 19941, 72169) c5(aHH, ceV, dB, e, cp, LL, kJ, dl, cl, TP, aC, ft, hU, jE, tO, ag, bk, fD, aUt, bq, aA, ku, X, vD, sF, iG, bo, bw, vl, eK, eX, kC, bIQ, vE, av, fy, is, NW, cfj, cd, fJ, xd, dy, aYM, rK, xe, qd, ji, wl, bwi, ap, vY, ceX, ha, jh, aos, ov, wY, da, fs, il, sX, gL, ad, aYw, iw, nV, Ns, xf, uE, aES, bOm, fr, pR, gN, xh, jc, vZ, C, iL, zK, cfh, oJ, Jk, kd, YR, be, J, bR, jo, My, cfg, fP, Af, E, rb, dx, sA, qP, PM, bf, aK, xl, AX, gB, yh, jM, og, wo, yO, gm, bp, Gl, x, amq, wh, gs, sS, mx, dh, bT, bP, iP, mk, kY, U, co, BL, f, aDD, bu, ky, aee, Bs, gt, QG, z, d, bb, eA, jd, Qu, PA, q, zx, ra, zm, mL, ff, iR, o, fh, tw, kF, VD, qL, LR, bLu, Fk, wd, jH, Eu, cff, ch, kM, aad, Xm, sO, eO, al, aW, hN, ez, nQ, dt, T, nk, hq, acg, bgl, aw, iD, lu, BO, iy, Vx, eE, fH, g, Xc, Dt, fO, vc, fx, EG, xb, cY, kB, bW, V, pp, ml, B, O, JX, Us, oD, gg, iT, yJ, apN, rN, aGU, wA, cy, iA, JY, vH, bH, b, aF, jL, cfe, AA, au, tG, re, k, ajJ, sz, KL, cfd, et, Lt, bMt, DR, agf, WP, rC, ds, vg, wf, jx, Bi, cU, ik, iK, afp, aFN, du, Be, W, aX, AP, iv, fM, aM, avq, Y, Rd, ajv, zM, Ez, at, eG, adl, aAv, gK, bsd, gG, aN, w, bV, cO, yi, dv, gC, t, Hs, sH, gJ, od, jT, we, yE, i, id, Kc, IW, y, jb, ed, azn, vQ, cs, mm, bm, iF, ok, cK, dP, py, jR, gA, hV, ia, vh, Mz, eR, ic, xg, jD, cfi, Iz, bX, ar, jG, u, PJ, bU, aDu, I, im, by, Io, yG, Bu, Du, dr, I, bL, A, BY, di, hP, yw, c, jl, ty, h, F, aBd, qr, az, Dd, Jf, aV, jZ, HI, fU, si, cV, P, IC, j, bh, bsc, sK, QN, Nq, XH, Oi, cfk, iE); #c1(MMP3) c2(NP_002413) c3(6885) c4(32999, 46056, 59113, 19942, 72170) c5(tM, gK, ak, aw, bx, ig, cfl, gG, dB, eH, w, bV, dx, cO, vp, eP, rF, ra, O, vA, gC, Vx, kB, e, dl, aHH, jm, mR, cq, TP, g, Jf, aeM, rV, aC, bRS, sH, du, yO, wh, bp, m, vc, bLi, x, FW, fx, hR, hj, dH, rR, aDb, gs, rE, dS, F, jh, tO, ag, xb, vK, i, cB, bq, aA, bT, GO, hT, fO, cY, mk, ob, bf, Iw, U, y, tp, co, bi, ip, Mw, DM, f, vQ, bu, k, cfo, JX, cfn, av, fy, bm, iT, yJ, wK, be, V, aNt, bj, Bu, cd, gv, dv, eX, VP, Fr, iA, qH, pi, YU, xd, dO, Xm, rK, py, er, nJ, B, vH, TQ, tl, Iz, fD, bX, ap, aFI, bW, ceY, b, eR, wA, vY, id, ic, tG, z, aTF, pl, aO, d, eE, bb, eA, vC, vj, sO, q, zx, X, zm, ar, uz, aRv, HL, u, aE, o, ff, bU, tw, fs, I, LR, fz, gL, by, IG, Io, cfp, kS, Jl, jH, ao, hU, anG, LO, sW, Bt, cC, Ns, aFi, aqq, I, uE, hd, rC, kM, bL, A, iL, qd, xa, gE, nl, gN, cfm, di, fw, vg, eO, wf, al, xe, hP, vl, aW, oy, RX, gg, aX, or, sG, rG, ox, aBd, Aq, cU, ik, oJ, fh, afp, Jk, fP, aV, jZ, Af, Hl, ma, hW, bC, sj, me, bQV, W, bR, IC, T, aBW, dn, jl, mQ, ac, aM, jT, bnn, LQ, Jh, Ic, N7, zM, amS, j, pZ, cfh, gj, bh, aT, at, eG, gl); #c1(MMP7) C2(NP_002414) c3(6886) c4(33000, 46057, 59114, 19943, 72171) c5(dx, B, aw, alz, bx, gG, dB, baB, adr, ra, xl, dv, cy, b, kJ, akv, Si, e, iT, jm, ji, Hs, g, aC, sH, du, bp, ft, x, fx, jT, FG, apc, Ox, tO, ag, Lo, bk, i, pt, cY, oa, eu, Ni, kY, bw, U, Oh, y, tp, co, BL, pp, f, bu, O, cs, bv, av, fy, bm, fY, fi, V, gv, Ih, bt, Qt, Fr, iA, qH, JY, dO, py, oM, aG, bn, am, vh, oi, cfo, d, jh, eA, re, q, X, zm, ar, fv, u, il, LR, ad, BZ, sf, cfq, Io, ct, et, jU, jH, wV, iR, eQ, wP, aZ, af, Xm, A, k, fr, gN, di, al, sx, aW, aX, I, hP, Bi, ox, aBd, cU, ik, gg, aV, HI, wF, W, T, fO, Oi, by, QN, mb, hq, fP, bh, at, eG, rb); #c1(MMP8) c2(NP_002415) c3(6887) c4(33001, 46058, 59115, 19944, 72172) c5(dx, bL, eX, vp, vg, b, gK, aF, aFy, O, mk, ic, tG, cO, cA, nT, al, pz, vl, y, at, d, co, aX, aeM, bX, qd, e, q, aG, cd, eN, ar, uz, Jk, bf, jG, aV, u, oJ, aem, wF, ap, aC, sH, du, fO, gL, gv, bR, vc, dv, bp, aZ, aZE, cy, vA, aM, wh, dO, dS, TP, Bu, aoN, tO, gd, cT, i, bh, yA, bPA, bW, rC); #c1(MMP9) c2(NP_004985) c3(6888) c4(33002, 46059, 59116, 19945, 72173) c5(ml, dB, en, ajf, ra, LL, kJ, Pn, dl, mR, cl, TP, aNq, aC, jD, ft, jE, DO, tO, ag, axC, bk, fD, aUt, acM, bq, aA, GD, X, vD, eu, aCB, sF, iG, ajw, bw, vl, sr, yX, Dq, eX, e, vE, akk, fy, is, aBv, NW, cfj, cd, IR, fJ, xd, dy, uJ, yM, ji, wl, ap, dk, vY, jh, EA, Gj, aos, dh, wY, da, fs, sX, gL, ad, bkX, aeC, ceT, aen, ao, nV, py, Ns, vZ, yA, uE, bOm, fr, pR, gn, gN, jc, Ja, C, iL, gE, zK, cfh, m, ox, oJ, Jk, jQ, kd, wF, cfs, be, J, My, Ao, mb, Ic, fP, Af, E, rb, gl, tM, sd, ud, iU, qP, bf, aK, xl, rh, yh, jM, rR, cfu, og, aeM, nl, du, gm, bp, Gl, x, su, amq, wh, dS, fc, mE, bT, bP, fl, iP, mk, ix, kY, U, arW, co, BL, f, md, bu, tv, aee, gv, qH, nb, gt, Oa, tl, cfa, Qu, wT, vq, Pv, oi, z, d, biX, bb, eA, jd, vj, PA, q, zx, bWQ, zm, mL, sR, ff, hb, ar, aM, iR, amO, fh, tw, kF, qL, LR, aZ, ct, wd, jU, jH, cff, ch, aCp, bkF, El, gd, o, OI, fl, Xm, MZ, qd, Ik, asE, qX, eO, al, aW, Hx, ez, aMK, bQV, Po, bEC, T, II, agn, DG, hq, acg, gj, bPA, DM, dx, pm, ak, aw, dN, aiu, lu, BO, Vx, Bl, aZB, eE, aD, fH, g, gG, fO, vc, fx, hR, av, rS, cT, xb, aZD, nX, Bt, cY, jz, Id, kB, bW, uH, V, tp, RD, aof, ml, B, Ll, gX, k, O, JX, Us, oD, gg, iT, yJ, rN, qq, afn, aR, bt, wA, cy, iA, JY, dO, fw, vH, bH, dr, b, aF, cfe, AA, au, tG, Fr, aiR, aem, re, hV, DC, OC, aFr, ajJ, Zz, avo, IX, Mw, et, Ha, cW, hU, IS, zO, rC, cfm, xf, Iv, vg, wf, DK, eb, jx, cfv, qs, hP, Bi, Aq, cU, iZ, ik, aE, afp, aFN, Yb, wo, W, aBW, jl, cft, Y, ajv, zM, pZ, Ez, at, eG, ja, gK, Ig, bx, aiW, aN, eG, w, bV, cO, yi, wk, gO, dv, gC, t, sO, tE, ajz, R, cB, sH, zU, od, jT, mO, cq, alb, Ox, TJ, yE, vK, i, id, aFy, ma, IW, y, jb, vQ, cs, IL, mm, bm, cj, iF, ok, ajl, pi, qW, aaa, dU, jR, TQ, ci, vh, Mz, eR, ic, xg, ey, bFU, eV, aO, zJ, vu, dQ, qe, VM, jG, u, PJ, bU, aDu, I, im, by, Io, Nh, VH, KK, cfr, eQ, Bu, rq, Sk, I, bL, A, BY, di, sx, yw, c, aX, sS, ty, h, F, aBd, az, n, Jf, aV, jZ, HI, fU, si, cV, P, IC, j, bh, ac, Nq, gf, rL, cfb, Oi, aT, iE); #c1(MMRN1) c2(NP_031377) c3(6889) c4(33003, 46060, 59117, 19946, 72174) c5(dx, bL, id, b, acE, xK, eO, wf, bf, bj, aO, dv, bb, ml, kX, hj, V, du, cfw, bpY, aM, jH, at, Ic, bq, eN); #c1(MMRN2) c2(NP_079032) c3(6890) c4(33004, 46061, 59118, 19947, 72175) c5(b); #c1(MMS19) c2(NP_001276332) c3(6891) c4(33005, 46062, 59119, 19948, 72176) c5(iw, fy, fr, ft, ag, ar, bw, av, aV); #c1 (MMS22L) c2(NP_940870) c3(6892) c4(33006, 46063, 59120, 19949, 72177) c5(f, b); #c1(MN1) c2(NP_002421) c3(6893) c4(33007, 46064, 59121, 19950, 72178) c5(hf, h, M, cfx, bpd, ac); #c1(MNAT1) c2(NP_001171434) c3(6894) c4(33008, 46065, 59122, 19951, 72179) c5(hT, b, Xd, fr, Pv, Xl, mW, sJ, iL, bf, xw, y, iy, m, co, aX, eZ, k, q, pB, aV, u, gl, o, g, ae, dA, bK, Xn, v, bp, ft, cV, bb, aM, Ic, aE, Bm, Xe); #c1(MNDA) c2(NP_002423) c3(6895) c4(33009, 46066, 59123, 19952, 72180) c5(dx, m, fl, Y, h, du, gm, cd, aE, cT, n, jT, ci); #c1(MNS1) c2(NP_060835) c3(6896) c4(33010, 46067, 59124, 19953, 72181) c5(oy); #c1(MNT) c2(NP_064706) c3(6897) c4(33011, 46068, 59125, 19954, 72182) c5(aX, b, AP, f, q, jR, Nq, bdZ, jM, u, y); #c1(MNX1) c2(NP_001158727) c3(6898) c4(33012, 46069, 59126, 19955, 72183) c5(agG, jK, bf, Bz, bxr, cfy, h, q, M, Gs, bYE, Cl, cfz, J, T, fH, fJ, aM, ao, aai, mB, mA, cT, mD, at); #c1(MOAP1) C2(NP_071434) c3(6899) c4(33013, 46070, 59127, 19956, 72184) c5(A, b, Bf, Xe, o, aM); #c1(MOB1A) c2(NP_060691) c3(6900) c4(33014, 46071, 59128, 19957, 72185) c5(co, V, b, bp, ad, aA, fy, U); #c1(MOB1B) c2(NP_775739) c3(6901) c4(33015, 46072, 59129, 19958, 72186) c5(b); #c1(MOB2) c2(NP_001165694) c3(6902) c4(33016, 46073, 59130, 19959, 72187) c5(jE, bm, q); #c1(MOB3B) c2(NP_079037) c3(6903) c4(33017, 46074, 59131, 19960, 72188) c5(aC, ao, b); #c1(MOB4) c2(NP_001094289) c3(6904) c4(33018, 46075, 59132, 19961, 72189) c5(co, V, b, bp, aA, fy); #c1(MOBP) c2(NP_001265251) c3(6905) c4(33019, 46076, 59133, 19962, 72190) c5(acE); #c1(MOCOS) c2(NP_060417) c3(6906) c4(33020, 46077, 59134, 19963, 72191) c5(by, nV, G, X, t, cK, cs, XA, gm, BK, P, aeC, y, z, fP, nP, bu, u, av, mO); #c1(MOCS1) c2(NP_001068566) c3(6907) c4(33021, 46078, 59135, 19964, 72192) c5(cfA); #c1(MOCS2) c2(NP_004522) c3(6908) c4(33022, 46079, 59136, 19965, 72193) c5(cfB, ji); #c1(MOGAT1) c2(NP_477513) c3(6909) c4(33023, 46080, 59137, 19966, 72194) c5(A, b, B, bf, aA, aV, aE, aM); #c1(MOGAT2) c2(NP_079374) c3(6910) c4(33024, 46081, 59138, 19967, 72195) c5(em, mz, fN, eq, aA, dL); #c1(MOGAT3) c2(NP_001274076) c3(6911) c4(33025, 46082, 59139, 19968, 72196) c5(bm, aA, u, y); #c1(MOG) c2(NP_001008229) c3(6912) c4(33026, 46083, 59140, 19969, 72197) c5(mZ, ach, ami, ix, iL, ajb, m, cfC, bJt, do, ky, qu, aV, aE, adV, aC, be, v, cz, akT, rV, fc, ex, oj, oT); #c1(MOGS) c2(NP_001139630) c3(6913) c4(33027, 46084, 59141, 19970, 72198) c5(KC, co, aai, ae, NG, cfD, t, h, sE, J, bEe, adu, G, NH, bk, cV, Xz, Cl, pz); #c1(MOK) c2(NP_055041) c3(6914) c4(33028, 46085, 59142, 19971, 72199) c5(dx, bL, A, td, b, ey, dB, aE, ck, di, sU, bW, wf, bf, vl, aK, LP, aO, gO, wZ, co, dN, ml, f, q, jG, bu, nM, jm, ar, y, fH, av, aV, u, dh, o, wR, da, si, I, B, aC, fJ, du, bp, cz, W, dv, fO, aZ, x, by, et, fp, aM, fy, dS, Ic, Le, vH, gd, Lo, fD, I, bq, aA, at, ap); #c1(MON1A) c2(NP_001135973) c3(6915) c4(33029, 46086, 59143, 19972, 72200) c5(aVh); #c1(MON1B) c2(NP_001273568) c3(6916) c4(33030, 46087, 59144, 19973, 72201) c5(bb, fl); #c1(MON2) c2(NP_001265398) c3(6917) c4(33031, 46088, 59145, 19974, 72202) c5(adK, aDD); #c1(MORC3) c2(NP_056173) c3(6918) c4(33032, 46089, 59146, 19975, 72203) c5(BL, cV); #c1(MORF4L1) c2(NP_001252534) c3(6919) c4(33033, 46090, 59147, 19976, 72204) c5(rb, f, u, y, b); #c1(MORN1) c2(NP_001287989) c3(6920) c4(33034, 46091, 59148, 19977, 72205) c5(kF); #c1 (MORN2) c2(NP_001138922) c3(6921) c4(33035, 46092, 59149, 19978, 72206) c5(ao); #c1(MORN5) c2(NP_940871) c3(6922) c4(33036, 46093, 59150, 19979, 72207) c5(Ns, Nq); #c1(MOS) c2(NP_005363) c3(6923) c4(33037, 46094, 59151, 19980, 72208) c5(auS, b, dB, z, re, aeC, nP, y, co, G, t, h, bu, M, n, iv, av, fy, u, cj, cV, jG, gm, by, jo, T, J, jT, fp, wV, nV, P, wP, ci); #c1(MOV10L1) c2(NP_001157576) c3(6924) c4(33038, 46095, 59152, 19981, 72209) c5(Kw); #c1(MPC1) c2(NP_001257808) c3(6925) c4(33039, 46096, 59153, 19982, 72210) c5(IV, cfE); #c1(MPC2) c2(NP_001137146) c3(6926) c4(33040, 46097, 59154, 19983, 72211) c5(di, cp); #c1(MPDU1) c2(NP_004861) c3(6927) c4(33041, 46098, 59155, 19984, 72212) c5(KC, fl, eq, i, I, Te, cfF); #c1(MPDZ) c2(NP_001248335) c3(6928) c4(33042, 46099, 59156, 19985, 72213) c5(HI, ml, cfG, aaB, cab, sD, Gn); #c1 (MPEG1) c2(NP_001034485) c3(6929) c4(33043, 46100, 59157, 19986, 72214) c5(aLt, em, bNm, gt, b, kJ, u, hT, F, LG, bu, w, atq, aaS, kA, sl, aX, by, pi, IU, o); #c1(MPG) c2(NP_001015052) c3(6930) c4(33044, 46101, 59158, 19987, 72215) c5(dx, fe, by, hV, b, X, Lv, KN, w, oR, bV, O, Fh, bW, U, aRr, A, e, y, cy, d, bi, co, aX, h, f, q, jG, bu, M, Kz, ji, B, cs, Tr, av, aV, u, ff, du, aP, V, aC, ZY, v, fO, J, W, jo, dv, T, pt, Tp, ad, PH, jH, jT, fy, ck, pP, bm, P, jR, ag, cT, amu, i, rw, oM, jC, eN, byB); #c1(MPHOSPH10) c2(NP_005782) c3(6931) c4(33045, 46102, 59159, 19988, 72216) c5(u, y); #c1(MPHOSPH6) c2(NP_005783) c3(6932) c4(33046, 46103, 59160, 19989, 72217) c5(Ge, b, dA, Gf, f, HN, cV, di, tl, bj, o); #c1(MPHOSPH8) c2(NP_059990) c3(6933) c4(33047, 46104, 59161, 19990, 72218) c5(T); #c1(MPHOSPH9) c2(NP_073619) c3(6934) c4(33048, 46105, 59162, 19991, 72219) c5(aV, cV); #c1 (MP1) c2(NP_001276084) c3(6935) c4(33049, 46106, 59163, 19992, 72220) c5(anO, KG, ajf, eq, I, X, brG, cf, eN, cfl, xX, z, acb, cfH, cfJ, ccP); #c1(MPLKIP) c2(NP_619646) c3(6936) c4(33050, 46107, 59164, 19993, 72221) c5(nB, nF, aBx, bnF); #c1(MP0) c2(NP_000241) c3(6937) c4(33051, 46108, 59165, 19994, 72222) c5(dx, by, en, aw, aZ, dN, bx, rR, Zy, jK, vB, aN, hC, cO, vp, bu, ps, nU, dv, cy, t, e, wv, aKt, ji, IV, gl, TP, g, fx, Oe, lb, du, yO, gm, bp, GK, vM, bJY, jT, vG, kN, azM, jE, gE, qt, ie, os, ag, cT, bk, i, jB, bq, aA, bP, GD, anY, Kt, fO, wK, yu, bmY, ma, bf, cA, bw, U, G, y, co, bi, pp, bOn, f, cs, aG, tv, B, iv, bv, av, fy, bm, d, SA, GS, V, FK, bag, v, gv, Jc, bt, BV, pi, W, pk, dO, in, vH, ej, fD, ci, ap, fn, bn, ny, b, cfK, aF, atU, eR, z, jy, re, aYA, yK, qH, bb, Iz, bX, q, jV, X, ar, n, oO, fv, jG, u, dh, o, aBh, PJ, aDu, I, qW, ir, anZ, aH, gL, ad, as, Fo, nk, rw, mW, rB, et, jU, jH, hU, ch, GM, gd, ix, Ol, I, yA, fh, bL, A, TQ, iC, gN, IE, di, fw, eO, al, sx, eb, m, jl, il, wG, h, im, M, aC, ik, oJ, qB, aV, fU, an, mc, J, GB, bR, do, T, II, Ou, aos, Pk, cfL, ip, QJ, fW, fP, pi, bh, at, eG, gl); #c1(MPP1) c2(NP_001159933) c3(6938) c4(33052, 46109, 59166, 19995, 72223) c5(ae, aC, h, P, bp, xU, sJ, aE, ar, zO, al, anf); #c1(MPP2) c2(NP_001265299) c3(6939) c4(33053, 46110, 59167, 19996, 72224) c5(lp, WO, u, ff, qO); #c1(MPP3) c2(NP_001923) c3(6940) c4(33054, 46111, 59168, 19997, 72225) c5(bK, nz, nU, cz, qP, w); #c1(MPP5) c2(NP_001243479) c3(6941) c4(33055, 46112, 59169, 19998, 72226) c5(alM, nQ); #c1(MPP7) c2(XP_005252425) c3(6942) c4(33056, 46113, 59170, 19999, 72227) c5(cy, dA, Fg, IV, o, ap); #c1(MPPE1) c2(NP_001229833) c3(6943) c4(33057, 46114, 59171, 20000, 72228) c5(vu, ak); #c1(MPPED2) c2(NP_001138871) c3(6944) c4(33058, 46115, 59172, 20001, 72229) c5(b, cV, kC, fP, fD, cO, bq, aqS); #c1 (MPR1P) c2(NP_055949) c3(6945) c4(33059, 46116, 59173, 20002, 72230) c5(dx, dv, nQ, wG, du, HG, aAN, cT, w, fP, ceF); #c1(MPST) c2(NP_001123989) c3(6946) c4(33060, 46117, 59174, 20003, 72231) c5(ih, pw, I, aF, q, cfM, G, t, fy, u, y); #c1(MPV17) c2(NP_005264383) c3(6947) c4(33061, 46118, 59175, 20004, 72232) c5(bP, dx, gB, cfO, VY, awQ, aoJ, di, sU, aSX, aeH, dv, atF, kW, wd, f, n, cfN, ov, aNN, apx, cV, cJ, du, bd, Q, bfc, et, btp, hT, na, fD); #c1(MPV17L2) c2(NP_116072) c3(6948) c4(33062, 46119, 59176, 20005, 72233) c5(aV); #c1(MPZ) c2(NP_000521) c3(6949) c4(33063, 46120, 59177, 20006, 72234) c5(mZ, aeK, aFY, aw, b, cG, bld, EM, vD, HS, cfT, U, bUr, bj, aCX, Bj, qZ, cfQ, cN, cfS, cfR, f, bCK, aDx, zm, jU, bK, bbu, aV, UR, ov, jH, te, cfU, V, wp, cV, nl, aiU, ao, j, MO, dt, cbr, PL, UT, yA, ac, bgD, xV, pk, amy, Y, cfP, bMm, HN, blb, ahe, cb, cH, tl, Xf, aT, AX); #c1(MPZL1) c2(NP_001139663) c3(6950) c4(33064, 46121, 59178, 20007, 72235) c5(Ag, ao, zi, q, T, Af, di, cp); #c1(MPZL2) c2(NP_658911) c3(6951) c4(33065, 46122, 59179, 20008, 72236) c5(wK, at, dt, alo, aNa, u, y); #c1(MPZL3) c2(NP_001273081) c3(6952) c4(33066, 46123, 59180, 20009, 72237) c5(dt); #c1(MR1) c2(NP_001181928) c3(6953) c4(33067, 46124, 59181, 20010, 72238) c5(jH, nV, bK, f, ag, hV, aib); #c1(MRAP2) c2(XP_011533703) c3(6954) c4(33068, 46125, 59182, 20011, 72239) c5(jj, aA, at, td); #c1(MRAP) c2(NP_848932) c3(6955) c4(33069, 46126, 59183, 20012, 72240) c5(Pw, be, ahB, cfV, fP, nl, Im, bD); #c1(MRAS) c2(NP_001239019) c3(6956) c4(33070, 46127, 59184, 20013, 72241) c5(V, eO, bq, U, at, bj); #c1(MRC1) c2(NP_002429) c3(6957) c4(33071, 46128, 59185, 20014, 72242) c5(pm, B, aw, EM, iU, sJ, w, e, O, cy, b, ajz, R, aC, fO, dB, Ce, x, fx, jT, av, ag, i, pt, X, jz, GO, ava, bw, U, y, co, f, akf, bu, gX, Em, cs, gg, fy, QD, V, jh, IR, mD, iA, dt, aen, in, Le, cz, tl, oM, aGZ, re, ck, am, Fc, ic, d, ec, Pk, oB, q, acO, ar, Lv, fv, u, da, Dg, ad, IX, ct, Ut, Lt, acN, iR, RU, IS, Bm, I, yA, af, qO, A, k, auj, lv, iL, Ld, jQ, aX, fq, F, cU, RQ, asW, pE, E, be, J, W, T, Zd, Ap, qp, adu, by, fP, Yv, avx, gj, Oi, eG); #c1(MRC2) c2(NP_006030) c3(6958) c4(33072, 46129, 59186, 20015, 72243) c5(d, Ag, qL, T, Af, u, e, O); #c1(MRE11A) c2(NP_005581) c3(6959) c4(33073, 46130, 59187, 20016, 72244) c5(GD, ji, A, b, X, QZ, adB, O, bw, U, Bz, bRB, y, aiH, co, jl, h, f, q, bu, cU, aC, ar, rR, cs, av, aV, u, o, g, V, qL, fO, J, gL, ad, W, Ce, T, Lk, pt, x, cK, fx, by, kS, ac, cq, WZ, dt, jT, i, oM); #c1(MREG) c2(NP_060470) c3(6960) c4(33074, 46131, 59188, 20017, 72245) c5(l, td); #c1(MRFAP1) c2(NP_150638) c3(6961) c4(33075, 46132, 59189, 20018, 72246) c5(ar, zr, iG); #c1(MRGBP) c2(NP_060740) c3(6962) c4(33076, 46133, 59190, 20019, 72247) c5(V, b, W, T, U, adr); #c1(MRGPRF) c2(NP_659452) c3(6963) c4(33077, 46134, 59191, 20020, 72248) c5(akd, jE, h, nU, Oa, J, P, II, fD, TW, yG, bm, zl, gO); #c1(MRGPRX1) c2(NP_671732) c3(6964) c4(33078, 46135, 59192, 20021, 72249) c5(d, qp, hW, I, Fw, Jq, cy, ag, P, w, dn, aX, aA, eN, e); #c1(MRGPRX3) c2(NP_473372) c3(6965) c4(33079, 46136, 59193, 20022, 72250) c5(d, qp, hW, I, Fw, Jq, cy, ag, P, w, dn, aX, aA, eN, e); #c1(MRGPRX4) c2(NP_473373) c3(6966) c4(33080, 46137, 59194, 20023, 72251) c5(d, qp, hW, I, Fw, Jq, cy, ag, P, w, dn, aX, aA, eN, e); #c1(MRI1) c2(NP_001026897) c3(6967) c4(33081, 46138, 59195, 20024, 72252) c5(80); #c1(MRM1) C2(NP_079140) c3(6968) c4(33082, 46139, 59196, 20025, 72253) c5(Ng); #c1(MROH2B) c2(NP_775760) c3(6969) c4(33083, 46140, 59197, 20026, 72254) c5(aV); #c1(MRO) c2(NP_001120647) c3(6970) c4(33084, 46141, 59198, 20027, 72255) c5(Dr, Bd, b, hX, nl, Bi, cT, ra, FN, T); #c1(MRPL10) c2(NP_660298) c3(6971) c4(33085, 46142, 59199, 20028, 72256) c5(dx, du); #c1(MRPL11) c2(NP_057134) c3(6972) c4(33086, 46143, 59200, 20029, 72257) c5(o); #c1(MRPL13) c2(NP_054797) c3(6973) c4(33087, 46144, 59201, 20030, 72258) c5(d, at, u, e, bu); #c1(MRPL15) c2(NP_054894) c3(6974) c4(33088, 46145, 59202, 20031, 72259) c5(bf); #c1(MRPL17) c2(NP_071344) c3(6975) c4(33089, 46146, 59203, 20032, 72260) c5(aC); #c1(MRPL19) c2(NP_055578) c3(6976) c4(33090, 46147, 59204, 20033, 72261) c5(u, yQ); #c1 (MRPL1) c2(NP_064621) c3(6977) c4(33091, 46148, 59205, 20034, 72262) c5(Eo, di, dA); #c1(MRPL23) c2(NP_066957) c3(6978) c4(33092, 46149, 59206, 20035, 72263) c5(X, av, by, bu); #c1(MRPL28) c2(XP_011520653) c3(6979) c4(33093, 46150, 59207, 20036, 72264) c5(A, b, k, X, Zy, iP, jz, i, w, lv, iG, gE, bw, U, pz, fx, y, jQ, aiH, M, jT, aX, jd, t, h, B, F, q, vQ, bu, cU, ra, ik, O, cB, iv, jG, fy, u, e, n, g, d, V, il, Fs, gm, bp, Yl, W, P, T, fO, J, nP, by, pJ, jV, iR, ie, G, aJt, cT, gR, ji, jC, at); #c1(MRPL33) c2(NP_004882) c3(6980) c4(33094, 46151, 59208, 20037, 72265) c5(aA); #c1(MRPL36) c2(NP_115868) c3(6981) c4(33095, 46152, 59209, 20038, 72266) c5(A, X, re, f, afn, iT, awk, T, B, pt, oM, av, u, y); #c1(MRPL3) c2(NP_009139) c3(6982) c4(33096, 46153, 59210, 20039, 72267) c5(cfW, cs, ay, jT, sK); #c1(MRPL40) c2(NP_003767) c3(6983) c4(33097, 46154, 59211, 20040, 72268) c5(afb); #c1(MRPL41) c2(NP_115866) c3(6984) c4(33098, 46155, 59212, 20041, 72269) c5(A, b, f, F, T, B, u, y); #c1(MRPL44) c2(NP_075066) c3(6985) c4(33099, 46156, 59213, 20042, 72270) c5(acU, cfX, cF); #c1 (MRPL49) c2(NP_004918) c3(6986) c4(33100, 46157, 59214, 20043, 72271) c5(aX); #c1(MRPL52) c2(NP_848026) c3(6987) c4(33101, 46158, 59215, 20044, 72272) c5(dA); #c1(MRPL9) c2(NP_001287662) c3(6988) c4(33102, 46159, 59216, 20045, 72273) c5(aA, u); #c1 (MRPS11) c2(NP_073750) c3(6989) c4(33103, 46160, 59217, 20046, 72274) c5(q, bu); #c1(MRPS12) c2(NP_203527) c3(6990) c4(33104, 46161, 59218, 20047, 72275) c5(by, bu); #c1(MRPS16) C2(NP_057149) c3(6991) c4(33105, 46162, 59219, 20048, 72276) c5(cfY); #c1 (MRPS18B) c2(NP_054765) c3(6992) c4(33106, 46163, 59220, 20049, 72277) c5(m, bu); #c1(MRPS22) c2(NP_064576) c3(6993) c4(33107, 46164, 59221, 20050, 72278) c5(u, kW, cfZ, sK); #c1(MRPS23) c2(NP_057154) c3(6994) c4(33108, 46165, 59222, 20051, 72279) c5(u); #c1(MRPS28) c2(NP_054737) c3(6995) c4(33109, 46166, 59223, 20052, 72280) c5(u); #c1(MRPS30) c2(NP_057724) c3(6996) c4(33110, 46167, 59224, 20053, 72281) c5(vq, jl, eK, V, anC, eu, zY, Ij, w, aA, cO, bf, J, wT, u, zW, y, bk); #c1(MRPS31) c2(NP_005821) c3(6997) c4(33111, 46168, 59225, 20054, 72282) c5(bf, aM); #c1(MRPS33) c2(NP_444263) c3(6998) c4(33112, 46169, 59226, 20055, 72283) c5(1); #c1(MRPS6) c2(NP_115865) c3(6999) c4(33113, 46170, 59227, 20056, 72284) c5(bq, at); #c1 (MRPS7) c2(NP_057055) c3(7000) c4(33114, 46171, 59228, 20057, 72285) c5(u); #c1(MRPS9) c2(NP_872578) c3(7001) c4(33115, 46172, 59229, 20058, 72286) c5(bw, I); #c1(MRRF) c2(NP_001166983) c3(7002) c4(33116, 46173, 59230, 20059, 72287) c5(acU); #c1(MRS2) c2(NP_001273193) c3(7003) c4(33117, 46174, 59231, 20060, 72288) c5(bP, by, qq, DE, qd, TU, aAV, bu, zM, HC, vR, di, aaR, YR, D, aAS, azo, fD, aA, wR); #c1(MRV11) c2(NP_001092049) c3(7004) c4(33118, 46175, 59232, 20061, 72289) c5(A, hW); #c1(MS4A12) c2(NP_001157942) c3(7005) c4(33119, 46176, 59233, 20062, 72290) c5(cs, ad); #c1(MS4A1) c2(NP_068769) c3(7006) c4(33120, 46177, 59234, 20063, 72291) c5(Zq, Zs, bf, aHp, bXP, cy, t, aoF, yh, fH, gl, bXQ, aC, gm, fO, aoS, aHv, jT, OR, cT, axC, bq, jl, fl, jz, eu, Ku, kY, Ou, U, cM, V, hg, Em, ss, bXO, fY, wK, CZ, Ov, nl, afz, ny, fJ, dP, ne, cga, gR, WH, anh, b, qz, oR, IS, bxk, yW, u, ov, Dg, LR, j, G, pD, jG, yG, hU, aE, hd, zD, xu, Jo, mW, zz, gE, jQ, m, bXN, ajn, h, M, y, aV, fU, be, J, P, aX, Pk, aM, mk, Ic, eG); #c1(MS4A2) c2(NP_001243845) c3(7007) c4(33121, 46178, 59235, 20064, 72292) c5(dx, bGG, Ka, U, vl, gM, bb, t, DM, aD, fH, fh, V, I, TK, du, ti, vM, cy, JN, fJ, qe, dP, gd, Dl, fq, Xz, at); #c1(MS4A3) c2(NP_001026836) c3(7008) c4(33122, 46179, 59236, 20065, 72293) c5(cy, b, dA, do, ar, QJ); #c1(MS4A4A) c2(NP_001230195) c3(7009) c4(33123, 46180, 59237, 20066, 72294) c5(gk, fl, o); #c1(MS4A6A) c2(NP_001234928) c3(7010) c4(33124, 46181, 59238, 20067, 72295) c5(tF, gk, fl, o); #c1(MS4A8) c2(NP_113645) c3(7011) c4(33125, 46182, 59239, 20068, 72296) c5(A, ar, B, b, cs); #c1(MSANTD3-TMEFF1) c2(NP_001185741) c3(7012) c4(33126, 46183, 59240, 20069, 72297) c5(g, b); #c1(MSC) c2(NP_005089) c3(7013) c4(33127, 46184, 59241, 20070, 72298) c5(bP, by, bi, aw, b, X, zF, pR, IW, eu, pD, O, aNP, w, ds, ZM, z, bf, U, G, xl, cp, aX, pp, ag, jd, t, f, q, cc, bu, jo, nL, vu, aO, gg, iJ, fH, av, aV, u, dh, ff, g, wK, aP, V, fJ, sB, gm, cM, J, IR, IX, IJ, fO, bq, gn, bb, ad, anf, jU, aM, bPT, ao, cs, sS, fP, PY, fw, aE, gd, cT, IS, fD, fl, zS, aA, y); #c1(MSGN1) c2(NP_001099039) c3(7014) c4(33128, 46185, 59242, 20071, 72299) c5(dB); #c1(MSH2) c2(NP_000242) c3(7015) c4(33129, 46186, 59243, 20072, 72300) c5(fA, B, aw, mi, bx, EM, gG, iX, dB, w, PM, KK, ps, e, O, Hq, bhQ, t, dl, sL, ji, jU, acy, ajz, g, aC, Dt, gJ, gm, bp, Ce, x, fx, jT, HR, kN, BX, bm, Yw, DO, os, ag, cT, i, pt, bP, cj, cY, jz, pd, bo, bw, U, Co, y, tp, co, ip, adr, f, cs, bu, iv, iJ, av, fy, hD, iT, is, fi, V, Qz, YS, ny, Qt, iA, Mp, W, aen, af, in, Le, br, qO, oM, ci, ck, b, ceC, cgc, YO, ic, re, Mr, d, jh, bb, jd, oB, q, es, X, ar, RF, ava, u, dh, ff, QD, fs, il, qL, el, avo, ad, IX, G, agm, Vw, ct, Ut, Lt, jH, wV, nV, iR, jc, wP, fl, I, yA, fj, bmE, A, IO, k, pR, gw, jl, gN, BY, Iv, hP, Nm, jQ, QV, Oh, aX, h, anM, F, jA, cU, ik, n, cB, apb, QJ, J, dt, jo, T, II, Oi, jl, nP, by, cgb, adu, zU, Yv, avx, bh, iE); #c1(MSH3) c2(NP_002430) c3(7016) c4(33130, 46187, 59244, 20073, 72301) c5(dx, jp, hg, aw, dB, w, t, kX, g, fe, aeM, aC, iv, fO, ft, Ce, fx, jT, lu, ag, bk, i, pt, bT, QF, X, iP, jz, jf, hS, iG, cA, bw, U, y, co, f, bu, B, cs, av, fy, bm, fi, V, Qt, iA, lx, du, iY, qO, ji, b, q, ar, jG, u, il, by, G, iO, nV, bq, I, A, k, fr, Iv, Iw, hP, iM, jQ, aX, h, F, cU, ik, n, jx, fU, cV, J, W, P, T, oM, ad, E); #c1(MSH5) c2(NP_079535) c3(7017) c4(33131, 46188, 59245, 20074, 72302) c5(WH, NT, jl, am, b, m, aC, Jo, wn, jw, IS, aE, aW); #c1(MSH6) c2(NP_000170) c3(7018) c4(33132, 46189, 59246, 20075, 72303) c5(fA, A, aw, b, k, cY, EM, jz, dB, wy, MS, w, Iv, O, bw, U, bu, hP, fx, y, jQ, jT, aX, E, cgd, es, cU, X, hN, ar, B, pt, as, av, ji, u, OT, g, fi, V, an, aHi, cs, bp, ad, W, Ce, T, Jj, Kv, Qt, x, af, iA, by, ava, ac, pb, iw, aen, iR, To, adu, jR, Qa, aC, yE, et, Oi, fl, i, I, oM, jl, eG, hd); #c1(MSI1) c2(NP_002433) c3(7019) c4(33133, 46190, 59247, 20076, 72304) c5(bS, b, wK, iU, w, kY, U, fx, y, d, co, re, f, e, q, bu, cU, gX, ar, O, cs, u, o, fh, g, fi, V, gL, ad, W, T, iA, by, bm, jR, i, fl, I, eG); #c1(MSI2) C2(NP_620412) c3(7020) c4(33134, 46191, 59248, 20077, 72305) c5(co, t, h, ak, q, J, M, G, n, jG); #c1(MSLN) c2(XP_005255091) c3(7021) c4(33135, 46192, 59249, 20078, 72306) c5(YZ, aw, kY, b, X, iP, oi, iG, bw, BQ, y, d, tp, co, kJ, jd, t, h, e, bu, cU, ar, cs, fv, av, iR, gG, yg, ad, G, T, fM, JY, u, os, ag, IN, agQ, ji); #c1(MSMB) c2(NP_002434) c3(7022) c4(33136, 46193, 59250, 20079, 72307) c5(acE, A, aw, kE, b, pN, F, DQ, sE, dB, Ip, w, rv, Fh, U, Uq, vl, Up, jh, co, aX, Ob, kJ, bn, re, B, bOx, q, bu, cU, ar, y, qw, OA, fy, u, iT, oJ, PJ, fU, V, ae, kt, wh, by, T, II, jl, cge, ao, qp, eV, qG, PY, dY, ag, agw, acF, xX, VT, iA, eG); #c1(MSMOl) c2(NP_001017369) c3(7023) c4(33137, 46194, 59251, 20080, 72308) c5(cgf, I, b); #c1(MSMP) c2(NP_001037729) c3(7024) c4(33138, 46195, 59252, 20081, 72309) c5(A, bb, B); #c1(MSN) c2(NP_002435) c3(7025) c4(33139, 46196, 59253, 20082, 72310) c5(B, b, X, EM, A, eM, bw, O, e, y, d, BO, aX, LI, js, ag, Be, re, hg, F, cU, FN, ar, aW, cs, av, u, iT, si, PQ, gL, BV, pr, P, II, cl, iA, ad, gg, jd, w, ji, at); #c1(MSRI) c2(NP_002436) c3(7026) c4(33140, 46197, 59254, 20083, 72311) c5(dx, B, aw, b, X, jL, Fc, A, O, y, jh, co, t, Si, jG, Up, av, u, o, mz, LR, fD, I, du, J, YI, G, dv, x, gg, py, bm, fl, i, cgg, I, Mp, at, ap); #c1(MSRA) c2(NP_001129142) c3(7027) c4(33141, 46198, 59255, 20084, 72312) c5(pV, cV, rh, f, q, v, yS, di, bk, iL, qB, aC, bb, IV, at, aA, bq, ap); #c1(MSRB2) c2(NP_036360) c3(7028) c4(33142, 46199, 59256, 20085, 72313) c5(gB); #c1(MSRB3) c2(NP_001180390) c3(7029) c4(33143, 46200, 59257, 20086, 72314) c5(cgi, cgh, aHE, ak, Eg); #c1(MSTI) c2(NP_066278) c3(7030) c4(33144, 46201, 59258, 20087, 72315) c5(hV, kE, b, F, DQ, gG, dB, Ip, Ty, sJ, w, rv, O, Fh, e, U, aoD, A, vl, y, d, jh, cK, co, aX, Ob, kn, re, f, bOx, g, bu, cU, mR, B, qw, cs, ar, zQ, aV, u, iT, oJ, PJ, fU, V, ae, kt, LR, wh, bp, ad, nV, T, II, Uq, fy, cl, iA, by, gg, jH, ao, qp, eV, OA, qG, fc, bgV, PY, dY, gC, ag, og, agw, fP, acF, xX, VT, bq, eG, rr); #c1(MSTIR) c2(NP_001231866) c3(7031) c4(33145, 46202, 59259, 20088, 72316) c5(A, b, X, dB, pD, Ip, O, U, e, y, d, co, Ml, fy, hV, q, bu, WO, fr, ar, B, cs, av, aV, u, fU, aEf, V, jH, bK, J, bp, ad, W, P, nV, T, II, x, fx, by, BZ, jT, qp, sh, akT, ag, fP, i, eG); #c1(MSTN) c2(NP_005250) c3(7032) c4(33146, 46203, 59260, 20089, 72317) c5(cgj, b, em, Fc, hM, aaZ, cO, U, xl, c, dv, f, cc, kz, Ex, cM, bQo, oD, wh, oJ, sz, V, I, dA, Ue, Au, v, P, od, bgw, hR, dL, Yp, wC, wR, ao, En, aY, fN, dc, I, aA, ap, cl, oT); #c1(MSTOI) c2(NP_001243462) c3(7033) c4(33147, 46204, 59261, 20090, 72318) c5(pw, t, ih, G, aW, fy, u, y); #c1(MSXI) c2(NP_002439) c3(7034) c4(33148, 46205, 59262, 20091, 72319) c5(rU, cgm, bj, y, Tq, re, cV, amQ, bu, axK, fH, cgk, aoj, u, bjD, si, afx, GS, fO, cgo, amR, cgl, AP, fJ, rQ, bjG, iT, Nq, yy, Ns, amS, bpz, boO, apU, cgn); #c1(MSX2) c2(NP_002440) c3(7035) c4(33149, 46206, 59263, 20092, 72320) c5(aw, b, arB, X, aF, akL, cgq, di, bw, y, cgp, aX, kJ, anM, Un, cgr, Um, UF, av, u, dh, agu, AI, nl, gv, aPe, amR, cgl, AP, ao, Nq, vH, ag, Ns, cgs, bq, bh, apU, apF); #c1(MTIA) c2(NP_005937) c3(7036) c4(33150, 46207, 59264, 20093, 72321) c5(QU, KC, Qv, aw, b, gK, dB, Ip, A, bf, vp, e, y, d, tp, jl, I, hV, q, yx, bu, Vr, B, aJ, fy, u, og, Pz, ez, VD, eJ, gL, by, W, T, x, FW, nP, aM, dt, nV, nc, PY, m, i, ap, oT); #c1(MTIB) c2(NP_005938) c3(7037) c4(33151, 46208, 59265, 20094, 72322) c5(KC, eX, b, eR, hM, bf, y, jl, f, q, ar, fy, u, aag, ez, I, x, FW, gF, aM, eJ, fS, PY, aah, at, ap); #c1(MTIE) c2(NP_783316) c3(7038) c4(33152, 46209, 59266, 20095, 72323) c5(KC, b, iU, hS, fx, y, aQu, jl, q, cU, Vr, O, fy, u, ez, I, qL, cM, dB, aZ, x, FW, iA, eJ, PY, i); #c1(MTIF) c2(NP_005940) c3(7039) c4(33153, 46210, 59267, 20096, 72324) c5(KC, jB, bm, jl, I, b, eJ, qL, nl, bj, PY, q, x, fy, et, FW, Vs, u, y, ez); #c1(MTIG) c2(NP_001288196) c3(7040) c4(33154, 46211, 59268, 20097, 72325) c5(KC, f, dB, A, U, cp, jl, h, hV, q, ik, B, ez, fy, u, jB, og, V, I, x, FW, eJ, nV, PY); #c1(MTIH) c2(NP_005942) c3(7041) c4(33155, 46212, 59269, 20098, 72326) c5(KC, jE, jl, I, b, eJ, bm, f, dB, PY, q, i, x, FW, fx, fy, u, y, ez); #c1(MTIM) c2(NP_789846) c3(7042) c4(33156, 46213, 59270, 20099, 72327) c5(KC, jl, ez, I, eJ, f, PY, q, x, FW, fy, u); #c1(MTIX) c2(NP_005943) c3(7043) c4(33157, 46214, 59271, 20100, 72328) c5(d, KC, A, jl, ez, I, eJ, B, PY, q, fK, i, x, FW, fx, fy, u, e); #c1(MT2A) c2(NP_005944) c3(7044) c4(33158, 46215, 59272, 20101, 72329) c5(dx, GD, by, A, b, X, vY, vp, ey, ft, y, m, dv, bb, f, q, bu, aMN, fr, ik, cM, aJ, cs, av, u, rR, yJ, I, nl, nW, du, bmp, ad, Qu, aiL, FW, fx, hR, et, jU, jT, rQ, gs, aY, B, i, dc, aA, Vs); #c1(MT3) c2(NP_005945) c3(7045) c4(33159, 46216, 59273, 20102, 72330) c5(A, b, aN, BY, hM, aK, e, cM, d, LL, h, ar, aJ, sR, mT, fy, u, SV, J, by, W, T, fx, OA, eJ, aY, FI, ih, mS, i, dc, vZ); #c1(MT4) c2(NPJI6324) c3(7046) c4(33160, 46217, 59274, 20103, 72331) c5(fy); #c1(MTA1) c2(NP_001190187) c3(7047) c4(33161, 46218, 59275, 20104, 72332) c5(sa, An, aw, b, asx, X, A, iL, U, e, y, d, cU, co, aX, Bc, ja, f, q, bu, dl, aFA, ar, aW, av, fy, u, V, il, jh, qL, gm, IT, T, pw, jT, fM, jE, qp, anG, bm, B, ag, Yv, eG); #c1(MTA2) c2(NP_004730) c3(7048) c4(33162, 46219, 59276, 20105, 72333) c5(fn, aw, b, aFy, eu, VG, y, m, co, kJ, f, bu, cs, zQ, fy, u, by, BW, fx, ad, cgt, i, eG); #c1(MTA3) c2(NP_065795) c3(7049) c4(33163, 46220, 59277, 20106, 72334) c5(jT, co, b, X, gm, ar, bf, av, fy, u, y); #c1(MTAP) c2(NP_002442) c3(7050) c4(33164, 46221, 59278, 20107, 72335) c5(cgu, A, b, fr, rR, Zy, iP, jz, eH, kB, oi, di, Iv, bw, bf, O, e, y, jQ, d, co, aX, t, aAa, f, q, bu, ar, B, cB, cs, fv, fy, u, anu, Ng, fh, I, J, ft, W, G, qp, T, bq, by, fM, JY, jT, cgv, st, iY, py, DO, os, ag, Ez, h, anE, ic); #c1(MTBP) c2(NP_071328) c3(7051) c4(33165, 46222, 59279, 20108, 72336) c5(b, fr, gm, ft, at, u, y); #c1(MTCH1) c2(NP_001258570) c3(7052) c4(33166, 46223, 59280, 20109, 72337) c5(Ba, fs, aeq, b, vQ, wz); #c1(MTCH2) c2(NP_055157) c3(7053) c4(33167, 46224, 59281, 20110, 72338) c5(cy, b, I, dA, aA, bm, ap); #c1(MTCL1) c2(NP_056025) c3(7054) c4(33168, 46225, 59282, 20111, 72339) c5(d, ik, bb, e, cO); #c1(MTCP1) c2(NP_001018025) c3(7055) c4(33169, 46226, 59283, 20112, 72340) c5(atn, aKV, if, A, KA, qz, J, gm, Iv); #c1(MTDH) c2(NP_848927) c3(7056) c4(33170, 46227, 59284, 20113, 72341) c5(by, A, aw, iL, b, X, O, w, kY, gE, U, e, y, d, jh, aX, Ec, sG, h, f, F, q, bu, cU, fr, ky, B, aJ, cs, ik, av, fy, u, iT, g, V, iI, cV, bK, v, ad, P, T, Ez, iA, ft, qW, jE, bm, apG, agQ, Oi, re); #c1(MTERF1) c2(XP_006716189) c3(7057) c4(33171, 46228, 59285, 20114, 72342) c5(awV, av, kW); #c1(MTFI) c2(XP_011539794) c3(7058) c4(33172, 46229, 59286, 20115, 72343) c5(Dr, og, q, cz, nV, hM); #c1(MTFMT) c2(NP_640335) c3(7059) c4(33173, 46230, 59287, 20116, 72344) c5(ake, A, b, cE, bxp, cgw, B); #c1(MTFP1) c2(NP_001003704) c3(7060) c4(33174, 46231, 59288, 20117, 72345) c5(fD); #c1(MTGI) c2(NP_612393) c3(7061) c4(33175, 46232, 59289, 20118, 72346) c5(aWj, jK, hV, aw, cT, mp, bAw, ey, dj, kP, O, hS, A, di, gE, bAt, bf, U, agb, cgx, y, d, m, b, co, aX, dN, Ec, h, f, e, q, yE, zx, jo, tF, EM, B, cB, cs, as, Ll, u, afY, ff, mz, ajs, fU, V, cV, an, be, qs, bp, ad, dt, byM, Hq, bol, qP, cA, gF, aM, wU, ct, cbk, EZ, Ww, bm, cf, MP, he, xU, ag, gA, TD, bk, hM, re); #c1(MTHFD1) c2(NP_005947) c3(7062) c4(33176, 46233, 59290, 20119, 72347) c5(dx, caG, A, vg, b, X, cr, IJ, Nq, mk, xf, tG, bW, U, bj, y, gM, arY, co, bb, sG, t, ak, Ns, bu, cd, ar, B, tg, cs, nA, Nf, av, fy, u, o, fh, fU, V, aC, sH, du, J, gL, ad, vc, bp, LA, bc, cz, iw, aY, aq, G, gA, I, aA, LB); #c1(MTHFD1L) c2(NP_001229696) c3(7063) c4(33177, 46234, 59291, 20120, 72348) c5(gk, bb, dA, Gs, bq, at, aq, aE, o); #c1(MTHFD2) c2(NP_006627) c3(7064) c4(33178, 46235, 59292, 20121, 72349) c5(IJ, cr, b, q, Nq, Ns, i, I, u, y); #c1(MTHFR) c2(XP_011539797) c3(7065) c4(33179, 46236, 59293, 20122, 72350) c5(Gt, dD, iX, dB, abd, Ip, hM, JH, aoK, e, cp, gM, arY, acL, agn, dl, gP, mz, fe, ajc, aC, ajy, ME, YT, JN, vG, pq, jE, tl, ie, tO, ag, fD, bq, aA, GJ, wz, ug, caG, X, vD, ig, xK, sF, GV, bw, vl, Oh, cM, fm, sr, ps, ak, N, aaj, av, fy, wK, V, ae, nl, cd, tj, J, f J, xd, aY, xe, apU, ap, bn, LA, vY, jy, pl, Ag, HW, tg, oO, dh, wY, da, il, sX, bc, gL, ad, aDC, aaB, aeo, iw, ao, nV, cgl, vT, Ns, aU, yA, Yj, vg, wc, fr, pR, gn, gN, vZ, C, iL, gE, jw, jQ, m, cr, or, wG, qB, Xc, Ps, be, bd, Ap, aBe, Ic, fP, jN, cgE, tM, dM, BF, tC, eH, wj, bf, O, at, bLD, jm, cgA, Zv, du, yO, gm, bp, Ce, x, atn, qt, BX, dS, adr, mx, Fv, sU, bP, aEX, Jy, iP, dj, ve, rd, mk, pX, ix, cA, I, gZ, amo, f, bbG, bu, LB, bpV, wH, adf, qw, fC, gv, ny, qD, aH, tm, nb, hp, aMQ, aBY, QO, aUZ, JO, tl, aLP, Ig, am, mZ, qz, wn, z, blU, d, bb, aqB, jd, vj, PA, q, dW, ff, fE, aM, iR, bzf, o, fh, arQ, kF, aSC, ob, dT, rw, ct, wd, Ut, jH, rQ, ch, ale, GM, gd, bpB, cgz, gU, pD, aBV, bpE, eO, al, aW, wr, hN, Gs, cB, aq, bpM, bpz, ax, hW, ez, gV, dt, T, Bb, aCC, nk, ii, Kj, hq, vW, Vp, gf, pM, dx, IJ, eX, aw, dN, aoL, Eh, eD, hO, GH, BI, aaU, aKf, fH, g, bK, yL, fO, vc, vM, fx, hR, bFY, aDJ, bzR, cT, xb, ahp, yu, Dv, TM, jz, cgF, kB, bW, Eh, vV, tp, Ei, dg, na, ml, B, bpL, gX, iv, bta, hj, pP, iT, QD, v, cx, bQ, aR, bt, wA, iA, JY, cgK, dO, bkq, fw, uK, iu, abB, aSG, uy, b, aF, cgH, tG, re, hV, je, bql, Vd, NT, wp, awy, cz, cgy, et, aSH, hT, Bg, ex, vP, acb, aAZ, rp, mW, xf, rj, wf, vH, qs, LS, cgJ, Qm, sG, bj, cU, tF, ik, sb, wb, wo, ei, W, ti, aBW, jl, aro, fM, HL, bpG, ME, agl, Y, tA, cgD, amS, cgC, eN, adl, pV, Gm, gG, eC, w, gO, dv, cy, bqa, t, agw, sZ, sO, tE, gl, Ew, sH, gJ, gY, Lb, jT, dL, dH, nh, hQ, fN, wi, acs, os, tK, bqi, i, dc, Nn, id, td, Zx, Nr, aFy, hS, aiM, IW, y, ip, un, UV, vQ, cs, kN, bm, uO, em, fz, jh, IM, dP, py, aUW, er, gA, gO, uh, aaW, nU, qG, ia, eR, yU, ic, Og, xg, ey, nS, eV, aO, Iz, AK, pn, ar, qe, aRY, cgB, jG, u, wR, PJ, qy, Pz, I, VL, qC, acv, by, BZ, wM, G, cfp, fu, rm, aUN, eQ, he, aE, ih, I, vf, azt, bL, A, cgG, di, Bz, hP, yw, oy, aX, fq, h, F, qr, M, Ex, ID, gg, nA, aV, IG, fU, si, GB, P, co, j, Oi, ac, to, Nq, bh, LQ); #c1(MTHFS) c2(NP_006432) c3(7066) c4(33180, 46237, 59294, 20123, 72351) c5(IJ, jl, V, X, Nq, gm, Ns, fD, ap); #c1(MTIF2) c2(NP_001005369) c3(7067) c4(33181, 46238, 59295, 20124, 72352) c5(1); #c1(MTIF3) c2(XP_011533265) c3(7068) c4(33182, 46239, 59296, 20125, 72353) c5(aA, cV, bj, I, dA); #c1(MTL5) c2(NP_001034745) c3(7069) c4(33183, 46240, 59297, 20126, 72354) c5(bg); #c1(MTMI) c2(XP_011529475) c3(7070) c4(33184, 46241, 59298, 20127, 72355) c5(f, lr, b, cG, AA, CT, aWu, eX, Vl, bu, Lm, mR, cc, oD, nl, el, dt, ac, cgN, Y, At, xP, cgM, cgL); #c1(MTMR11) c2(XP_011507401) c3(7071) c4(33185, 46242, 59299, 20128, 72356) c5(hS, U, V, b, cl); #c1(MTMRI2) c2(NP_001035536) c3(7072) c4(33186, 46243, 59300, 20129, 72357) c5(xP, VI); #c1(MTMR14) c2(NP_001070993) c3(7073) c4(33187, 46244, 59301, 20130, 72358) c5(KC, bhj, xP, VI, oD); #c1(MTMRI) c2(NP_003819) c3(7074) c4(33188, 46245, 59302, 20131, 72359) c5(el, xP); #c1(MTMR2) c2(NP_057240) c3(7075) c4(33189, 46246, 59303, 20132, 72360) c5(qZ, bbO, PL, Y, er, v, VI, cb, xP, ac, cG, ahe, cgL); #c1(MTMR3) c2(NP_066576) c3(7076) c4(33190, 46247, 59304, 20133, 72361) c5(fl, b, f, bp, bu, co, by); #c1(MTMR4) c2(XP_006722231) c3(7077) c4(33191, 46248, 59305, 20134, 72362) c5(kC, cc); #c1(MTMR6) c2(NP_004676) c3(7078) c4(33192, 46249, 59306, 20135, 72363) c5(b); #c1(MTMR7) c2(NP_004677) c3(7079) c4(33193, 46250, 59307, 20136, 72364) c5(eJ, dA); #c1(MTMR8) c2(NP_060147) c3(708D) c4(33194, 46251, 59308, 20137, 72365) c5(aW); #c1(MTMR9) c2(NP_056273) c3(7081) c4(33195, 46252, 59309, 20138, 72366) c5(aA, di); #c1(MTNRIA) c2(NP_005949) c3(7082) c4(33196, 46253, 59310, 20139, 72367) c5(KC, lb, fr, e, y, d, jl, Wk, ml, q, fy, u, o, ez, I, aC, cz, x, FW, eJ, rQ, PY, cC, HV); #c1(MTNRIB) c2(NP_005950) c3(7083) c4(33197, 46254, 59311, 20140, 72368) c5(dx, lb, HV, jC, bf, ey, cC, y, bQ, aX, Wk, eX, aMN, NJ, cM, u, mz, kF, I, aC, nl, du, cz, P, FW, fx, jU, aM, wG, rQ, aY, MP, mA, Hf, na, i, dc, aA); #c1(MTOI) c2(NP_001116698) c3(7084) c4(33198, 46255, 59312, 20141, 72369) c5(b, SS, cE, cgO, na, I, cK, u, y, sK); #c1(MTPAP) c2(NP_060579) c3(7085) c4(33199, 46256, 59313, 20142, 72370) c5(aE, vq, jl, eK, aX, V, eu, zY, J, cgP, w, awS, cO, bf, aA, wT, zW, o, bk); #c1(MTPN) c2(NP_665807) c3(7086) c4(33200, 46257, 59314, 20143, 72371) c5(di, cO); #c1(MTRFI) c2(XP_006719963) c3(7087) c4(33201, 46258, 59315, 20144, 72372) c5(bP, fD); #c1(MTR) c2(NP_000245) c3(7088) c4(33202, 46259, 59316, 20145, 72373) c5(dx, IJ, f, iX, eH, w, ps, e, O, gM, aDo, avt, b, iR, t, gP, g, jH, aAl, bK, sH, du, gm, bp, ME, fx, jT, ahX, BX, nh, hQ, ag, mx, i, dc, bg, aA, Nn, mZ, caG, fl, adf, TM, hS, sF, GV, bw, U, eo, cM, co, ip, ak, bu, B, cs, fy, iT, em, V, ae, cx, cd, aR, ny, acb, hs, bkq, py, aY, dY, mS, ap, abB, am, jJ, wn, jy, fD, aO, d, jh, bb, QO, jd, re, vf, q, dW, HW, mL, ar, Nf, u, o, tE, NT, kF, I, fz, ad, G, cgy, et, Ut, cW, iw, ch, ex, na, Ns, I, di, fh, bL, A, fr, bpE, Bz, hP, yw, aW, bJi, qs, cr, il, sG, bj, h, F, aC, hN, ik, y, cB, nA, aV, aq, bpz, fU, si, m, xf, J, W, T, fO, jl, cz, ac, to, Nq, by, amS, fP, jN, E, cgC, bh, at); #c1(MTRNR2L7) c2(NP_001177418) c3(7089) c4(33203, 46260, 59317, 20146, 72374) c5(aA); #c1(MTRR) c2(NP_002445) c3(7090) c4(33204, 46261, 59318, 20147, 72375) c5(dx, IJ, f, aw, cO, bW, e, O, gM, dv, b, t, gP, g, aC, bK, sH, du, bp, fx, hQ, ie, ag, cT, i, dc, bq, aA, jl, Nn, mZ, caG, fl, adf, TM, hS, pX, GV, bw, U, cM, co, ip, ak, mx, bbG, bu, LB, B, cs, fy, bm, iT, em, V, cd, aR, W, aY, ap, am, LA, wn, jy, BQ, aO, d, jh, bb, jd, re, vf, q, dW, HW, ar, as, Nf, Vd, u, aE, o, tE, PJ, NT, ad, G, et, jH, ex, na, Ns, I, xf, fh, bL, A, BY, di, iL, Bz, bj, aW, m, cr, sG, h, F, y, nA, aV, aq, fU, si, cgQ, an, J, dt, fO, aX, cz, fM, to, Nq, by, fP, jN, cgC, at); #c1(MTSS1) C2(NP_001269903) c3(7091) c4(33205, 46262, 59319, 20148, 72376) c5(d, A, aX, V, b, B, e, q, jR, bu, T, i, jl, U, by, u, fx, y); #c1(MTTP) c2(NP_000244) c3(7092) c4(33206, 46263, 59320, 20149, 72377) c5(dx, f, aw, eH, w, hM, bf, ps, cgR, dv, iy, t, om, n, mz, aag, fe, du, po, fO, hR, dL, oQ, fN, aah, dc, bq, aA, ZT, jz, eu, oH, U, cM, px, pp, hg, N, iv, bm, em, V, cx, hi, Fy, eX, aaa, aY, fS, gR, ap, b, aF, eR, oR, z, jy, pi, q, fM, jG, u, il, G, oV, Ha, hX, fg, pD, di, iL, gE, al, aW, jQ, oy, I, h, ik, y, cB, jZ, J, dt, P, ll, gF, pc, aM, jT, pG, Y, pl, bh, at); #c1(MTURN) c2(NP_690006) c3(7093) c4(33207, 46264, 59321, 20150, 72378) c5(bq); #c1(MTUS1) c2(NP_001001931) c3(7094) c4(33208, 46265, 59322, 20151, 72379) c5(A, b, bq, B, q, T, i, bzm, ar, av, u, fx, y); #c1(MTUS2) c2(NP_001028774) c3(7095) c4(33209, 46266, 59323, 20152, 72380) c5(oy, cy, cO); #c1(MTX1) c2(NP_002446) c3(7096) c4(33210, 46267, 59324, 20153, 72381) c5(da, aX, afx, aC, t, zH, iX, J, ad, wz, G, xf, tE, cs, bb, jT, u, y); #c1(MTX2) c2(NP_006545) c3(7097) c4(33211, 46268, 59325, 20154, 72382) c5(ak); #c1(MUC12) c2(NP_001157934) c3(7098) c4(33212, 46269, 59326, 20155, 72383) c5(ccS, U, V, b, jH); #c1 (MUC13) c2(NPJ49038) c3(7099) c4(33213, 46270, 59327, 20156, 72384) c5(jH, by, b, X, bu, fP, av, ad, dh, ccS); #c1(MUC15) c2(NP_001128563) c3(7100) c4(33214, 46271, 59328, 20157, 72385) c5(cs, ccS, ad); #c1(MUC17) c2(NP_001035194) c3(7101) c4(33215, 46272, 59329, 20158, 72386) c5(jH, jU, V, b, kJ, X, be, cs, ct, ad, W, ag, ccS, Qt, aC, bw, av, u, U, y, js); #c1(MUC19) c2(NP_775871) c3(7102) c4(33216, 46273, 59330, 20159, 72387) c5(jH, fP, ccS); #c1(MUC1) c2(NP_001018016) C3(7103) c4(33217, 46274, 59331, 20160, 72388) c5(cgS, SC, aw, bx, sd, gG, dB, Ip, bKw, en, PM, bf, e, Ej, bzw, cU, jT, cy, kJ, jc, Dd, rR, Ad, aeM, aC, gJ, gm, fO, Ce, jx, x, fx, YY, vG, gg, pb, aZn, fN, sJ, ag, Lo, oi, bk, i, dc, aA, aKj, bP, GD, sa, zu, kN, cY, iP, jz, eu, hS, ma, iG, ot, bw, U, cM, jh, tp, co, Ml, pp, PL, DM, f, bKv, bu, B, cs, vo, av, fy, iT, fi, V, arY, nI, bt, cl, pi, JY, py, aY, P, jR, cgU, aEQ, fD, fW, ccS, Dr, gz, wt, b, beC, bKz, au, BQ, Mr, d, jh, fv, aol, re, hV, q, X, dQ, ff, ar, jG, u, QM, kF, il, qL, LR, gL, ad, Fo, vw, et, et, jU, jH, nV, hT, cgT, vT, dn, fl, I, af, A, k, gn, gN, BY, og, VG, al, hP, Sj, MT, aX, ob, ni, h, F, jQ, az, avj, ik, y, ZU, wF, fU, cV, Be, be, J, po, W, jo, T, aox, ji, by, aph, qp, jp, js, zE, vU, Dl, fP, eG, gf, rZ); #c1(MUC20) c2(NP_001269435) c3(7104) c4(33218, 46275, 59332, 20161, 72389) c5(c0, iA, fl, ccS); #c1(MUC21) c2(NP_001010909) c3(7105) c4(33219, 46276, 59333, 20162, 72390) c5(d, da, m, ix, T, hM, yi, iu, e); #c1(MUC22) c2(NP_001185744) c3(7106) c4(33220, 46277, 59334, 20163, 72391) c5(aZS); #c1 (MUC2) c2(NP_002448) C3(7107) c4(33221, 46278, 59335, 20164, 72392) c5(B, sd, gG, IM, cO, e, cU, cy, kJ, OM, dl, mR, arp, aC, Xc, pF, x, fx, YY, kN, mO, gs, ag, bk, GD, X, iP, cgV, bw, U, Oh, y, jb, tp, co, js, DM, f, bu, cs, av, fy, bm, is, fi, V, bt, Qt, cK, py, dY, fW, ccS, b, Pv, au, z, BQ, Ne, d, gz, ar, u, dh, sz, gL, by, Fo, ct, jU, jH, aKI, gd, Mp, af, A, fd, jc, xa, hP, cgW, Qm, az, rR, jZ, mc, W, T, bh, ad, sK, zE, Zb, bbF, DI, fP, Oi); #c1(MUC3A) c2(NP_005951) c3(7108) c4(33222, 46279, 59336, 20165, 72393) c5(jH, V, b, X, be, cs, ct, ad, W, aC, T, ccS, Qt, bw, av, u, U, y, js); #c1(MUC4) c2(NP_004523) c3(7109) c4(33223, 46280, 59337, 20166, 72394) c5(jp, sa, A, aw, b, X, EB, gG, gn, ct, bw, e, y, cy, d, tp, QV, co, Ml, kJ, DM, B, OM, q, bu, fr, ar, cs, fv, av, fy, u, dn, il, dB, ad, W, T, Qt, aX, ca, ft, JY, pb, jH, jx, qp, af, zE, ale, bm, bIH, os, by, ag, DI, fP, bk, aBz, ji, eG, ccS, aKj); #c1(MUC5AC) c2(NP_001291288) c3(7110)

c4(33224, 46281, 59338, 20167, 72395) c5(ml, aw, bx, sd, DT, vB, OH, e, bQ, cy, kJ, dl, aPf, aC, IM, x, gg, Pw, os, ag, bk, aal, X, cgX, Kc, bw, U, jb, tp, co, Ml, js, DM, f, bu, cs, av, fy, fi, SA, V, BV, bt, eF, py, cgU, ji, fW, ccS, b, BQ, Mr, d, eA, dQ, ar, u, kF, qL, by, Fo, aZ, ct, aKI, cgT, yr, gd, dn, I, aZU, Mp, af, A, TQ, gn, BY, cU, be, W, T, ll, aEQ, ad, zE, Zb, bbF, DI, fP, rZ); #c1(MUC5B) c2(NP_002449) c3(7111) c4(33225, 46282, 59339, 20168, 72396) c5(B, Al, bt, b, DT, vB, sJ, A, ct, bu, y, cy, DM, f, bty, dl, ar, cs, gg, fy, u, fi, iE, LR, j, ad, P, T, IM, aZ, gn, cl, by, kN, aZS, zE, ag, DI, fP, bk, i, I, ji, ccS); #c1(MUC6) c2(NP_005952) c3(7112) c4(33226, 46283, 59340, 20169, 72397) c5(A, b, IM, BY, U, hP, y, tp, js, eA, B, bu, ar, kN, u, aal, V, qL, gL, by, W, T, bt, et, qH, JY, ag, fP, bk, ji, bT, ccS); #c1(MUC7) c2(NP_001138479) c3(7113) c4(33227, 46284, 59341, 20170, 72398) c5(d, cy, qL, sd, DM, BY, ti, ar, i, fv, fx, e, ccS, DI); #c1(MUCLI) c2(XP_011536170) c3(7114) c4(33228, 46285, 59342, 20171, 72399) c5(jh, b, py, Be, u, y); #c1(MUM1) c2(NPJI6242) c3(7115) c4(33229, 46286, 59343, 20172, 72400) c5(pD, gm, fO, apY, II, jT); #c1(MURC) c2(NP_001018126) c3(7116) c4(33230, 46287, 59344, 20173, 72401) c5(111); #c1(MUS81) c2(XP_011543572) c3(7117) c4(33231, 46288, 59345, 20174, 72402) c5(g, tp, wo, b, f, q, ad, GB, cs, pt, fy, oM, O, aV, u, e, y, d); #c1(MOSK) c2(NP_001159752) c3(7118) c4(33232, 46289, 59346, 20175, 72403) c5(xu, cgY, xQ, hS, aOm, iB, bq, cc); #c1(MOT) c2(NP_000246) c3(7119) c4(33233, 46290, 59347, 20176, 72404) c5(aHw, b, cE, jd, A, U, aO, aiz, re, hV, cB, cha, fy, u, cgZ, iT, em, V, j, dt, P, cK, nV, chb, ni, sc, aA, at); #c1(MOTYH) c2(NP_001280119) c3(7120) c4(33234, 46291, 59348, 20177, 72405) c5(bP, A, rB, b, Yq, gG, Zf, YO, O, bf, U, hP, fD, aW, ez, d, co, aX, aMF, jd, t, f, e, q, bu, cU, ar, y, cs, fH, ava, aV, u, g, chc, si, V, I, Qz, ad, W, Ce, T, Kv, Qt, x, et, iA, by, fJ, ac, aM, bm, B, ag, i, Di); #c1(MVBI2B) c2(NP_001011703) c3(7121) c4(33235, 46292, 59349, 20178, 72406) c5(Ns, er, Nq); #c1(MVD) c2(NP_002452) c3(7122) c4(33236, 46293, 59350, 20179, 72407) c5(aw, b, X, zh, pR, bf, pz, e, y, d, zi, LI, aqn, h, hV, N, q, pn, O, n, kX, av, u, R, ae, kt, J, pF, Q, iD, jG, aM, nV, qt, bgV, agb, fg, pJ, at, pv); #c1(MVK) c2(NP_001288111) c3(7123) c4(33237, 46294, 59351, 20180, 72408) c5(bQ0, b, aPi, eH, ix, iL, U, S, chd, ni, h, nU, q, do, as, u, V, I, cV, nW, agR, dK, dt, bzl, Dn, kS, bm, aLQ, iV, Om, aT, rr); #c1(MVP) c2(NP_001280133) c3(7124) c4(33238, 46295, 59352, 20181, 72409) c5(b, k, X, jz, dB, eH, hS, w, lv, gE, y, jQ, fe, co, kJ, t, h, F, q, cU, fr, O, iv, av, fy, u, dh, o, n, g, fU, cV, ft, cs, J, fO, xs, P, T, II, Lw, ad, hw, jT, lu, oe, bm, sW, G, iT, QP, bq, at, re); #c1(MX1) c2(XP_005261039) c3(7125) c4(33239, 46296, 59353, 20182, 72410) c5(en, PJ, X, aiW, atU, aN, ul, iL, gE, al, m, h, q, bu, che, FG, alb, aq, jZ, o, ld, sQ, Dg, sy, gL, P, II, pt, bNA, lq, aV, aeq, fc, aFB, rq, j, i, fl, I, bh, at); #c1(MX2) c2(XP_011527874) c3(7126) c4(33240, 46297, 59354, 20183, 72411) c5(en, aX, do, P, gE, ji); #c1(MXD1) c2(NP_001189443) c3(7127) c4(33241, 46298, 59355, 20184, 72412) c5(A, b, k, dB, w, gE, U, al, y, co, aX, pp, h, B, q, ar, O, iv, pB, fH, av, u, tQ, n, V, cV, cs, ad, W, T, cK, by, fJ, jE, py, bm, jR, cT, gj, ci); #c1(MXD3) c2(NP_001136407) c3(7128) c4(33242, 46299, 59356, 20185, 72413) c5(g, jR, b); #c1(MXD4) c2(NP_006445) c3(7129) c4(33243, 46300, 59357, 20186, 72414) c5(g, k, jq, Nv, Fs, P, w, pB); #c1(MXII) c2(NP_001008541) c3(7130) c4(33244, 46301, 59358, 20187, 72415) c5(fr, A, aw, b, k, X, pR, xc, w, O, U, y, co, aX, fv, B, q, bu, M, aug, ik, Up, aJ, iv, ar, av, V, u, ff, g, asd, bm, cB, cV, nl, cs, bp, ft, byM, T, fy, fx, by, et, jH, Hs, pS, iR, jo, jR, cT, i); #c1(MXRA5) c2(NP_056234) c3(7131)

c4(33245, 46302, 59359, 20188, 72416) c5(co, fy, b); #c1(MYADM) c2(NP_001277119) c3(7132) c4(33246, 46303, 59360, 20189, 72417) c5(g); #c1(MYBBPIA) c2(NP_001099008) c3(7133) c4(33247, 46304, 59361, 20190, 72418) c5(A, b, B, iU, u, hd, y); #c1(MYB) c2(NP_001123644) c3(7134) c4(33248, 46305, 59362, 20191, 72419) c5(b, k, ie, jz, atK, HG, w, NH, Iv, lw, U, boB, y, chf, qf, awK, aX, t, h, f, N, M, jQ, O, iv, aD, pH, jG, jb, u, n, qw, V, ae, cV, Be, cs, J, j, ad, pz, T, bq, x, cy, jT, qe, G, fy, qt, NG, hX, pP, DO, Ck, mA, yE, fg, qO, rw, di, aA, at, ci, rb); #c1(MYBLI) c2(NP_001073885) c3(7135) c4(33249, 46306, 59363, 20192, 72420) c5(jT, kF, rb, O); #c1(MYBL2) c2(NP_001265539) c3(7136) c4(33250, 46307, 59364, 20193, 72421) c5(Jh, cB, b, cV, h, f, fO, q, atK, iT, cT, j, i, I, u, re, y, n); #c1(MYBPC1) c2(NP_001241647) c3(7137) c4(33251, 46308, 59365, 20194, 72422) c5(chh, sK, mR, chg, oD); #c1(MYBPC2) c2(NP_004524) c3(7138) c4(33252, 46309, 59366, 20195, 72423) c5(cK, mR, sK); #c1(MYBPC3) c2(NP_000247) c3(7139) c4(33253, 46310, 59367, 20196, 72424) c5(ml, rQ, xi, cO, cK, dE, chj, Im, chi, aYv, hR, mL, mR, eR, nl, hj, oD, chk, at, chi, sK); #c1(MYBPH) c2(NP_004988) c3(7140) c4(33254, 46311, 59368, 20197, 72425) c5(yK, rq, b, Dg, LR, jz, ar, ji, di, PH, Vn, jQ); #c1(MYCBP2) c2(NP_055872) c3(7141) c4(33255, 46312, 59369, 20198, 72426) c5(g, bjV, co, aw, cV, J, bp, sJ, ar, O, ey, fy, u, aA, y, cl); #c1(MYCBPAP) c2(NP_115509) c3(7142) c4(33256, 46313, 59370, 20199, 72427) c5(F, u, y, b); #c1(MYC) c2(NP_002458) c3(7143) c4(33257, 46314, 59371, 20200, 72428) c5(dx, by, ml, aw, LI, gG, iX, dB, Ip, w, cho, aoA, bf, O, Mn, azO, Up, cp, M, jt, dv, iR, aEa, t, yh, cl, fH, yG, R, g, ha, xc, og, asQ, lb, zv, kJ, du, fO, gm, bp, ft, aNS, bta, zU, od, Jj, x, fx, jT, mO, cg, rR, ata, f, sg, DO, OJ, anb, ag, cT, i, fN, jB, aA, is, Xw, aal, cY, ie, Nq, jz, chp, wy, oH, kB, VM, Dj, kY, IW, ajw, bw, VJ, y, co, pw, px, pp, yE, adr, Dq, hg, N, cs, vQ, bu, B, iv, Tk, chn, av, fy, bm, awe, iT, avB, cj, fi, apk, apu, V, afn, bav, Hq, bt, Qt, iA, fJ, JY, dt, if, chm, aoy, py, aMQ, fg, zJ, To, P, nJ, Le, fG, gO, Xk, ji, yq, iu, ci, pv, afE, b, QB, Ns, oi, vn, jD, d, jh, aiT, jd, re, hV, q, jV, es, ND, X, ar, pc, aJ, Dv, oO, n, jG, sK, u, nj, o, ff, wU, jE, il, qW, qL, dT, gL, ad, chr, Km, G, sf, Yi, buk, ct, chq, oV, gt, WZ, nV, hX, ch, yC, kM, jc, iq, aE, zZ, agf, cdY, CL, OI, I, Mp, af, C, A, aov, k, fr, pR, bo, pD, qY, EN, BY, Iv, iL, gE, jR, U, iK, jQ, MT, aX, Aa, h, F, jA, gT, cU, aC, iZ, ik, oJ, cB, DP, QJ, e, fU, cV, Be, YR, J, fE, W, jo, T, j, jl, nP, Pk, aph, aM, TY, Lc, Jh, lc, adu, XH, Lr, Yv, bh, at, oT); #c1(MYCN) c2(NP_005369) c3(7144) c4(33258, 46315, 59372, 20201, 72429) c5(jK, B, aw, jt, w, O, Hq, axd, cl, R, g, fe, asQ, aeM, aC, qY, gm, cht, QZ, fx, jT, pb, fc, ie, OJ, cT, qP, i, chv, azR, X, oa, eu, oH, U, y, co, f, bu, Nk, Tk, av, fy, bm, V, chu, bNh, JY, aJh, QG, jR, aAN, T, yq, ck, b, jq, jy, aJB, jd, re, hV, q, es, bkm, ff, as, ar, Tv, u, ad, iD, Ut, Lt, aAF, nV, A, fr, FE, ahV, C, jx, oy, aX, Qm, h, cB, aV, fU, cV, an, J, chs, nP, by, TY, qp, Tq, XH, rb); #c1(MYCT1) c2(NP_079383) c3(7145) c4(33259, 46316, 59373, 20202, 72430) c5(Ez, T, b, bu); #c1(MYD88) c2(NP_001166037) c3(7146) c4(33260, 46317, 59374, 20203, 72431) c5(dx, en, aw, Ym, Ob, dD, sE, iU, bf, dv, cy, fp, aDO, baD, gl, aC, du, gm, fO, hR, zQ, hx, aAd, cT, dh, aA, bT, id, X, ig, vp, ai, y, zZ, pw, Ov, DM, eX, cs, av, Ou, yJ, V, ae, Bs, Cq, BV, YS, bt, wA, pi, Cs, dY, zS, bTf, II, vq, bn, b, aF, aoP, fl, eE, q, dQ, u, nj, aNu, chw, aDu, Zz, kt, awD, gL, ad, Fo, jU, jH, hU, xU, ih, gd, kC, CL, In, mW, iL, gE, U, m, IE, LS, n, Dg, ev, adK, sj, P, T, bNt, aM, jT, nk, atR, Kn, at, LQ); #c1(MYDGF) c2(NP_061980) c3(7147) c4(33261, 46318, 59375, 20204, 72432) c5(dx, en, axx, b, aF, DT, aE, A, NH, dV, iL, eM, bf, OH, aW, co, aX, pp, Kp, h, f, q, dZ, ik, y, cs, aD, fP, av, aV, u, jZ, da, PJ, be, rN, il, aC, aDM, du, J, bQg, dv, II, aDe, cy, jT, pi, iU, jU, aM, jH, fy, Eu, NG, fc, aos, dS, B, gd, aDF, pH, fq, I, bh, aA, at, gf, rn, gl); #c1(MYEF2) c2(NP_001288139) c3(7148) c4(33262, 46319, 59376, 20205, 72433) c5(aoa, hg); #c1(MYEOV) c2(NP_001280220) c3(7149) c4(33263, 46320, 59377, 20206, 72434) c5(d, jh, V, b, cV, fO, ad, cT, ar, cs, U, u, e, y, JY); #c1(MYF5) c2(NP_005584) C3(7150) c4(33264, 46321, 59378, 20207, 72435) c5(bb, QG, qC, cI, cO, aA); #c1(MYFG) c2(NP_002460) c3(7151) c4(33265, 46322, 59379, 20208, 72436) c5(c, WE, bhj, XH, cl, oD, chx); #c1(MYH10) c2(NP_001242941) c3(7152) c4(33266, 46323, 59380, 20209, 72437) c5(u, h, do, xK, wd, y); #c1(MYH11) c2(NP_001035202) c3(7153) c4(33267, 46324, 59381, 20210, 72438) c5(jK, B, b, MS, A, NH, bV, bW, U, chA, y, cy, aBP, h, f, zh, jV, AK, M, gX, n, iv, jG, u, dr, V, FK, chz, J, chy, Ce, AF, W, dy, NG, pH, gR, aRK); #c1(MYH13) c2(NP_003793) c3(7154) c4(33268, 46325, 59382, 20211, 72439) c5(o); #c1(MYH14) c2(NP_001139281) c3(7155) c4(33269, 46326, 59383, 20212, 72440) c5(bL, aKm, A, b, chB, Nq, TD, Ns, mR, fD, Bx, cK, chC, jT, chD, ac, sK); #c1(MYH15) c2(NP_055796) c3(7156) c4(33270, 46327, 59384, 20213, 72441) c5(dx, fh, dv, bh, aHX, du, aHW, bq, at, ap); #c1(MYH1) c2(NP_005954) c3(7157) c4(33271, 46328, 59385, 20214, 72442) c5(Yj, gC, or, bm, gG, bu, ar, rB, ct, IN, by, u, y, V); #c1(MYH2) C2(NP_001093582) c3(7158) c4(33272, 46329, 59386, 20215, 72443) c5(EM, dE, AA, aaZ, O, BQ, aX, buE, h, f, chF, oD, Yj, yy, Yi, cK, jU, sK, aZF, chE, AB, At, cT, Au, vt, chG); #c1(MYH3) c2(XP_011522173) c3(7159) c4(33273, 46330, 59387, 20216, 72444) c5(Yj, d, ae, buE, chI, f, chH, chJ, ik, oD, e, bCa); #c1(MYH4) c2(NP_060003) c3(7160) c4(33274, 46331, 59388, 20217, 72445) c5(oy, MO); #c1(MYH6) c2(NP_002462) c3(7161) c4(33275, 46332, 59389, 20218, 72446) c5(A, b, ds, cO, Bo, cr, bHp, B, mR, oD, chK, chL, chN, cK, sK, rQ, alt, sS, ie, na, chM, at); #c1(MYH7B) c2(NP_065935) c3(7162) c4(33276, 46333, 59390, 20219, 72447) c5(aX, DO, ic, i, cK, chC, u, ac); #c1(MYH7) c2(NP_000248) c3(7163) c4(33277, 46334, 59391, 20220, 72448) c5(aNN, ml, aw, aTt, sO, dE, boE, di, boG, cO, Bo, chP, yK, yy, cr, vC, atE, bjn, chO, mL, mR, oD, hj, apz, WG, aoa, chQ, aYv, OI, bq, cK, kz, mO, sK, bgc, chB, acw, bAF, aWz, At, fz, akL, BJ); #c1(MYH8) c2(NP_002463) c3(7164) c4(33278, 46335, 59392, 20221, 72449) c5(Yj, bCa, chJ, chR, chS); #c1(MYH9) c2(NP_002464) c3(7165) c4(33279, 46336, 59393, 20222, 72450) c5(bP, dx, fl, td, b, yu, vh, Nq, aZF, chY, Pp, xK, NH, pu, bf, ajZ, vp, chD, chX, y, gO, m, fl, chW, bb, dv, wd, Wn, h, Em, bu, cia, chF, li, co, iv, aM, u, te, Ei, I, Nc, du, chV, bd, by, vG, P, bLO, vx, qt, et, aXp, pk, L, hU, chT, NG, chZ, Ck, acQ, na, Ns, amS, fD, chU, Xz, di, apU, nc); #c1(MYL12A) c2(NP_001289977) c3(7166) c4(33280, 46337, 59394, 20223, 72451) c5(cK, pR, dE, co, sK); #c1(MYL12B) c2(NP_001138416) C3(7167) c4(33281, 46338, 59395, 20224, 72452) c5(bf, cib); #c1(MYL1) c2(NP_524144) c3(7168) c4(33282, 46339, 59396, 20225, 72453) c5(cl); #c1(MYL2) c2(NP_000423) c3(7169) c4(33283, 46340, 59397, 20226, 72454) c5(ml, I, cic, f, dB, di, cK, mR, cfi, O, sK); #c1(MYL3) c2(NP_000249) c3(7170) c4(33284, 46341, 59398, 20227, 72455) c5(yK, cid, cK, mR, sK); #c1(MYL4) C2(NP_001002841) c3(7171) c4(33285, 46342, 59399, 20228, 72456) c5(ak, bwl, k, cJ, ble, mE, dt, aPu, aNU, sK); #c1(MYL6) c2(NP_066299) c3(7172) c4(33286, 46343, 59400, 20229, 72457) c5(f); #c1(MYL7) c2(NP_067046) c3(7173) c4(33287, 46344, 59401, 20230, 72458) c5(sO, cJ, f, aPu, cO, cK, at, aq, sK); #c1(MYL9) c2(NP_006088) c3(7174) c4(33288, 46345, 59402, 20231, 72459) c5(bL, f, h, dE, dB, mE, cK, sK); #c1(MYLIP) c2(NP_037394) c3(7175) c4(33289, 46346, 59403, 20232, 72460) c5(dx, ao, G, I, b, t, F, dB, q, ad, ag, cT, Iv, cs, aA, at, eG); #c1(MYLK2) c2(NP_149109) c3(7176) c4(33290, 46347, 59404, 20233, 72461) c5(Bo, yJ, cK, BK, nl); #c1(MYLK3) c2(NP_872299) c3(7177) c4(33291, 46348, 59405, 20234, 72462) c5(nl, BK); #c1(MYLK) c2(NP_444253) c3(7178) c4(33292, 46349, 59406, 20235, 72463) c5(bL, A, aw, b, aF, dD, di, cO, O, y, qs, co, cy, LN, ty, f, B, fy, u, ff, yJ, mz, nl, el, BC, cd, BZ, jo, cie, aZ, cr, gF, nk, er, aJy, mE, tA, gf, gd, fP, fl, at, BK, aG); #c1(MYLPF) c2(NP_037424) c3(7179) c4(33293, 46350, 59407, 20236, 72464) c5(at, O, cfi); #c1(MYNN) c2(NP_001172048) c3(7180) c4(33294, 46351, 59408, 20237, 72465) c5(l, iq, aV, i); #c1(MYO1O) c2(NP_036466) c3(7181) c4(33295, 46352, 59409, 20238, 72466) c5(di, u, o, y, nG); #c1(MYO15A) c2(NP_057323) c3(7182) c4(33296, 46353, 59410, 20239, 72467) c5(alH, cG, cif, aQp, bCN, bCh, Bx); #c1(MYO16) c2(NP_001185879) c3(7183) c4(33297, 46354, 59411, 20240, 72468) c5(rQ, bb, cO, bf, at, et, aW, aM); #c1(MYO18B) c2(NP_115997) c3(7184) c4(33298, 46355, 59412, 20241, 72469) c5(fU, hW, V, X, iP, bp, co, av, U, aW); #c1(MYO1A) c2(NP_005370) c3(7185) c4(33299, 46356, 59413, 20242, 72470) c5(q, bu, na, cig, Qt, oi, by, bm); #c1(MYO1B) c2(NP_036355) c3(7186) c4(33300, 46357, 59414, 20243, 72471) c5(aE, dA); #c1(MYO1C) c2(NP_001074248) c3(7187) c4(33301, 46358, 59415, 20244, 72472) c5(aw, b, X, na, i, av, fx); #c1(MYO1D) c2(NP_056009) c3(7188) c4(33302, 46359, 59416, 20245, 72473) c5(l, bw, di, cz); #c1(MYO1E) c2(NP_004989) c3(7189) c4(33303, 46360, 59417, 20246, 72474) c5(oy, cih, bd, na, wd, hc); #c1(MYO1F) c2(NP_036467) c3(7190) c4(33304, 46361, 59418, 20247, 72475) c5(na, fl, jL); #c1(MYO3A) c2(XP_011517803) c3(7191) c4(33305, 46362, 59419, 20248, 72476) c5(V, aY, aC, cii, U, ac); #c1(MYO3B) c2(NP_001077084) c3(7192) c4(33306, 46363, 59420, 20249, 72477) c5(TD); #c1(MYO5A) c2(NP_000250) c3(7193) c4(33307, 46364, 59421, 20250, 72478) c5(ceH, cij, aX, b, ac, gX, fl, ic, i, I, cik); #c1(MYO5B) c2(NP_001073936) c3(7194) c4(33308, 46365, 59422, 20251, 72479) c5(KC, dj, ak, aw, bpo, cil, ni, gz, bu, gB, xq, ow, awl, z, bf, by, bm, IT); #c1(MYO5C) c2(NP_061198) c3(7195) c4(33309, 46366, 59423, 20252, 72480) c5(IV); #c1(MYO6) c2(NP_001287828) c3(7196) c4(33310, 46367, 59424, 20253, 72481) c5(cin, A, b, ie, B, aRc, na, T, cim, Bx, di, IV, cio); #c1(MYO7A) c2(NP_000251) c3(7197) c4(33311, 46368, 59425, 20254, 72482) c5(dx, aw, ow, ic, cir, aIE, aW, aX, ciq, ml, XM, nR, nQ, cip, nW, du, Fl, Nx, cdv, TD, na, Bx); #c1(MYO7B) c2(NP_001073996) c3(7198) c4(33312, 46369, 59426, 20255, 72483) c5(bb, et); #c1(MYO9A) c2(NP_008832) c3(7199) c4(33313, 46370, 59427, 20256, 72484) c5(TD); #c1(MYO9B) c2(NP_001123537) c3(7200) c4(33314, 46371, 59428, 20257, 72485) c5(jH, cis, m, an, wG, BV, ig, lJ, fP, aE, hr, aC, aV, aq, Jl, as); #c1(MYOCD) c2(NP_001139784) c3(7201) c4(33315, 46372, 59429, 20258, 72486) c5(bL, ba, b, f, BC, AK, di, iK, Wf, iN, cK, u, aRK, y, sK); #c1(MYOC) c2(NP_000252) c3(7202) c4(33316, 46373, 59430, 20259, 72487) c5(wj, Pv, eR, Ig, JZ, xg, bj, bbO, ml, f, md, qr, dZ, bbL, ez, Bu, Ek, bbM, cit, DR, er, ciu, bbN, vL, dV); #c1(MYOD1) c2(NP_002469) c3(7203) c4(33317, 46374, 59431, 20260, 72488) c5(OG, b, Gm, X, cO, di, fH, eO, U, y, Ne, jl, re, wN, ar, xl, cB, oD, av, u, iT, cl, V, wp, jH, J, T, Vw, mF, fJ, bwZ, QG, ie, XH, aA, oB, gl); #c1(MYOF) c2(NP_038479) c3(7204) c4(33318, 46375, 59432, 20261, 72489) c5(b, xl, cK, adF, u, y); #c1(MYOG) c2(NP_002470) c3(7205) c4(33319, 46376, 59433, 20262, 72490) c5(aoa, WE, pw, cdY, xu, cV, el, At, cc, kz, XH, cl, Vw, iB, aA, Mb, QG, gl); #c1(MYOM1) c2(NP_003794) c3(7206) c4(33320, 46377, 59434, 20263, 72491) c5(aPt); #c1(MYOM2) c2(NP_003961) c3(7207) c4(33321, 46378, 59435, 20264, 72492) c5(uk, b, vd, aMr, A, ciw, Ku, iL, aW, aQr, qf, aX, px, AX, bPf, tv, gX, ky, cM, zM, bzq, u, RQ, da, Id, sQ, V, Dg, qJ, fO, civ, II, cv, bb, hR, Iq, wu, aeq, aY, rq, zZ, fl, azG, dc, y, C); #c1(MYOT) c2(NP_001129412) c3(7208) c4(33322, 46379, 59436, 20265, 72493) c5(WG, bSf, aTt, alt, bgR, nl, h, f, ciy, cc, AG, mx, akL, ac, cix, cK, oD, aWu, xl, kG); #c1(MYOZI) c2(NP_067068) c3(7209) c4(33323, 46380, 59437, 20266, 72494) c5(mR, ml, kG); #c1(MYOZ2) c2(NP_057683) c3(7210) c4(33324, 46381, 59438, 20267, 72495) c5(c, kG, ciz, AG, mR, cK, oD, fY, sK); #c1(MYOZ3) c2(XP_011536006) c3(7211) c4(33325, 46382, 59439, 20268, 72496) c5(kG); #c1(MYPN) c2(NP_001243196) c3(7212) c4(33326, 46383, 59440, 20269, 72497) c5(ciA, ml, caw, f, mR, cK, Bn, vL, sK); #c1(MYRF) c2(NP_001120864) c3(7213) c4(33327, 46384, 59441, 20270, 72498) c5(aA); #c1(MYRFL) c2(XP_011537358) c3(7214) c4(33328, 46385, 59442, 20271, 72499) c5(alF, ix, cO); #c1(MYRIP) c2(NP_001271352) c3(7215) c4(33329, 46386, 59443, 20272, 72500) c5(w, aal, ciB, aW, dA); #c1(MYT1) c2(NP_004526) c3(7216) c4(33330, 46387, 59444, 20273, 72501) c5(bmV, fc, nU, og, T, aV, u); #c1(MYTIL) c2(NP_001289981) c3(7217) c4(33331, 46388, 59445, 20274, 72502) c5(aY, Fs, by, cA, aA, bu); #c1(MYZAP) c2(NP_001018110) c3(7218) c4(33332, 46389, 59446, 20275, 72503) c5(f, A, B); #c1(MZB1) c2(NP_057543) c3(7219) c4(33333, 46390, 59447, 20276, 72504) c5(bP, f, b, Ey, A, ak, bf, co, sG, h, B, q, bu, hb, aV, bm, hW, cB, cV, fO, eX, aM, yG, Fn, Le, ih, ag, cT, iB, aA); #c1(MZFI) c2(NP_001253962) c3(7220) c4(33334, 46391, 59448, 20277, 72505) c5(re, bm, q, b, iT); #c1(N4BP1) c2(NP_694574) c3(7221) c4(33335, 46392, 59449, 20278, 72506) c5(aC, cT); #c1(N4BP2L1) c2(NP_001073159) c3(7222) c4(33336, 46393, 59450, 20279, 72507) c5(i); #c1(N4BP2L2) c2(NP_001265361) c3(7223) c4(33337, 46394, 59451, 20280, 72508) c5(iw, Pz, V, q, mk, hN); #c1(NAA10) C2(NP_001243048) c3(7224) c4(33338, 46395, 59452, 20281, 72509) c5(Dr, ciC, V, b, apG, kD, BC, cx, aqe, adM, jU, U, u, y); #c1(NAA15) c2(NP_476516) c3(7225) c4(33339, 46396, 59453, 20282, 72510) c5(Dr, wa, b, hV, pD, T); #c1(NAA16) c2(NP_001104268) c3(7226) c4(33340, 46397, 59454, 20283, 72511) c5(dM, aw, iU, bf, bIL, e, O, cy, t, blz, aC, dB, Ce, x, fx, jT, pq, oi, i, azz, fE, hS, iG, U, Oh, y, co, B, bu, awd, cs, av, fy, is, V, dP, ji, qh, apU, b, tN, au, Og, ciD, jD, d, jh, Iz, bX, hV, q, ar, bcs, u, I, dT, ad, as, G, aPe, et, nV, bkq, I, di, A, jc, hl, C, iL, m, jl, h, W, bR, P, Oi, nP, by, aM, QN, hq, amS, fP, E, Ez, eG); #c1(NAA20) c2(NP_057184) c3(7227) c4(33341, 46398, 59455, 20284, 72512) c5(f); #c1(NAA25) c2(NP_079229) c3(7228) c4(33342, 46399, 59456, 20285, 72513) c5(aw, b, aF, di, O, m, ip, uj, F, Be, amU, u, aE, o, da, ax, V, I, qL, ui, be, T, dH, ag, zO, aC, at, y); #c1(NAA30) c2(NP_001011713) c3(7229) c4(33343, 46400, 59457, 20286, 72514) c5(aW); #c1(NAA35) c2(NP_078911) c3(7230) c4(33344, 46401, 59458, 20287, 72515) c5(jh, b); #c1(NAA40) c2(NP_001287729) c3(7231) c4(33345, 46402, 59459, 20288, 72516) c5(bm, q); #c1(NAA50) c2(NP_079422) c3(7232) c4(33346, 46403, 59460, 20289, 72517) c5(AS, aDJ, aqQ, Y, aY, do, aFh, dc, yk, bhq, ov, cM); #c1(NAA60) c2(NP_001077069) c3(7233) c4(33347, 46404, 59461, 20290, 72518) c5(oy); #c1(NAAA) c2(NP_001035861) c3(7234) c4(33348, 46405, 59462, 20291, 72519) c5(A, b, qJ, arQ, Gs, o, u, y, ap); #c1(NAALAD2) c2(XP_011540854) c3(7235) c4(33349, 46406, 59463, 20292, 72520) c5(ap); #c1(NAALADLI) c2(NP_005459) c3(7236) c4(33350, 46407, 59464, 20293, 72521) c5(wh, cV); #c1(NAALADL2) c2(NP_996898) c3(7237) c4(33351, 46408, 59465, 20294, 72522) c5(aNS, Io); #c1(NAB1) c2(NP_005957) c3(7238) c4(33352, 46409, 59466, 20295, 72523) c5(oy, bib, bT); #c1(NAB2) c2(NP_005958) c3(7239) c4(33353, 46410, 59467, 20296, 72524) c5(d, A, B, blb, pD, co, bo, u, e, y); #c1(NABP1) c2(NP_001026886) c3(7240) c4(33354, 46411, 59468, 20297, 72525) c5(jh); #c1(NABP2) c2(NP_076973) c3(7241) c4(33355, 46412, 59469, 20298, 72526) c5(f, q, b, aKV); #c1(NACA) c2(NP_001106674) c3(7242) c4(33356, 46413, 59470, 20299, 72527) c5(pJ, aq, o); #c1(NACC1) c2(XP_005259778) c3(7243) c4(33357, 46414, 59471, 20300, 72528) c5(d, aw, b, cV, X, agQ, re, nJ, Ty, T, ar, aX, av, avg, e, iT); #c1(NACC2) c2(XP_011516523) c3(7244) c4(33358, 46415, 59472, 20301, 72529) c5(Eo, bb); #c1(NADSYN1) c2(NP_060631) c3(7245) c4(33359, 46416, 59473, 20302, 72530) c5(bb, V, aC, U, at, et, aE, ap); #c1(NAE1) c2(NP_001018169) c3(7246) c4(33360, 46417, 59474, 20303, 72531) c5(V, b, py, bu, W, Zd, ar, x, U, by, aq); #c1(NAF1) c2(NP_001122403) c3(7247) c4(33361, 46418, 59475, 20304, 72532) c5(aC, ss, aWM, z); #c1(NAGA) c2(XP_005261673) c3(7248) c4(33362, 46419, 59476, 20305, 72533) c5(en, bK, ayi, dt, iC, ciE, cK, ciF, ciG); #c1(NAGK) c2(NP_060037) c3(7249) c4(33363, 46420, 59477, 20306, 72534) c5(A); #c1(NAGLO) c2(NP_000254) c3(7250) c4(33364, 46421, 59478, 20307, 72535) c5(jR, nU, IU, cV, p, aCb, jt, LG, tR, es, Lm, A, arQ, II, awl, n, wX, aT, aAr, Yp, kA); #c1(NAGPA) c2(NP_057340) c3(7251) c4(33365, 46422, 59479, 20308, 72536) c5(aQX); #c1(NAGS) c2(NP_694551) c3(7252) c4(33366, 46423, 59480, 20309, 72537) c5(aiz, ciH); #c1(NAIP) c2(NP_004527) c3(7253) c4(33367, 46424, 59481, 20310, 72538) c5(apR, ao, A, iC, b, u, asf, B, J, apA, w, kz, ar, cc, rQ, aV, pi, dh, n); #c1(NALCN) c2(XP_011519369) c3(7254) c4(33368, 46425, 59482, 20311, 72539) c5(hW, ak, cil, cO); #c1(NAMPT) c2(XP_005250157) c3(7255) c4(33369, 46426, 59483, 20312, 72540) c5(dx, bL, eX, b, aF, eH, w, fw, O, bf, ey, y, bQ, ag, h, f, M, fv, aO, Km, fP, aM, u, dh, Fg, jH, mz, be, I, dA, aC, du, J, gL, vF, dv, fO, fQ, fx, et, aA, jU, Ha, rd, fy, ch, mA, xU, gd, fl, i, fN, gj, bh, ael, at, gf, gl); #c1(NANOG) c2(NP_001284627) c3(7256) c4(33370, 46427, 59484, 20313, 72541) c5(A, jE, b, k, X, Lv, wy, BY, w, aAM, Lr, U, e, y, oy, re, B, q, gT, Dd, O, cs, HE, av, ZU, u, iT, d, V, J, ad, hl, T, x, jT, aol, fp, wV, ck, bm, wP, Lo, sf, od); #c1(NANOS1) c2(NP_955631) c3(7257) c4(33371, 46428, 59485, 20314, 72542) c5(bP, ux, dB, bzu, qa, di, cO, O, xw, e, y, d, vr, gZ, aX, fy, jd, f, gU, cy, cM, aV, u, fY, ff, hW, dc, KK, ciJ, JJ, bb, bjQ, lb, rQ, qt, dP, aqw, aY, zo, ag, bk, fD, HV, jl); #c1(NANOS2) C2(NP_001025032) c3(7258) c4(33372, 46429, 59486, 20315, 72543) c5(dx, da, A, aw, am, aF, ciK, gE, eW, jc, og, z, ct, al, aK, U, y, ez, m, b, co, bb, aAo, f, q, eV, xg, B, pN, cs, auy, u, aE, o, is, sz, be, V, ae, afx, aC, bK, du, ao, j, ad, IR, IX, im, dv, II, cy, fx, pq, aml, bm, zX, cT, lS, bk, i, VT, vL); #c1(NANOS3) c2(NP_001092092) c3(7259) c4(33373, 46430, 59487, 20316, 72544) c5(bP, bL, ak, dN, Zx, sE, dj, jd, eH, dv, id, di, dx, cO, wf, agc, jw, gZ, A, fx, aO, ez, vW, qs, rF, bb, am, gd, sG, ayB, wp, f, IW, mR, tE, et, u, aE, adL, bQ, du, tP, I, aC, xf, dc, v, cM, IR, IX, cA, aip, aR, eX, bq, cy, sf, Ap, axk, py, bPT, j, qt, dS, aY, er, G, B, vH, na, og, vf, IS, pZ, i, t, asT, T, aA, at, fD, y, ap); #c1(NANS) c2(NP_061819) c3(7260) c4(33374, 46431, 59488, 20317, 72545) c5(e, b, fr, hS, QR, w, bo, nT, yw, cM, jx, d, tp, QV, h, F, bu, ciL, dQ, AS, cV, by, P, ft, aY, dc); #c1(NAPIL1) c2(NP_004528) c3(7261) c4(33375, 46432, 59489, 20318, 72546) c5(g, da, n, A, aw, b, cV, uj, aF, ui, f, aTs, B, Fo, w, amU, i, U, u, fx, y); #c1(NAPIL3) c2(NP_004529) c3(7262) c4(33376, 46433, 59490, 20319, 72547) c5(A, 8); #c1(NAPIL4) c2(NP_005960) c3(7263) c4(33377, 46434, 59491, 20320, 72548) c5(fe, f, aw); #c1 (NAPIL5) c2(NP_715638) c3(7264) c4(33378, 46435, 59492, 20321, 72549) c5(aA); #c1(NAPA) c2(NP_003818) c3(7265) c4(33379, 46436, 59493, 20322, 72550) c5(f, vt, GN); #c1(NAPEPLD) c2(XP_006725119) c3(7266) c4(33380, 46437, 59494, 20323, 72551) c5(ig, aW); #c1 (NAPG) c2(NP_003817) c3(7267) c4(33381, 46438, 59495, 20324, 72552) c5(vY, ak, ciM); #c1(NAPRT) c2(NP_001273758) c3(7268) c4(33382, 46439, 59496, 20325, 72553) c5(w, b); #c1(NAPSA) c2(XP_011525842) c3(7269) c4(33383, 46440, 59497, 20326, 72554) c5(aw, b, k, X, aF, w, IO, e, d, co, uj, f, ar, amU, fv, av, o, da, ui, Wj, T, ji); #c1(NARFL) c2(NP_001291728) c3(7270) c4(33384, 46441, 59498, 20327, 72555) c5(vu, bb); #c1(NARR) c2(NP_001243210) c3(7271) c4(33385, 46442, 59499, 20328, 72556) c5(u, y); #c1(NARS) c2(NP_004530) c3(7272) c4(33386, 46443, 59500, 20329, 72557) c5(U, V); #c1(NATIO) c2(XP_011518499) c3(7273) c4(33387, 46444, 59501, 20330, 72558) c5(TV, bm, fr, TU, ft, ba, Io, ZG, f0, q, TX, P, od, cs, aC, r0, TW, ad, wy, bT, Z0); #c1(NATI4) c2(NP_065111) c3(7274) c4(33388, 46445, 59502, 20331, 72559) c5(RF); #c1(NATI) c2(NP_001153646) c3(7275) c4(33389, 46446, 59503, 20332, 72560) c5(gG, azz, IJ, A, vg, b, ag, Ns, iP, jH, mk, SB, e, tG, gE, bw, U, nS, BQ, y, d, m, Oh, cy, Os, ip, iR, h, B, F, q, jV, bu, dP, ar, gP, cs, OA, bIz, jZ, o, awd, Yj, fx, bm, V, cV, aSw, f0, pk, gL, cx, W, vc, co, bp, ny, ad, x, jI, J, gY, ac, aCC, GB, aBe, nk, BX, bkq, u, hg, Ng, Bg, by, eB, cT, amS, iL, i, da, apU, fW); #c1(NAT2) c2(XP_011542660) c3(7276) c4(33390, 46447, 59504, 20333, 72561) c5(dx, IJ, dM, aw, dD, gG, iU, eC, SB, bf, bIL, e, O, gM, h0, cy, t, gP, jM, bIz, g, jH, aC, sH, du, bp, gY, GK, vc, Ce, x, fx, jT, OA, pq, asq, cT, oi, i, Dr, azz, Og, X, fE, iP, mk, ix, GM, iG, bw, vl, Oh, y, tp, co, ip, B, vQ, bu, awd, cs, av, fy, bm, is, V, aub, v, cx, ny, cK, GB, eF, bkq, ji, qh, apU, re, b, Gd, atU, tN, au, tG, z, nS, ciD, BQ, d, jh, Xy, Iz, jd, bX, hV, q, jD, ar, ff, bcs, u, aE, o, aNN, I, aSw, dT, gL, ad, da, as, G, aPe, rB, et, iw, nV, dP, hS, iR, Bg, na, Ns, I, di, Yj, A, iL, k, jc, hi, C, vg, jw, bj, U, aW, m, Ez, jI, ciN, fg, h, M, ik, ID, jZ, ci0, dB, J, W, bR, P, ti, T, fO, Oi, nP, by, aM, aCC, aBe, eN, QN, hg, Ng, amS, fP, E, gj, bh, at, eG); #c1(NAT6) c2(NP_001186947) c3(7277) c4(33391, 46448, 59505, 20334, 72562) c5(jM); #c1(NAT8B) c2(NP_057431) c3(7278) c4(33392, 46449, 59506, 20335, 72563) c5(gK, A, dP, b, jH, B, ad, fx, o, i, cs, U, u, dh, y, V); #c1(NAT8) c2(NP_003951) c3(7279) c4(33393, 46450, 59507, 20336, 72564) c5(B, b, vh, iC, A, di, C, z, bf, U, fD, y, gO, d, jh, co, bb, Iz, hV, F, q, e, M, aC, ik, awd, bcs, u, n, da, aO, V, il, m, an, J, by, as, dy, fx, et, nV, er, Nq, fP, i, Ez); #c1(NAT8L) c2(NP_848652) c3(7280) c4(33394, 46451, 59508, 20337, 72565) c5(ciP); #c1(NAVI) c2(NP_001161210) c3(7281) c4(33395, 46452, 59509, 20338, 72566) c5(oy, u, y); #c1(NAV2) c2(NP_001104488) c3(7282) c4(33396, 46453, 59510, 20339, 72567) c5(U, cV, ad); #c1(NAV3) c2(NP_001019554) c3(7283) c4(33397, 46454, 59511, 20340, 72568) c5(fG, cy, V, b, cV, yh, dB, W, ag, w, T, Wf, bq, U, o); #c1(NBAS) c2(NP_056993) c3(7284) c4(33398, 46455, 59512, 20341, 72569) c5(jR, awl, IU, cV, p, jt, n, tR, es, Lm, dZ, bu, dV, bYD, wX, GF, ciQ, aAr, Yp, awS); #c1(NBEA) c2(NP_001191126) c3(7285) c4(33399, 46456, 59513, 20342, 72570) c5(rQ, bb, b, fO, cz, aA); #c1(NBEAL1) c2(NP_001107604) c3(7286) c4(33400, 46457, 59514, 20343, 72571) c5(0); #c1 (NBEAL2) c2(NP_055990) c3(7287) c4(33401, 46458, 59515, 20344, 72572) c5(V, b, xK, U, eN, pz); #c1(NBN) c2(NP_002476) c3(7288) c4(33402, 46459, 59516, 20345, 72573) c5(B, aw, dB, w, e, O, t, Dc, fH, g, aij, aBE, tz, iU, QZ, fx, jT, cq, BX, qN, ie, cT, bk, i, pt, aA, GD, X, fE, adB, bw, U, y, co, f, bu, iv, av, fy, iT, QD, V, aub, Qz, jC, fJ, DO, GB, jR, tI, bp, b, d, Ag, jd, nU, ar, u, qy, kF, bc, dT, CM, G, WZ, nV, I, CD, A, k, aKd, aBV, eM, jw, Bz, bRB, m, aX, bj, h, F, M, Ib, rR, aV, qO, J, dt, P, T, II, jI, wU, avx); #c1(NBPF3) c2(XP_011540583) c3(7289) c4(33403, 46460, 59517, 20346, 72574) c5(z); #c1(NBRI) c2(NP_001278500) c3(7290) c4(33404, 46461, 59518, 20347, 72575) c5(Dr, An, aw, b, X, QB, iP, dB, kB, hC, iG, bf, avA, y, d, cy, Bc, e, cU, ar, av, u, avC, Ce, T, bjg, iA, apG, pb, ag, avx, ji, eG, avz); #c1(NCALD) C2(XP_011515637) c3(7291) c4(33405, 46462, 59519, 20348, 72576) c5(vD, I); #c1(NCAMI) c2(NP_000606) c3(7292) c4(33406, 46463, 59520, 20349, 72577) c5(ml, jt, ns, sJ, nm, nt, nq, nr, cO, no, np, e, O, uS, t, alz, ajK, mR, cl, IV, cq, g, fe, aC, nl, cs, fO, Ej, bp, Jj, jT, aEY, pq, f, sS, ie, sN, ag, w, hM, Dr, nn, jz, eu, ajw, hW, O, zZ, co, px, DG, yE, ak, vQ, gX, ky, bZW, iv, oD, FG, fy, fY, yJ, iF, FK, hf, Cq, Xr, MW, bq, cK, anf, jR, VE, ji, TA, gz, b, GL, anb, eY, ic, jy, zL, d, aBP, hV, q, jV, es, ciR, ar, Gj, bGE, u, dh, o, oa, aKN, aiU, ad, G, sf, HE, jG, aAF, nV, pS, hX, tW, Bg, ih, CL, C, aov, gE, og, Iv, bw, aI, aW, jQ, m, IE, aX, Tq, h, F, M, n, cB, aV, aq, Ac, dj, fU, kG, cV, mc, J, gm, W, P, T, II, jI, cz, sK, qp, alt, Tv, hq, XH, rb, iB, at, eG, alw); #c1(NCAM2) c2(NP_004531) c3(7293) c4(33407, 46464, 59521, 20350, 72578) c5(ao, b, aW, aq, o, aA, u, y); #c1(NCAN) c2(NP_004377) c3(7294) c4(33408, 46465, 59522, 20351, 72579) c5(fN, ak, dL); #c1(NCAPD2) c2(NP_055680) c3(7295) c4(33409, 46466, 59523, 20352, 72580) c5(u, o); #c1(NCAPD3) c2(NP_056076) c3(7296) c4(33410, 46467, 59524, 20353, 72581) c5(A, B); #c1 (NCAPG2) c2(NP_001268861) c3(7297) c4(33411, 46468, 59525, 20354, 72582) c5(bDM, iU, bci, P, bNx, ciS, aFc); #c1(NCAPG) c2(NP_071741) c3(7298) c4(33412, 46469, 59526, 20355, 72583) c5(fl, aX, b, dD, ar, u, y); #c1 (NCBP2) c2(NP_001036005) c3(7299) c4(33413, 46470, 59527, 20356, 72584) c5(u, y); #c1(NCEHI) c2(NP_001139748) c3(7300) c4(33414, 46471, 59528, 20357, 72585) c5(dx, dv, du, bb); #c1(NCFI) c2(NP_000256) c3(7301) c4(33415, 46472, 59529, 20358, 72586) c5(fn, asK, A, zr, b, aF, dD, sE, eu, vB, di, sF, cO, bf, baQ, JK, bb, pp, AX, f, N, eV, CK, B, fP, aV, o, ae, aC, be, cd, akT, ciT, alM, bt, jT, jU, aM, jH, qt, ch, fw, xU, fg, fD, aA, fj, rr, ap); #c1(NCF2) c2(NP_001177718) c3(7302) c4(33416, 46473, 59530, 20359, 72587) c5(dx, fn, asK, fl, aw, rB, pR, w, di, ciV, O, m, dv, cy, DM, CK, u, g, RG, aC, du, P, bt, jl, cW, ch, DI, fP, i, I, ciU, aA, at, rr); #c1(NCF4) c2(NP_000622) c3(7303) c4(33417, 46474, 59531, 20360, 72588) c5(g, fn, ciW, jl, V, jH, aC, fq, P, fP, rB, U, hR, u, yd); #c1(NCKI) c2(NP_001177725) c3(7304) c4(33418, 46475, 59532, 20361, 72589) c5(td, b, cY, f, q, bd, sU, BW, ey, et, aA); #c1(NCK2) c2(NP_001004722) c3(7305) c4(33419, 46476, 59533, 20362, 72590) c5(er, td, b, cY, f, bd, dZ, dV, Ig, aX, sU); #c1(NCKAPI) c2(NP_038464) c3(73D6) c4(33420, 46477, 59534, 20363, 72591) c5(da, aw, uj, aF, ui, amU, o); #c1(NCKAPIL) c2(NP_001171905) c3(7307) c4(33421, 46478, 59535, 20364, 72592) c5(cT, fl); #c1 (NCKAP5) c2(NP_997046) c3(7308) c4(33422, 46479, 59536, 20365, 72593) c5(oy, aV, hW, ak, gr, di, gZ); #c1(NCKIPSD) c2(NP_057537) c3(7309) c4(33423, 46480, 59537, 20366, 72594) c5(gw, jz, eu, NA, C, rH, jQ, BO, aX, f, qj, HE, fe, fs, aC, J, P, Ny, byr, Nv, rJ, Nu); #c1(NCL) c2(NP_005372) c3(7310) c4(33424, 46481, 59538, 20367, 72595) c5(by, nU, b, k, jq, pR, dB, mW, w, O, re, e, y, d, m, co, aX, aPZ, aPX, AX, f, q, bu, Be, dQ, rR, bK, as, ar, fy, u, gl, adE, sp, og, an, Bs, cs, gm, v, dU, P, T, aPe, bt, aQa, J, aPY, at, nJ, cT, iT, fl, apU, DM); #c1(NCOA1) c2(XP_005264682) c3(7311) c4(33425, 46482, 59539, 20368, 72596) c5(A, aw, b, k, hM, e, y, d, aX, B, q, cl, av, bm, T, aeC, u, QG, cT, Af, aA, eG); #c1(NCOA2) c2(XP_005251188) c3(7312) c4(33426, 46483, 59540, 20369, 72597) c5(aEX, A, aw, b, apH, ia, kB, vY, hM, Bz, oU, y, QG, h, B, q, cU, cl, iv, fy, u, J, T, iA, bwZ, hx, hq, gA, XH, PS, hd); #c1(NCOA3) c2(NP_001167559) c3(7313) c4(33427, 46484, 59541, 20370, 72598) c5(by, A, aw, b, k, X, bGs, sJ, bn, hM, bw, U, fx, y, jx, d, co, Ml, fv, t, f, e, q, bu, cU, fr, ar, B, cs, PT, av, fy, u, V, Be, J, ad, W, T, eX, aX, iA, ft, dL, jG, pb, fN, DO, nJ, ag, i, I, ji, aA, jl, Mg); #c1(NCOA4) c2(NP_001138732) c3(7314) c4(33428, 46485, 59542, 20371, 72599) c5(Dr, ml, iq, b, X, xO, Bi, hV, BY, ciX, qL, auH, FN, nV, T, B, A, og, av, u, y); #c1(NCOA5) c2(NP_066018) c3(7315) c4(33429, 46486, 59543, 20372, 72600) c5(ir, be, xU, zM, aC, fM); #c1(NCOA6) c2(NP_001229468) c3(7316) c4(33430, 46487, 59544, 20373, 72601) c5(A, b, k, dB, fU, bf, y, aX, f, q, Ex, nU, bm, o, fe, hW, I, u, gv, P, ciY, afO, bh, eG, kK); #c1(NCOA7) c2(NP_001116314) c3(7317) c4(33431, 46488, 59545, 20374, 72602) c5(cV, u, y, cO); #c1(NCORI) c2(NP_001177367) c3(7318) c4(33432, 46489, 59546, 20375, 72603) c5(A, b, w, hM, O, Bz, aeC, y, bQ, f, jV, Be, B, iv, pB, av, u, oJ, kF, V, lb, J, vF, G, fx, agh, wh, iR, aTZ, i, eG); #c1(NCOR2) c2(NP_001070729) c3(7319) c4(33433, 46490, 59547, 20376, 72604) c5(A, b, rd, hM, pz, y, bb, ak, jV, bu, B, cs, u, Qx, oJ, cV, lb, Dw, gm, fO, ad, P, cy, by, cq, wh, Dz, aA); #c1(NCRI) c2(NP_001138929) c3(7320) c4(33434, 46491, 59548, 20377, 72605) c5(fl, en, aX, k, fc, Kp, h, f, F, J, fO, aE, P, w, gE, vl, aV, jG, O, Ac); #c1(NCR2) c2(NP_001186438) c3(7321) c4(33435, 46492, 59549, 20378, 72606) c5(azt, m, en, aX, h, nl, J, fO, T, bb, vl, at, o); #c1(NCR3) c2(NP_001138938) c3(7322) c4(33436, 46493, 59550, 20379, 72607) c5(P, m, ae, b, h, ciZ, J, jG, HJ, zZ, vS, w, ix, fO, aE, aA, jT, eV, fM); #c1(NCR3LG1) c2(NP_001189368) c3(7323) c4(33437, 46494, 59551, 20380, 72608) c5(aF, jT, aX, b); #c1(NCSI) c2(NP_001122298) c3(7324) c4(33438, 46495, 59552, 20381, 72609) c5(aOb, cV, nz, ak, cz, cO); #c1(NCSTN) c2(NP_001277113) c3(7325) c4(33439, 46496, 59553, 20382, 72610) c5(bbE, gk, b, cV, aN, aaS, o, cja, u, y); #c1(NDC80) c2(NP_006092) c3(7326) c4(33440, 46497, 59554, 20383, 72611) c5(An, b, ck, af, bu, cU, Bc, P, co, fl, fy, fl, oi, et, av, by, u, iA, y, apG); #c1(NDEI) c2(NP_060138) c3(7327) c4(33441, 46498, 59555, 20384, 72612) c5(V, FR, bK, he, cjd, cjb, FT, cjb, QZ, U, hw, av); #c1(NDELI) c2(NP_001020750) c3(7328) c4(33442, 46499, 59556, 20385, 72613) c5(pk, ax, cV, be, cz, Q, bJO, dH); #c1(NDFIPI) c2(NP_085048) c3(7329) c4(33443, 46500, 59557, 20386, 72614) c5(ck, cy, aV, bb); #c1(NDFIP2) c2(NP_061953) c3(7330) c4(33444, 46501, 59558, 20387, 72615) c5(bw, Ns, I); #c1(NDNF) c2(NP_078850) c3(7331) c4(33445, 46502, 59559, 20388, 72616) c5(bL, eG, dh); #c1(NDN) c2(NP_002478) c3(7332) c4(33446, 46503, 59560, 20389, 72617) c5(b, X, yD, w, y, oy, Ag, S, f, av, u, Qx, hW, cV, j, cz, UT, aX, fp, iR, hT, TD, agw, rv, T, aA); #c1(NDP) c2(NP_000257) c3(7333) c4(33447, 46504, 59561, 20390, 72618) c5(wa, o, dl, CA, ml, ajG, q, byn, cje, u, y); #c1(NDRG1) c2(NP_001128714) c3(7334) c4(33448, 46505, 59562, 20391, 72619) c5(mZ, by, A, aw, b, cG, X, dB, w, O, hw, U, oE, BQ, y, yK, RX, co, aX, Qm, h, f, e, q, jV, bu, cU, ZB, ar, B, cs, av, aV, u, ahe, iT, ff, g, d, fU, V, il, qZ, bp, ad, W, jo, T, cV, x, iA, k, ac, fy, cjf, bm, kJ, jh, nJ, ag, i, re, RB); #c1(NDRG2) c2(NP_001269140) c3(7335) c4(33449, 46506, 59563, 20392, 72620) c5(f, aw, b, fi, pR, jz, dB, aN, w, vZ, O, hw, U, A, y, jQ, oy, jh, jd, re, hV, q, bu, k, B, cs, u, o, hh, Bd, V, ad, W, jo, T, x, fx, by, jE, nV, bm, mb, ag, qP, iT, i); #c1(NDRG3) c2(NP_071922) c3(7336) c4(33450, 46507, 59564, 20393, 72621) c5(A, 8, b); #c1(NDRG4) c2(NP_001123959) c3(7337) c4(33451, 46508, 59565, 20394, 72622) c5(U, f, V, fw); #c1(NDST1) c2(XP_005268491) c3(7338) c4(33452, 46509, 59566, 20395, 72623) c5(bmx, bb, b, u, AP, nU, K, vJ, Xt, at, et); #c1(NDST2) c2(XP_005270312) c3(7339) c4(33453, 46510, 59567, 20396, 72624) c5(U, V); #c1(NDST3) c2(NP_004775) c3(7340) c4(33454, 46511, 59568, 20397, 72625) c5(l, aC, ak, di, at, aE); #c1(NDST4) c2(NP_072091) c3(7341) c4(33455, 46512, 59569, 20398, 72626) c5(U, at, V, b, Wh); #c1(NDUFA10) c2(NP_004535) c3(7342) c4(33456, 46513, 59570, 20399, 72627) c5(bxp, ake, A, bF); #c1(NDOFA11) c2(NP_001180304) c3(7343) c4(33457, 46514, 59571, 20400, 72628) c5(bxo, bF); #c1(NDUFA12) c2(NP_001245267) c3(7344) c4(33458, 46515, 59572, 20401, 72629) c5(bxp, ake, bF); #c1(NDUFAI3) c2(NP_057049) c3(7345) c4(33459, 46516, 59573, 20402, 72630) c5(Dr, A, cjg, dB, w, O, b, B, q, bu, ff, u, iT, fh, by, P, T, x, nV, jo, ji, y); #c1(NDOFA1) c2(NP_004532) c3(7346) c4(33460, 46517, 59574, 20403, 72631) c5(aNN, ake, cjh, aeM, kW, awV, bj, v, bBD, pQ, bxo, fC, tl, yH, bF, vL); #c1(NDOFA2) c2(NP_001171941) c3(7347) c4(33461, 46518, 59575, 20404, 72632) c5(dx, ake, B, aw, Ob, bx, iU, eH, sJ, w, fR, OH, uA, dv, cy, aDw, gB, aFA, ul, Pv, aFn, Kd, gl, TP, mz, JP, fe, aC, du, gm, fO, dB, JQ, Q, fx, JN, oh, FG, dH, aDb, dS, fc, aFB, hx, sN, ag, cT, pv, bk, i, bq, aA, aEN, id, Kt, iP, aFu, eu, ig, JE, U, ex, y, rN, DG, yE, bxp, Dq, f, bu, aFv, JX, iJ, akk, fy, Gr, V, ae, nl, WL, gv, aFs, aFo, bt, bd, pi, be, dO, dP, QE, dY, Im, iu, fW, TA, ap, fn, WH, bn, b, zH, aF, eR, DJ, aDA, fl, yU, z, eV, yK, bb, Iz, zJ, bX, q, jV, CO, aFr, dQ, ge, jG, u, aE, sz, I, qL, j, by, aD, aFz, Io, aFC, jH, ao, aFw, xU, gd, kC, aFk, Bm, aFp, fl, xa, bL, A, iL, kb, JI, Lu, aFg, fw, JC, gE, zK, al, aFX, hP, vl, m, jl, kn, wG, h, Vr, n, aV, jZ, aAq, ax, sj, sB, J, asM, W, bR, P, ti, II, aFt, pc, jT, zE, Ic, eX, fP, aBz, fq, bh, at, LQ); #c1(NDOFA5) c2(NP_001269349) c3(7348) c4(33462, 46519, 59576, 20405, 72633) c5(cK, A, Fl, SS, cz); #c1(NDOFA6) c2(NP_002481) c3(7349) c4(33463, 46520, 59577, 20406, 72634) c5(P, BX, ny, ip); #c1(NDOFA9) c2(NP_004993) c3(7350) c4(33464, 46521, 59578, 20407, 72635) c5(bxp, A); #c1(NDOFABI) c2(NP_004994) c3(7351) c4(33465, 46522, 59579, 20408, 72636) c5(iF, aC, aUW, aKD, ak, Ge, di, bf, at, zD); #c1(NDOFAFI) c2(NP_057097) c3(7352) c4(33466, 46523, 59580, 20409, 72637) c5(bxo, cK, bF, kW, sK); #c1(NDOFAF2) c2(NP_777549) c3(7353) c4(33467, 46524, 59581, 20410, 72638) c5(d, ake, hT, 35 kW, jh, bxp, bws, f, bxn, A, mg, bF, e); #c1(NDOFAF3) c2(NP_951032) c3(7354) c4(33468, 46525, 59582, 20411, 72639) c5(bxo, bF, y, kW, u); #c1(NDOFAF4) c2(NP_054884) c3(7355) c4(33469, 46526, 59583, 20412, 72640) c5(kW, u, pQ, bxo, jT, bF, y); #c1(NDOFAF5) c2(NP_001034464) c3(7356) c4(33470, 46527, 59584, 20413, 72641) c5(ake, bxo, kW); #c1(NDOFAF6) c2(NP_689629) c3(7357) c4(33471, 46528, 59585, 20414, 72642) c5(bxp, bxo, bF, ake); #c1(NDUFBI0) c2(NP_004539) c3(7358) c4(33472, 46529, 59586, 20415, 72643) c5(c0); #c1(NDOFBI1) c2(NP_001129470) c3(7359) c4(33473, 46530, 59587, 20416, 72644) c5(pQ); #c1(NDUFB2) c2(NP_004537) c3(7360) c4(33474, 46531, 59588, 20417, 72645) c5(ma, B, q, vQ, Kg, A, iu, dh); #c1(NDUFB3) c2(NP_001244031) c3(7361) c4(33475, 46532, 59589, 20418, 72646) c5(bxo, mS, u, y); #c1(NDUFB4) C2(NP_001161803) c3(7362) c4(33476, 46533, 59590, 20419, 72647) c5(bk); #c1 (NDUFB5) c2(NP_001186886) c3(7363) c4(33477, 46534, 59591, 20420, 72648) c5(A); #c1(NDUFB6) c2(NP_002484) c3(7364) c4(33478, 46535, 59592, 20421, 72649) c5(bb, A, bF, B, I); #c1(NDUFB8) c2(NP_001271296) c3(7365) c4(33479, 46536, 59593, 20422, 72650) c5(mk, A, Pz); #c1(NDUFB9) c2(NP_004996) c3(7366) c4(33480, 46537, 59594, 20423, 72651) c5(bxo, A, bF); #c1(NDUFC2) c2(NP_001190983) c3(7367) c4(33481, 46538, 59595, 20424, 72652) c5(co, A); #c1(NDUFS1) c2(NP_001186910) c3(7368) c4(33482, 46539, 59596, 20425, 72653) c5(ake, A, f, cji, aby, bu, bxo, rQ, cz, bF, aXf, sK); #c1(NDUFS2) c2(NP_001159631) c3(7369) c4(33483, 46540, 59597, 20426, 72654) c5(ake, A, b, jd, kt, dY, pQ, bxo, ch, cK, aV, bF); #c1(NDUFS3) c2(NP_004542) c3(7370) c4(33484, 46541, 59598, 20427, 72655) c5(ake, u, bxp, ch, aq, tF, awS, cK, fy, bF, ff); #c1(NDUFS4) c2(NP_002486) c3(7371) c4(33485, 46542, 59599, 20428, 72656) c5(ake, aDI, A, V, m, bxp, bK, bj, hT, cU, bxo, cjj, pQ, fD, aC, U, bF, iA, aW); #c1(NDUFS6) c2(NP_004544) c3(7372) c4(33486, 46543, 59600, 20429, 72657) c5(bxo, re, A, bF, iT); #c1(NDUFS7) c2(NP_077718) c3(7373) c4(33487, 46544, 59601, 20430, 72658) c5(ake, bb, bxp, bxo, bf, aX, bF, aM); #c1(NDUFS8) c2(NP_002487) c3(7374) c4(33488, 46545, 59602, 20431, 72659) c5(bxp, bxo, bF, ake); #c1(NDOFV1) c2(NP_001159574) c3(7375) c4(33489, 46546, 59603, 20432, 72660) c5(ake, asN, kW, cJ, EW, bu, bxo, bK, bF); #c1(NDUFV2) c2(NP_066552) c3(7376) c4(33490, 46547, 59604, 20433, 72661) c5(ake, oC, ak, bj, hT, pQ, bxo, A, GR, cK, bF, sK); #c1(NDUFV3) C2(NP_001001503) c3(7377) c4(33491, 46548, 59605, 20434, 72662) c5(A, aq); #c1(NEB) c2(NP_001157979) c3(7378) c4(33492, 46549, 59606, 20435, 72663) c5(WG, AA, c, nl, Ik, At, AC, cc, cK, Aw, oD, xl); #c1(NEBL) c2(NP_006384) c3(7379) c4(33493, 46550, 59607, 20436, 72664) c5(sK, mR, BJ, acN); #c1(NECAB1) c2(NP_071746) c3(7380) c4(33494, 46551, 59608, 20437, 72665) c5(v); #c1(NECAB3) c2(NP_12508) c3(7381) c4(33495, 46552, 59609, 20438, 72666) c5(u, y); #c1(NECAP1) c2(NP_056324) c3(7382) c4(33496, 46553, 59610, 20439, 72667) c5(IC); #c1 (NEDD1) c2(NP_001128648) c3(7383) c4(33497, 46554, 59611, 20440, 72668) c5(qf, by, bu); #c1(NEDD4) c2(NP_001271267) c3(7384) c4(33498, 46555, 59612, 20441, 72669) c5(B, b, cG, A, ak, iL, cO, U, O, co, bZF, f, bu, cc, fy, u, V, v, P, cT, at, y); #c1(NEDD4L) c2(NP_001138439) c3(7385) c4(33499, 46556, 59613, 20442, 72670) c5(qs, A, bb, yQ, b, nF, cjl, B, MV, fG, hS, di, hY, nB, cy, aA, cjk, eG, ap); #c1(NEDD8) c2(NP_006147) c3(7386) c4(33500, 46557, 59614, 20443, 72671) c5(d, da, b, X, u, h, f, fO, aof, P, Hh, av, GW, e, y); #c1(NEDD9) c2(NP_001135865) c3(7387) c4(33501, 46558, 59615, 20444, 72672) c5(aw, b, X, apC, dB, BY, w, kY, U, bj, e, y, d, co, aX, kJ, t, h, F, q, bu, M, aoe, O, cB, cs, fM, av, fy, u, o, V, cV, aC, be, J, bp, ad, W, P, T, jl, by, aec, jH, jT, alt, ie, G, nJ, ag, bq, re, IA); #c1(NEFH) c2(NP_066554) c3(7388) c4(33502, 46559, 59616, 20445, 72673) c5(jh, ao, qs, bS, b, adf, X, ch, EM, f, PY, aQF, v, di, ac, bK, av, MO, ag, OA, o); #c1(NEFM) c2(NP_001099011) c3(7389) c4(33503, 46560, 59617, 20446, 72674) c5(ao, bS, aQF, ch, bj, Lf, Lq, alX, eG, OA); #c1(NEIL1) c2(NP_001243481) c3(7390) c4(33504, 46561, 59618, 20447, 72675) c5(f, b, gG, dB, eH, z, e, d, tp, gC, eX, F, bu, ff, fy, u, mz, by, P, oM, ct, gF, aoO, aV, fN, IN, pt, aA); #c1(NEIL2) c2(NP_001129219) c3(7391) c4(33505, 46562, 59619, 20448, 72676) c5(ao0, tp, co, aw, BX, b, X, e, d, ip, GQ, ny, et, av, aV, u, U, y, V); #c1(NEIL3) c2(NP_060718) c3(7392) c4(33506, 46563, 59620, 20449, 72677) c5(ct, fl, ac); #c1(NEKI0) c2(NP_001026911) c3(7393) c4(33507, 46564, 59621, 20450, 72678) c5(u); #c1(NEKI1) c2(NP_001139475) c3(7394) c4(33508, 46565, 59622, 20451, 72679) c5(X, av, b); #c1(NEK1) c2(NP_001186326) c3(7395) c4(33509, 46566, 59623, 20452, 72680) c5(rM, xc, b, cjm, bu, T, adp, bWE, by, u, zW); #c1(NEK2) c2(NP_001191112) c3(7396) c4(33510, 46567, 59624, 20453, 72681) c5(ml, aw, kY, b, X, gG, aES, U, y, wP, q, Be, av, fy, u, V, qL, fO, P, T, wV, cjn, os, ag, ji); #c1(NEK3) c2(NP_002489) c3(7397) c4(33511, 46568, 59625, 20454, 72682) c5(u, y); #c1(NEK4) c2(NP_001180462) c3(7398) c4(33512, 46569, 59626, 20455, 72683) c5(fy, co, fl, ak, ac); #c1(NEK6) c2(NP_001138473) c3(7399) c4(33513, 46570, 59627, 20456, 72684) c5(b, el, g, MS, do, i, bf, fx); #c1(NEK7) c2(NP_598001) c3(7400) c4(33514, 46571, 59628, 20457, 72685) c5(u); #c1(NEK8) c2(NP_835464) c3(7401) c4(33515, 46572, 59629, 20458, 72686) c5(xc, vU, cjp, et, f, ag, Nz, w, wt, cs, cjo, u, aCg, y); #c1(NEK9) c2(NP_149107) c3(7402) c4(33516, 46573, 59630, 20459, 72687) c5(xc, vU, f, Nz, wt, u, aCg); #c1(NELFA) c2(NP_005654) c3(7403) c4(33517, 46574, 59631, 20460, 72688) c5(axK); #c1(NELFB) c2(NP_056271) c3(7404) c4(33518, 46575, 59632, 20461, 72689) c5(b, bu, T, ar, by, u, y); #c1(NELFC0) c2(NP_945327) c3(7405) c4(33519, 46576, 59633, 20462, 72690) c5(aGk, Pv, Ip, aC, BW, aE); #c1(NELFE) c2(NP_002895) c3(7406) c4(33520, 46577, 59634, 20463, 72691) c5(pm, B, aw, aN, bgd, bf, aK, ca, xl, b, t, nv, ji, gl, apz, fe, lb, cs, gm, akr, fl, od, fx, jT, OA, cq, wh, Pc, agm, i, ace, pt, bT, X, eu, mk, aCB, IW, bw, ai, y, co, f, aaZ, iv, oD, av, fy, bm, awe, iF, NZ, V, qq, v, alM, akG, aYm, in, vH, oM, kD, ck, am, aF, AA, KN, Lg, ey, jD, jh, re, nU, q, jV, Kz, jG, u, aE, il, ht, ad, G, bUg, Nh, jU, ao, nV, kB, mA, Au, fj, A, k, UA, mW, qY, eM, hP, U, aW, m, aX, I, fq, h, aBd, M, aC, ik, oJ, cB, aV, si, nQ, cV, J, P, T, II, aj, fM, aM, wU, Lc, dl, cjg, Di, bM); #c1(NELL1) c2(NP_001275643) c3(7407) c4(33521, 46578, 59635, 20464, 72692) c5(AI, b, X, yD, et, cA, bj, e, cM, d, aX, ag, t, h, f, gX, O, av, fy, aE, agu, fi, dA, aza, G, OT, cV, cy, fx, Mw, jH, an, rQ, py, acw, aY, fP, i, dc, rr); #c1(NELL2) c2(NP_001138579) c3(7408) c4(33522, 46579, 59636, 20465, 72693) c5(co, aX, b, fq, h, f, zh, yD, M, Fo, apP, T, fx, i, UT, U, hP, av); #c1(NEMF) c2(NP_001288661) c3(7409) c4(33523, 46580, 59637, 20466, 72694) c5(fy, co, cs, ad); #c1(NEO1) c2(NP_001166094) c3(7410) c4(33524, 46581, 59638, 20467, 72695) c5(jh, aw, b, ag, X, Eo, gd, w, jy, O); #c1(NES) c2(NP_006608) c3(7411) c4(33525, 46582, 59639, 20468, 72696) c5(dx, aw, w, cO, rc, e, O, dv, iy, kJ, iT, cl, g, du, gm, fO, ft, QZ, jE, lu, yE, dh, vJ, bq, id, wK, afY, fU, bw, Cr, y, co, Ml, pp, ag, f, RA, fy, bm, fY, iF, SR, jR, ji, b, anb, ey, jD, d, bb, re, ar, as, u, aE, fh, fs, iD, et, et, Ut, agb, fl, A, k, fr, FL, wh, jx, RX, aX, LI, aGp, sG, zn, gT, cU, oJ, te, ma, cV, an, W, dU, P, fM, eJ, at); #c1(NETI) c2(NP_001040625) c3(7412) c4(33526, 46583, 59640, 20469, 72697) c5(g, awj, awi, b, AX, f, q, bu, T, ar, by, u, y, JY); #c1(NETO1) c2(NP_620552) c3(7413) c4(33527, 46584, 59641, 20470, 72698) c5(b); #c1(NETO2) c2(NP_060562) c3(7414) c4(33528, 46585, 59642, 20471, 72699) c5(rb); #c1(NEO1) c2(NP_000425) c3(7415) c4(33529, 46586, 59643, 20472, 72700) c5(Dr, fr, A, aw, b, k, X, LF, aYW, dB, aN, w, cjr, kY, U, aK, ey, y, yg, co, yl, B, jf, cU, qL, aYX, ar, O, av, fy, u, aYh, Zz, m, Be, aYi, LG, ft, zk, T, fx, bfg, aYY, LI, bzo, iR, by, bng, zp, fl, E); #c1(NEU3) c2(NP_006647) c3(7416) c4(33530, 46587, 59644, 20473, 72701) c5(aYh, aX, bzo, b, t, B, dB, ad, G, A, T, hb, cs, x); #c1(NEURL1) c2(NP_004201) c3(7417) c4(33531, 46588, 59645, 20474, 72702) c5(Dr, fr, A, aw, b, k, X, dB, jf, w, kY, U, O, yg, co, LI, B, cU, Be, ar, y, av, fy, iR, Zz, qL, ft, T, fx, by, u, jR, bnq, E); #c1(NEURL2) c2(NP_542787) c3(7418) c4(33532, 46589, 59646, 20475, 72703) c5(kG); #c1(NEUROD1) c2(NP_002491) c3(7419) c4(33533, 46590, 59647, 20476, 72704) c5(B, sE, dB, Ip, w, cO, bf, xl, cy, qc, yh, eE, mR, aD, mz, vO, aC, bK, cs, bp, ME, GI, jT, hj, mO, pg, mB, aoq, ag, cT, agQ, aA, id, td, arB, X, oa, rd, mk, dV, iG, Fh, U, uH, zL, y, arR, bhG, co, pp, yE, amo, DM, ak, IN, dZ, O, iv, Ch, av, fy, pP, iF, qw, V, qq, aNO, bJc, cjt, dP, byf, jR, fG, ji, dR, iu, ap, aOe, b, GL, aPW, z, agx, ey, bb, Re, ra, q, jV, CO, pn, vu, dQ, ff, as, ar, u, aE, da, sz, arQ, I, im, Dg, bc, UG, ahT, j, Rl, CM, G, Io, et, et, Jl, eh, cjs, Ck, mA, eo, na, aU, OS, A, aQR, di, wf, qs, aX, kn, h, aOd, aV, fU, cV, be, xS, J, W, jo, ti, T, II, jl, aM, qp, eN); #c1(NEUROD2) c2(XP_005257466) c3(7420) c4(33534, 46591, 59648, 20477, 72705) c5(aE, jR, pS); #c1(NEUROD4) c2(NP_067014) c3(7421) c4(33535, 46592, 59649, 20478, 72706) c5(bf, I, aM); #c1(NEUROD6) c2(NP_073565) c3(7422) c4(33536, 46593, 59650, 20479, 72707) c5(aXS); #c1(NEOROG1) c2(NP_006152) c3(7423) c4(33537, 46594, 59651, 20480, 72708) c5(ao, aw, V, b, ajX, gG, jR, cz, W, yE, T, cB, jy, U, jv, Mr); #c1(NEUROG2) c2(NP_076924) c3(7424) c4(33538, 46595, 59652, 20481, 72709) c5(W, yE, bj); #c1(NEUROG3) c2(NP_066279) c3(7425) c4(33539, 46596, 59653, 20482, 72710) c5(ahT, mz, UU, I, mB, qq, aE, yE, bf, at, HD, cju, aM); #c1(NF1) c2(NP_000258) c3(7426) c4(33540, 46597, 59654, 20483, 72711) c5(DP, aw, EM, Vz, HG, w, e, O, zi, ajF, bkr, cl, kX, g, iv, cjz, hR, atn, DO, OJ, xr, pJ, cC, afY, iP, agJ, bo, bw, xw, y, ed, co, cjA, f, N, aVm, cs, av, ze, Qz, Hg, VP, jC, anG, jR, adv, gO, iu, ap, ale, b, jg, jy, blO, cjx, d, jd, nO, cjy, es, byM, EL, as, jG, u, da, fs, afW, el, ad, IG, iD, aiJ, agb, aX, QU, bL, k, agH, aBR, gw, Ct, dl, c, QV, cr, LI, jk, h, xJ, jA, cjv, n, ag, fU, bmf, cV, an, adh, J, bks, dt, cjw, T, S, cz, AP, fM, or, TY, jT, E); #c1(NF2) c2(NP_000259) c3(7427) c4(33541, 46598, 59655, 20484, 72712) c5(ayo, fr, A, aw, b, k, agH, jq, afY, aCb, dB, hS, w, agJ, dV, iG, gE, bw, U, bu, avA, y, BO, co, aX, LI, pp, jd, h, cV, q, es, cjC, EM, bkB, fx, O, iv, fy, u, ov, g, iP, V, c, agb, qY, J, Qz, by, lx, anD, P, dZ, FF, cjB, Zt, Ut, fM, aJX, azy, bm, he, Le, qa, cfx, i, iu, avz, ic); #c1(NFAMI) c2(NP_666017) c3(7428) c4(33542, 46599, 59656, 20485, 72713) c5(gL); #c1(NFASC) c2(NP_001005388) c3(7429) c4(33543, 46600, 59657, 20486, 72714) c5(mZ, zm, aV, anB); #c1(NFAT5) c2(NP_001106649) c3(743O) c4(33544, 46601, 59658, 20487, 72715) c5(iF, wh, be, b, aC, f, PB, J, P, do, di, oJ, wf, ey, u, dh, y); #c1(NFATCI) c2(NP_001265598) c3(7431) c4(33545, 46602, 59659, 20488, 72716) c5(b, cY, Jo, akL, pu, bw, IS, oy, jT, X, cs, pB, aq, da, lb, be, aLD, cjD, P, T, BW, hR, jH, acw, u, Eo, ag, cT, aC, at); #c1(NFATC2) c2(NP_001129493) c3(7432) c4(33546, 46603, 59660, 20489, 72717) c5(abB, aKO, b, cY, eM, pD, kB, sJ, NH, cO, bf, U, y, MI, ag, rr, IW, g, es, tF, cjE, O, cs, pH, u, I, oS, bK, J, bp, ad, IR, IX, P, do, T, BW, aX, jT, jU, aM, jH, NG, aY, aq, qd, IS, aA, pv); #c1(NFATC3) c2(NP_004546) c3(7433) c4(33547, 46604, 59661, 20490, 72718) c5(A, b, hP, J, gL, II, IW, bf, u, y, aM); #c1(NFATC4) c2(NP_001129494) c3(7434) c4(33548, 46605, 59662, 20491, 72719) c5(abB, ze, cK, tF, mR, o, cO, bf, aA, u, y, aM); #c1(NFE2) c2(XP_005268963) c3(7435) c4(33549, 46606, 59663, 20492, 72720) c5(dx, pV, b, aF, pz, y, dv, f, N, pn, qB, kX, fy, u, Yb, afc, du, pF, pg, fg, zO, pv); #c1(NFE2L1) c2(NP_003195) c3(7436) c4(33550, 46607, 59664, 20493, 72721) c5(bm, A, I, dA, kD, f, q, cc, KK, B, cV, cO, bf, av, u, y, aM); #c1(NFE2L2) c2(NP_001138884) c3(7437) c4(33551, 46608, 59665, 20494, 72722) c5(dx, gK, B, pV, dN, Gm, Zy, w, aw, bu, e, O, gO, dv, cy, am, gB, dl, gP, Hs, g, fe, lb, bK, byP, du, aWN, bp, cV, x, qt, fx, dL, av, pq, buh, QJ, Iu, fc, sg, hx, os, ag, cT, pH, dX, i, fN, aA, bT, bP, QF, X, iP, Hp, Ko, mk, fU, NH, vp, bw, U, kV, y, Wl, uD, co, bi, pp, ml, f, IW, aG, tv, cs, bv, NB, fy, bm, wY, iT, bk, is, em, jB, V, ae, bx, v, Fy, uu, cK, iA, pi, aH, PY, fw, ji, fD, fW, ap, aEg, b, aF, dk, m, ic, z, ey, BQ, d, jh, bb, eA, re, hV, je, q, jV, yp, dQ, Yr, ar, u, dh, o, cl, adK, aP, jE, I, LR, KL, ad, BZ, tf, aPu, aZ, et, jU, jH, ao, nV, hS, HN, gd, ab, I, yA, bL, A, bf, gw, gN, jc, og, byQ, iL, bZ, wf, LK, bj, aW, asN, LS, io, h, F, cU, iZ, gg, aV, te, ma, si, qB, ed, J, W, P, II, aX, by, aM, ceZ, Lc, NG, gj, bh, at, gf, oT); #c1(NFE2L3) c2(NP_004280) c3(7438) c4(33552, 46609, 59666, 20495, 72723) c5(hX, t, jT, eG); #c1(NFIA) c2(XP_011539817) c3(7439) c4(33553, 46610, 59667, 20496, 72724) c5(aev, bb, dA, ag, cV, bu, ig, bok, by, vt, o); #c1(NFIB) c2(NP_001177666) c3(7440) c4(33554, 46611, 59668, 20497, 72725) c5(b, bKf, atK, kY, y, jh, bb, bu, aW, chf, aq, o, cjF, cV, Be, gL, by, W, rQ, boB, aeC, pF, aHE, u, rb, ib); #c1(NFIC) c2(NP_001231931) c3(7441) c4(33555, 46612, 59669, 20498, 72726) c5(cjF, A, bb, b, cV, EM, bu, Ku, kF, by, aq, o); #c1(NFIL3) c2(NP_001276929) c3(7442) c4(33556, 46613, 59670, 20499, 72727) c5(jH, ao, bb, b, m, aY, zM, aC, yk, fP, jU); #c1(NFIX) c2(NP_001257972) c3(7443) c4(33557, 46614, 59671, 20500, 72728) c5(by, cjl, cV, ag, aPO, ak, bu, bok, cjH, cjG, vt, o); #c1(NFKB1) c2(NP_001158884) c3(7444) c4(33558, 46615, 59672, 20501, 72729) c5(dx, by, r, aw, aAB, bx, gG, DT, aE, x, sJ, w, ak, cO, JH, O, VG, e, xl, cp, cU, fl, dv, cy, kJ, t, m, GL, yh, fP, jG, iT, dl, mR, cl, Pv, azx, gl, cc, g, baH, atW, lb, bK, sH, du, aB, gm, bp, iU, cjM, vc, rQ, bag, Mm, hU, fx, jT, cq, jE, aoC, iL, alt, rS, aOS, ie, tO, we, ag, cT, Oh, dh, i, bjF, yU, aA, bT, gE, Kt, pD, cY, cjK, jz, mk, ix, NH, kY, vp, bw, U, eo, y, ed, co, px, pp, uj, rl, DM, f, bu, ji, aoe, k, B, JX, cs, pH, av, JD, Zn, eG, fY, Bm, aEq, em, nl, V, ae, jh, bag, afe, n, cd, BV, bm, Og, eX, bt, pt, iy, iA, hw, f J, JY, en, eF, py, jg, er, P, dY, xe, fG, sh, yM, oM, iu, hc, aG, WH, afa, b, zH, aF, atU, agJ, oR, tG, z, ey, fD, cjJ, d, eE, fO, bb, Iz, fv, jd, pi, re, hV, q, jV, ap, afb, X, pn, vu, dQ, ff, cjL, ar, yW, xd, u, nj, o, fh, da, bjh, In, sQ, I, UK, aiU, LR, gL, ad, CM, Fo, gp, rw, aGn, aZ, fH, aeC, et, bg, jU, cW, jH, ao, nV, Eu, ig, iR, tW, kM, he, xU, gd, agf, MR, zO, fw, DD, I, bjf, UT, Xm, IA, bL, cjN, A, bf, JC, PJ, fr, fN, pR, Ik, apC, M, mW, jc, og, di, Iv, vg, eO, wf, fs, al, jR, hP, vl, eh, jx, bk, bkK, MT, xT, aX, il, ty, bj, h, im, F, jQ, aeY, HY, aC, iZ, ik, fy, cB, LI, aV, jZ, NO, aAq, fU, hW, qO, cV, hZ, ui, be, dB, J, W, jo, T, II, bEw, Oi, jl, ft, aM, VF, Lc, bvS, NG, vt, mb, lc, abX, G, zM, j, bh, at, Nu, gf, aeZ, Ca); #c1(NFKB2) c2(NP_002493) c3(7445) c4(33559, 46616, 59673, 20502, 72730) c5(dx, WH, by, A, vg, b, X, apC, ahM, jz, eu, pD, mk, Iv, tG, bw, re, G, e, O, jQ, d, MT, dv, cy, Zq, t, h, B, N, bu, M, ar, cB, cs, zQ, u, ae, aC, Cg, du, dB, gm, fO, J, vc, T, aGn, jl, ad, jU, xd, jH, jT, cjO, alt, ch, F, ie, P, ag, cT, Dl, bNf, bh, DM, IA); #c1(NFKB1A) c2(NP_065390) c3(7446) c4(33560, 46617, 59674, 20503, 72731) c5(dx, B, sJ, w, Ou, ps, e, O, cy, gc, t, aD, fH, cjQ, gl, g, aC, du, fO, bp, ft, vc, x, jT, bjf, sN, ag, bq, aEN, zr, X, mk, ix, bw, U, cjP, y, co, Ot, DM, f, N, bu, cs, av, fy, bm, iT, V, Ov, nl, v, pi, fJ, jR, xe, qO, rr, iu, b, aF, DJ, tG, bjA, d, jh, bb, Iz, re, g, dQ, ar, u, aE, fh, da, Dg, gL, by, CM, aZ, jO, jH, gd, fl, I, bL, A, iL, fr, gn, pD, vg, eO, m, aX, fg, QJ, hZ, GS, P, II, aDA, jl, gF, ad, ge, DI, fP, wG, bh, at, gf); #c1(NFKB1B) c2(NP_002494) c3(7447) c4(33561, 46618, 59675, 20504, 72732) c5(dx, jl, BX, vg, ig, X, t, du, P, ip, ny, mk, vc, tG, gE, I, aC, av, cjQ, aEN); #c1(NFKB1B) c2(NP_004547)

c3(7448) c4(33562, 46619, 59676, 20505, 72733) c5(dx, tG, P, aC, du, i, gL, mk, vc, fO, vg, I, cjQ, u); #c1(NFKB1L1) c2(NP_001138433) c3(7449) c4(33563, 46620, 59677, 20506, 72734) c5(en, uS, aF, IW, gn, ix, cK, vl, m, jl, aiT, aV, aE, pW, ae, aC, aR, cy, jH, aum, bq, iu); #c1(NFKB1Z) c2(NP_001005474) c3(7450) c4(33564, 46621, 59678, 20507, 72735) c5(yi, td, ae, cV, fg, DO, aV); #c1(NFRKB) c2(NP_001137307) c3(7451) c4(33565, 46622, 59679, 20508, 72736) c5(f0, o); #c1(NFSI) c2(NP_001185918) c3(7452) c4(33566, 46623, 59680, 20509, 72737) c5(cV); #c1(NFOI) c2(NP_001002755) c3(7453) c4(33567, 46624, 59681, 20510, 72738) c5(aNN, zj, hT, kW, cjR); #c1(NFYA) c2(NP_002496) c3(7454) c4(33568, 46625, 59682, 20511, 72739) c5(qs, co, qz, f, g, bp, rd, ar, jV, av, bT); #c1(NFYB) c2(NP_006157) c3(7455) c4(33569, 46626, 59683, 20512, 72740) c5(h, co, gs, cV); #c1(NFYC) c2(XP_011539819) c3(7456) c4(33570, 46627, 59684, 20513, 72741) c5(QJ, dB, tP, ff); #c1(NGB) c2(NP_067080) c3(7457) c4(33571, 46628, 59685, 20514, 72742) c5(aAt, g, du, sB, bb, b, cV, f, fw, e, w, afl, co, dx, fy, ar, fh, dh, o, d); #c1(NGDN) C2(NP_001036100) c3(7458) c4(33572, 46629, 59686, 20515, 72743) c5(A, V, B, x, U, beY); #c1(NGEF) c2(NP_001107562) c3(7459) c4(33573, 46630, 59687, 20516, 72744) c5(aA); #c1(NGF) c2(XP_011539820) c3(7460) c4(33574, 46631, 59688, 20517, 72745) c5(EM, gG, aN, dd, bf, aK, e, gO, cy, LN, g, agQ, bK, nW, jT, Vb, Fi, fD, dc, hM, vD, Kc, ix, dV, O, y, DM, B, dZ, JX, cs, vn, V, nu, v, Ih, cK, er, jR, xe, abt, bg, dk, aFh, d, biX, bb, q, yp, IY, u, o, da, kF, cjS, ad, Fo, gn, cjT, bdu, PL, hU, Uu, RS, ch, Y, ih, xf, A, bOm, k, sv, di, HS, bj, m, aX, fg, zn, aal, aV, dj, hW, cV, be, J, dt, ti, agR, cz, ac, aM, jP, cjU, eB, Dl, cjj, at, rb); #c1(NGFRAP1) C2(NP_001269603) c3(7461) c4(33575, 46632, 59689, 20518, 72746) c5(iy); #c1(NGFR) c2(NP_002498) c3(7462) c4(33576, 46633, 59690, 20519, 72747) c5(by, A, b, EM, vD, aKd, aBK, O, di, HS, iG, cO, cA, bw, Fr, ha, G, e, cM, d, jh, QV, jV, aX, pp, fq, DM, f, q, aOT, bu, CK, dZ, y, iv, aBO, av, u, dh, o, og, kF, apx, B, aBE, fl, OJ, v, eu, dt, Fo, PL, T, Jj, iD, pt, cy, J, cz, et, ac, P, rQ, Y, ch, er, cV, jR, uH, HM, ag, cT, Dl, bk, i, dc, oM, yg, Xm, dV); #c1(NGLY1) c2(NP_001138765) c3(7463) c4(33577, 46634, 59691, 20520, 72748) c5(cjV); #c1(NHEJ1) c2(NP_079058) c3(7464) c4(33578, 46635, 59692, 20521, 72749) c5(WZ, f, bZu, QZ, aV, cq); #c1(NHLH1) c2(NP_005589) c3(7465) c4(33579, 46636, 59693, 20522, 72750) c5(atn, AD, QN, b, cV, Nq, atf, ar, Gs); #c1(NHLRC1) c2(NP_940988) c3(7466) c4(33580, 46637, 59694, 20523, 72751) c5(zp, jT, f, yQ, zn, xJ, v, yH, hS, zj, zk, xw, cjW); #c1(NHLRC3) c2(NP_001012772) c3(7467) c4(33581, 46638, 59695, 20524, 72752) c5(Eo); #c1(NHP2) c2(NP_001030005) c3(7468) c4(33582, 46639, 59696, 20525, 72753) c5(ss, cjX, bp, cjY, cjZ); #c1(NHP2L1) c2(NP_004999) c3(7469) c4(33583, 46640, 59697, 20526, 72754) c5(oM, pt); #c1(NHS) c2(NP_001129496) c3(7470) c4(33584, 46641, 59698, 20527, 72755) c5(cka, bQ, cr, ae, b, aJc, aF, aqd, eR, P, KK, Gs, bk, fl, U, at, u, y, ap); #c1(NHSLI) c2(NP_001137532) c3(7471) c4(33585, 46642, 59699, 20528, 72756) c5(o, aJc); #c1(NICN1) c2(NPJI5692) c3(7472) c4(33586, 46643, 59700, 20529, 72757) c5(i); #c1(NID1) c2(NP_002499) c3(7473) c4(33587, 46644, 59701, 20530, 72758) c5(fl, aX, b, hP, Yg, bu, ND, cs, wf, ad, u, y); #c1(NID2) c2(NP_031387) c3(7474) c4(33588, 46645, 59702, 20531, 72759) c5(b, hP, q, bu, i, z, fx, at, u, y); #c1(NIF3L1) c2(NP_001129511) c3(7475) c4(33589, 46646, 59703, 20532, 72760) c5(dx, ajs, be, dN, cV, xM, du, dv, vu, mR, aWX, bf, WA, bM, yv, bAp, aM); #c1(NIMIK) c2(XP_006714513) c3(7476) c4(33590, 46647, 59704, 20533, 72761) c5(QF, hV, D); #c1(NIN) c2(NP_057434) c3(7477) c4(33591, 46648, 59705, 20534, 72762) c5(g, ag, u, N, Eo, QZ, fg, bVZ, avF, ckb, y); #c1(NINJ1) c2(NP_004139) c3(7478) c4(33592, 46649, 59706, 20535, 72763) c5(gj, I, yk, Bm, i); #c1(NINJ2) c2(NP_001281274) c3(7479) c4(33593, 46650, 59707, 20536, 72764) c5(vu, bb, aO, fh); #c1(NINL) c2(NP_079452) c3(7480) c4(33594, 46651, 59708, 20537, 72765) c5(co, anh, b, fH, jT, u, fJ, y); #c1(NIPA1) c2(NP_001135747) c3(7481) c4(33595, 46652, 59709, 20538, 72766) c5(ao, f, hW, rv, ckc, nl, ajl, v, QC, bN, hS, agw, amb, OA, cz, ajj, CG); #c1(NIPA2) c2(NP_001008892) c3(7482) c4(33596, 46653, 59710, 20539, 72767) c5(dl, A, Id, rv); #c1(NIPAL3) c2(XP_011540110) c3(7483) c4(33597, 46654, 59711, 20540, 72768) c5(A); #c1(NIPAL4) c2(NP_001092757) c3(7484) c4(33598, 46655, 59712, 20541, 72769) c5(ckd, dw, cO); #c1(NIPBL) c2(NP_056199) c3(7485) c4(33599, 46656, 59713, 20542, 72770) c5(d, Am, cr, eke, sE, aNS, hep, x, AP, e); #c1(NIPSNAP1) c2(NP_003625) c3(7486) c4(33600, 46657, 59714, 20543, 72771) c5(bQF); #c1 (NIPSNAP3B) c2(NP_060846) c3(7487) c4(33601, 46658, 59715, 20544, 72772) c5(dG, dF); #c1(NISCH) c2(NP_001263222) c3(7488) c4(33602, 46659, 59716, 20545, 72773) c5(dx, dv, I, du, di, cO, aA, u, y, ap); #c1(NIT1) c2(NP_001172021) c3(7489) c4(33603, 46660, 59717, 20546, 72774) c5(mD, gF, f, b); #c1(NIT2) c2(NP_064587) c3(7490) c4(33604, 46661, 59718, 20547, 72775) c5(b); #c1(NKAIN2) c2(NP_001035304) c3(7491) c4(33605, 46662, 59719, 20548, 72776) c5(HI, qf, bb, dA, cV, J, agT, CM, qa, cO); #c1(NKAIN3) c2(NP_001291462) c3(7492) c4(33606, 46663, 59720, 20549, 72777) c5(bb, cV); #c1(NKAP) c2(NP_078804) c3(7493) c4(33607, 46664, 59721, 20550, 72778) c5(aC); #c1(NKD1) c2(NPJ49110) c3(7494) c4(33608, 46665, 59722, 20551, 72779) c5(jB, co, V, b, X, W, bO, II, U, fy, av); #c1(NKD2) C2(NP_001258011) c3(7495) c4(33609, 46666, 59723, 20552, 72780) c5(by, w, iD, bu); #c1(NKG7) c2(NP_005592) c3(7496) c4(33610, 46667, 59724, 20553, 72781) c5(fG, h, jG); #c1(NKIRAS1) c2(NP_065078) c3(7497) c4(33611, 46668, 59725, 20554, 72782) c5(aC, ff, dB); #c1(NKIRAS2) c2(NP_001138400) c3(7498) c4(33612, 46669, 59726, 20555, 72783) c5(aC, w); #c1(NKRF) c2(NP_001166958) c3(7499) c4(33613, 46670, 59727, 20556, 72784) c5(x, ag, an, I); #c1(NKTR) c2(NP_005376) c3(7500) c4(33614, 46671, 59728, 20557, 72785) c5(P); #c1(NKX1-1) c2(NP_001277008) c3(7501) c4(33615, 46672, 59729, 20558, 72786) c5(nl, IK, Nw); #c1(NKX1-2) c2(NP_001139812) c3(7502) c4(33616, 46673, 59730, 20559, 72787) c5(aHX, aHW); #c1(NKX2-1) C2(NP_001073136) c3(7503) c4(33617, 46674, 59731, 20560, 72788) c5(Dr, ji, An, b, X, Sc, oa, ahS, eu, jw, fe, ckf, cI, ckg, zY, yv, ayY, d, co, aX, hM, si, cki, auA, hV, wN, apB, cy, cU, FN, ar, y, av, fy, u, biV, e, ckh, fU, kF, VD, FL, bp, dt, I, P, T, aZ, ahp, bb, nP, kN, agn, W, nV, af, QN, Ww, ge, xM, Bg, uH, bpk, gd, og, fl, iA, bM, aA, iu, fW); #c1(NKX2-2) c2(NP_002500) c3(7504) c4(33618, 46675, 59732, 20561, 72789) c5(mZ, fU, aX, I, b, k, mB, cV, Fs, es, w, O, gp); #c1(NKX2-3) c2(NP_660328) c3(7505) c4(33619, 46676, 59733, 20562, 72790) c5(jH, V, b, aMH, rr, oa, fP, U, yd); #c1(NKX2-5) c2(NP_001159647) c3(7506) c4(33620, 46677, 59734, 20563, 72791) c5(ats, bL, A, KG, Sc, acH, MS, cO, y, m, atj, cr, aLv, t, B, Lo, cko, mL, sO, ckn, gg, u, amO, chQ, aC, sX, el, ckk, aao, bzu, cK, Mw, hR, adx, su, acL, atE, VH, at, ckj, hQ, rQ, ckp, acw, ckm, ckl, mx, ckr, ahp, ckq, iu); #c1(NKX2-6) c2(NP_001129743) c3(7507) c4(33621, 46678, 59735, 20564, 72792) c5(aF, aLq, dA); #c1(NKX2-8) c2(NP_055175) c3(7508) c4(33622, 46679, 59736, 20565, 72793) c5(jh, IJ, co, il, b, ik, i, fx, fy, auz); #c1(NKX3-I) c2(NP_001243268) c3(7509) c4(33623, 46680, 59737, 20566, 72794) c5(aEg, A, Ir, b, Lv, wy, BY, ck, Lr, e, y, jb, d, t, B, ar, Up, aJ, u, hb, J, G, T, Fr, fp, wV, ie, wP); #c1(NKXG-1) C2(XP_006714293) c3(7510) c4(33624, 46681, 59738, 20567, 72795) c5(ch, beY, I); #c1(NKX6-2) c2(NP_796374) c3(7511) c4(33625, 46682, 59739, 20568, 72796) c5(g, I, Fs, i, fx, ey); #c1(NLE1) c2(NP_001014445) c3(7512) c4(33626, 46683, 59740, 20569, 72797) c5(b, qb); #c1(NLGN1) c2(NP_055747) c3(7513) c4(33627, 46684, 59741, 20570, 72798) c5(ao, rQ, hW, aY, ak, cz, do, bg); #c1(NLGN2) c2(NP_065846) c3(7514) c4(33628, 46685, 59742, 20571, 72799) c5(cz); #c1(NLGN3) c2(NP_001160132) c3(7515) c4(33629, 46686, 59743, 20572, 72800) c5(cku, nU, aQF, hT, cks, cz, rQ, ckt); #c1(NLGN4X) c2(NP_001269075) c3(7516) c4(33630, 46687, 59744, 20573, 72801) c5(cku, hT, hW, Wk, nz, nU, ckw, bty, rQ, zb, ckv, cz, iE); #c1(NLGN4Y) c2(NP_001193779) c3(7517) c4(33631, 46688, 59745, 20574, 72802) c5(nU, cz); #c1(NLK) c2(NP_057315) c3(7518) c4(33632, 46689, 59746, 20575, 72803) c5(jE, A, V, b, X, bm, B, q, ad, cs, x, av, fy, u, y); #c1(NLN) c2(NP_065777) c3(7519) c4(33633, 46690, 59747, 20576, 72804) c5(da, A, b, cV, B, pt, o, cO, iN, oM, at, u, y); #c1(NLRC3) c2(NP_849172) c3(7520) c4(33634, 46691, 59748, 20577, 72805) c5(fl); #c1(NLRC4) c2(NP_001186068) c3(7521) c4(33635, 46692, 59749, 20578, 72806) c5(m, en, aaa, bso, Ie, oh, aLQ, aoC, Dm, pi); #c1(NLRC5) c2(XP_005256251) c3(7522) c4(33636, 46693, 59750, 20579, 72807) c5(at, pi, I); #c1(NLRP10) c2(XP_011518345) c3(7523) c4(33637, 46694, 59751, 20580, 72808) c5(bf, aM); #c1(NLRP11) c2(NP_659444) c3(7524) c4(33638, 46695, 59752, 20581, 72809) c5(cT, ho, aV); #c1(NLRPI2) c2(NP_001264055) c3(7525) c4(33639, 46696, 59753, 20582, 72810) c5(WH, aoC, ae, Ob, fq, cs, dB, ad, Fm, aT, On, ckx); #c1(NLRPI3) c2(NP_789780) c3(7526) c4(33640, 46697, 59754, 20583, 72811) c5(cT); #c1(NLRPI4) c2(NP_789792) c3(7527) c4(33641, 46698, 59755, 20584, 72812) c5(wn, cT, NT); #c1(NLRP1) c2(NP_001028225) c3(7528) c4(33642, 46699, 59756, 20585, 72813) c5(A, pV, TH, b, k, aF, dB, aN, ig, vp, m, bb, Ob, fg, f, bu, M, jk, mL, B, qB, gg, dH, aE, o, ff, aFA, ax, si, yV, cV, aC, yY, be, v, j, by, jo, Yi, bq, aX, iv, ajn, aoC, dP, iz, P, cky, cT, fP, Bm, abs, ji); #c1(NLRP2) c2(NP_001167552) c3(7529) c4(33643, 46700, 59757, 20586, 72814) c5(GD, A, aw, b, fH, fE, aKd, dB, adB, w, qX, eM, bw, U, jR, y, m, co, aX, t, h, nU, F, dl, aBE, ar, B, iv, fv, av, fy, u, V, lb, Dc, dT, J, dt, CM, G, II, pt, QZ, jC, mF, Dd, fJ, ac, cq, WZ, jT, bR, gN, DO, ajv, ag, cT, qO, Im, jl, bX); #c1(NLRP3) c2(NP_001120933) c3(7530) c4(33644, 46701, 59758, 20587, 72815) c5(dx, ml, axx, aiW, aPi, en, aw, gO, gM, dv, aOx, adO, dl, nB, Uy, gl, sE, Nd, aAL, du, hR, oh, dH, azM, jE, aoC, bm, m, bq, aA, aLQ, aAp, asL, nX, fl, iP, ig, ix, bf, U, y, yX, DM, f, ky, B, gg, Zn, fY, em, jB, V, ae, aDM, nl, cd, eX, pi, RE, P, iV, xe, Om, abs, ij, hW, b, LX, aF, bdY, bQO, NY, LP, Xy, bX, nU, q, Jg, ckz, ajJ, as, boq, u, aE, da, jj, I, Fw, LR, gL, IJ, pD, aZ, ct, aeC, et, jU, jH, RU, Zl, xU, ih, gd, bQK, fl, yA, fj, A, mW, amt, di, qX, gE, adY, al, adR, aW, bkK, qs, aX, or, fq, aC, adQ, aV, NO, ax, si, aPQ, cV, hZ, be, W, bR, aoN, II, On, aM, jT, qj, ajv, UE, fP, al at); #c1(NLRP4) c2(XP_006723105) c3(7531) c4(33645, 46702, 59759, 20588, 72816) c5(U, cO, cT, b, V); #c1(NLRP5) c2(NP_703148) c3(7532) c4(33646, 46703, 59760, 20589, 72817) c5(Pb, wp, agl, cT, jw, Pm); #c1(NLRP6) c2(NP_001263629) c3(7533) c4(33647, 46704, 59761, 20590, 72818) c5(ag, gs, di, I); #c1(NLRP7) c2(NP_631915) c3(7534) c4(33648, 46705, 59762, 20591, 72819) c5(wV, wy, wP, gA, od, Dd, mF, ZU, aol, fp); #c1(NLRP8) c2(NP_789781) c3(7535) c4(33649, 46706, 59763, 20592, 72820) c5(cT); #c1(NLRP9) c2(XP_011525195) c3(7536) c4(33650, 46707, 59764, 20593, 72821) c5(cO); #c1(NMB) c2(NP_066563) c3(7537) c4(33651, 46708, 59765, 20594, 72822) c5(anT, co, f, cx, TD, T, aA, fy); #c1(NMBR) c2(NP_002502) c3(7538) c4(33652, 46709, 59766, 20595, 72823) c5(anT, fU, co, fy, u, y, ap); #c1(NME1) c2(NP_000260) c3(7539) c4(33653, 46710, 59767, 20596, 72824) c5(B, aw, IA, iU, bf, e, O, aoY, WZ, FN, ckA, cW, og, lb, gm, bp, ft, x, fx, jT, cq, M, DO, ag, bk, i, mD, aJU, Dr, GO, em, cY, eu, wy, mk, U, y, tp, co, ip, fi, f, bu, cs, av, fy, bm, OT, iT, yJ, if, V, hf, afz, VP, Fr, iA, qW, P, ji, b, jL, jC, d, jh, Dx, ra, apG, re, hV, q, jV, es, X, ar, ff, jG, aM, u, o, VD, qL, ad, G, aAF, nV, iR, bwv, atb, Mp, CD, A, fr, pD, BY, aBV, hP, yw, iK, jx, aX, Qm, h, F, Lh, cU, aC, Dd, cB, QJ, aq, cV, Be, dB, J, W, jo, T, bh, jl, by, sK, Lc, hq, E, Oi, eG, Bi); #c1(NME1-NME2) c2(NP_001018146) c3(7540) c4(33654, 46711, 59768, 20597, 72825) c5(dx, b, X, eu, wy, mk, bV, Lh, U, e, y, d, co, aX, re, f, q, jG, es, ar, av, u, cV, hf, du, dB, dv, fp, yE); #c1(NME2) c2(NP_001018148) c3(7541) c4(33655, 46712, 59769, 20598, 72826) c5(dx, b, X, iP, eu, Lh, mk, bV, U, e, y, d, co, aX, re, f, q, jG, es, ar, av, aq, o, cV, hf, du, J, dB, dv, wy, fp, u, yE); #c1(NME3) c2(NP_002504) c3(7542) c4(33656, 46713, 59770, 20599, 72827) c5(V, cV, W, w, U, jG, y); #c1(NME4) c2(NP_001273364) c3(7543) c4(33657, 46714, 59771, 20600, 72828) c5(cV, J, by, P, n, bu, ci); #c1(NME5) c2(NP_003542) c3(7544) c4(33658, 46715, 59772, 20601, 72829) c5(ag, iR); #c1(NME6) c2(NP_005784) c3(7545) c4(33659, 46716, 59773, 20602, 72830) c5(by, cs, ad); #c1(NME7) c2(NP_037462) c3(7546) c4(33660, 46717, 59774, 20603, 72831) c5(bb, ad, di, cs, IV, cp); #c1(NME8) c2(NP_057700) c3(7547) c4(33661, 46718, 59775, 20604, 72832) c5(MW, ckB, am); #c1(NME9) c2(NP_835231) c3(7548) c4(33662, 46719, 59776, 20605, 72833) c5(cs, o, b, ad); #c1(NM1) c2(NP_004679) c3(7549) c4(33663, 46720, 59777, 20606, 72834) c5(aX, b, X, i, aw, av, u, fx, y); #c1(NMNAT1) c2(NP_001284707) c3(7550) c4(33664, 46721, 59778, 20607, 72835) c5(alM, nQ, bK, bfs, aVB, ckC, awS, aW); #c1(NMNAT2) c2(NP_055854) c3(7551) c4(33665, 46722, 59779, 20608, 72836) c5(U, xw, HN, V, cO); #c1(NMNAT3) c2(NP_001186976) c3(7552) c4(33666, 46723, 59780, 20609, 72837) c5(hT, kF, Fg); #c1(NMS) c2(NP_001011717) c3(7553) c4(33667, 46724, 59781, 20610, 72838) c5(b, kJ, h, dA, iD, EM); #c1(NMT1) c2(NP_066565) c3(7554) c4(33668, 46725, 59782, 20611, 72839) c5(g, d, gL, T, x, e); #c1(NMT2) c2(NP_004799) c3(7555) c4(33669, 46726, 59783, 20612, 72840) c5(g, US, T); #c1(NMU) c2(NP_006672) c3(7556) c4(33670, 46727, 59784, 20613, 72841) c5(fl, b, qg, y, jh, co, kJ, rh, t, h, F, M, ff, u, o, bp, G, zU, fx, jo, ag, i, aA); #c1(NMUR1) c2(NP_006047) c3(7557) c4(33671, 46728, 59785, 20614, 72842) c5(M, jo, at, ff); #c1(NMUR2) c2(NP_064552) c3(7558) c4(33672, 46729, 59786, 20615, 72843) c5(aA); #c1(NNAT) c2(NP_005377) c3(7559) c4(33673, 46730, 59787, 20616, 72844) c5(b, FL, fe, bf, e, d, f, q, es, ar, iv, fy, fU, cV, zj, v, J, W, aM, ie, jR, pj, yE, ji, aA); #c1(NNMT) c2(NP_006160) c3(7560) c4(33674, 46731, 59788, 20617, 72845) c5(Dr, IJ, hV, b, Gm, pR, eu, xf, U, bj, e, y, hh, bb, sG, t, vj, f, q, cy, ra, jM, u, fh, d, og, V, cV, cd, dB, G, cr, fx, nV, anG, hT, i, I, aA); #c1(NNT) c2(XP_006714524) c3(7561) c4(33675, 46732, 59789, 20618, 72846) c5(mz, fl, vQ, jZ, ckD, aA, at, bD); #c1(NOA1) c2(NP_115689) c3(7562) c4(33676, 46733, 59790, 20619, 72847) c5(aW); #c1(NOB1) c2(NP_054781) c3(7563) c4(33677, 46734, 59791, 20620, 72848) c5(hh, b, pR, dB, jo, ff, fT, O); #c1(NOBOX) c2(NP_001073882) c3(7564) c4(33678, 46735, 59792, 20621, 72849) c5(bbg, jw, Ap, ckE); #c1 (NOC3L) c2(NP_071896) c3(7565) c4(33679, 46736, 59793, 20622, 72850) c5(U, by, bb, V, bu); #c1(NOD1) c2(NP_006083) c3(7566) c4(33680, 46737, 59794, 20623, 72851) c5(dx, b, bx, aF, eu, sJ, bf, y, ed, bb, rl, bu, bK, bv, aV, u, aDu, V, I, aC, ol, du, gL, by, aD, P, ti, aFs, II, bt, x, cy, iA, qH, pi, be, aM, jH, aoC, dP, mb, gC, cT, aaM, fP, Bm, fq, zS, gl); #c1(NOD2) c2(NP_071445) c3(7567) c4(33681, 46738, 59795, 20624, 72852) c5(dx, by, f, aw, Ob, bx, ig, sE, iU, aPi, sJ, bn, JH, ps, bba, cp, dv, cy, t, dl, aFA, mg, aD, TP, aNq, aC, sH, du, cji, bEk, bp, gY, vc, aiL, Lb, vM, x, oh, aXf, dH, aoC, tO, xr, i, rn, aFy, GO, fI, X, aAb, ahS, wF, Kc, mk, ix, bf, U, sN, y, rN, baR, co, ckH, DG, hm, rl, DM, ckF, cT, bu, bxF, cs, iv, bRb, bWc, SA, nl, V, eE, aSz, aZz, ajl, gv, bt, wA, cl, iA, pi, bJc, dP, aAG, To, P, iV, xe, aDL, aFW, Om, aLP, zS, Xe, ij, ap, fn, WH, gz, rD, b, aF, XF, ckJ, au, ic, tG, z, ey, yK, ec, Zk, or, vj, qd, q, acO, dQ, as, u, dh, ri, da, RG, YL, auu, sX, qJ, UG, gL, ad, BZ, IJ, Za, et, jU, Yz, jH, acN, amJ, gC, Bm, I, xa, vg, bFi, gU, gN, di, C, rj, hP, vl, m, bNQ, ckl, aX, aej, Yh, bj, h, aE, gg, fP, aCH, aV, ckG, yd, cal, ma, aFV, aMH, be, J, biv, dt, axl, ti, II, Im, HK, jl, Bb, Pk, aM, nk, bPu, ajv, DI, I, aBz, fq, bh, at, rr, oT); #c1(NODAL) c2(NP_060525) c3(7568) c4(33682, 46739, 59796, 20625, 72853) c5(aai, A, aX, BX, b, ckK, B, q, ip, aDY, O, ny, arZ, at, y); #c1(NOG) c2(NP_005441) c3(7569) c4(33683, 46740, 59797, 20626, 72854) c5(bL, A, AI, Oa, b, atu, bvY, VY, eu, bBh, Ak, ckP, di, ckL, dN, pz, jw, y, cp, co, ckR, atF, aVC, f, q, Cc, bkm, B, ik, jQ, u, Ap, cl, agu, il, cV, jz, aB, P, atm, atl, aX, ckN, et, sm, btp, aai, ckO, ckM, os, Ns, apx, aA, Nu, ckQ); #c1(NOL11) c2(NP_001290201) c3(7570) c4(33684, 46741, 59798, 20627, 72855) c5(aOL); #c1 (NOL3) c2(NP_001263236) c3(7571) c4(33685, 46742, 59799, 20628, 72856) c5(by, b, dB, Ey, U, bu, y, jT, aX, kW, iR, h, f, q, ckS, aC, mR, ff, cs, fH, u, gD, V, aeh, cV, Be, J, gm, jo, T, BW, x, ad, fJ, sK, jH, xM, aeg, P, tl, bq, at, IA); #c1(NOL4) c2(NP_001185475) c3(7572) c4(33686, 46743, 59800, 20629, 72857) c5(re, bb, iT, b, dA); #c1(NOL6) c2(NP_075068) c3(7573) c4(33687, 46744, 59801, 20630, 72858) c5(bq); #c1(NOL8) c2(NP_001243323) c3(7574) c4(33688, 46745, 59802, 20631, 72859) c5(by, b, bu); #c1(NOLC1) c2(NP_001271317) c3(7575) c4(33689, 46746, 59803, 20632, 72860) c5(B, b, aN, Ip, w, U, A, e, y, d, aJL, re, f, q, bu, cB, av, u, o, fU, V, by, T, jT, fp, iT); #c1(NOM1) c2(NP_612409) c3(7576) c4(33690, 46747, 59804, 20633, 72861) c5(bb); #c1(NOMO1) c2(NP_055102) c3(7577) c4(33691, 46748, 59805, 20634, 72862) c5(h, Iv, eu); #c1(NON0) c2(NP_001138881) c3(7578) c4(33692, 46749, 59806, 20635, 72863) c5(fi, aX, V, sg, f, T, U, u); #c1(NOP10) c2(NP_061118) c3(7579) c4(33693, 46750, 59807, 20636, 72864) c5(cjX, cjY, ss); #c1(NOP14) c2(NP_001278908) c3(7580) c4(33694, 46751, 59808, 20637, 72865) c5(ag); #c1(NOP16) c2(NP_001243468) c3(7581) c4(33695, 46752, 59809, 20638, 72866) c5(bm, u, y); #c1(NOP2) c2(NP_001028886) c3(7582) c4(33696, 46753, 59810, 20639, 72867) c5(V, b, ag, Be, nU, qL, T, zO, iv, O, u, y); #c1(NOP56) c2(NP_006383) c3(7583) c4(33697, 46754, 59811, 20640, 72868) c5(kS, bu, alW, n/v, OA, jT, kV); #c1(NOP9) c2(NP_777573) c3(7584) c4(33698, 46755, 59812, 20641, 72869) c5(u); #c1(NOS1AP) c2(NP_001119532) c3(7585) c4(33699, 46756, 59813, 20642, 72870) c5(dx, ak, qd, le, Ey, cO, bf, y, BO, Fp, dv, ckT, f, cM, hj, u, Fg, sz, hW, I, nl, du, MO, n/v, bq, hR, mO, aM, aY, atJ, vH, uG, dc, acb, at, ap); #c1(NOS1) c2(NP_000611) c3(7586) c4(33700, 46757, 59814, 20643, 72871) c5(dx, IJ, f, Fk, dB, vw, w, cO, bf, e, O, vr, dv, cy, zo, gU, mR, bOr, Qx, oN, n, g, Ew, HX, aC, bK, du, bp, KK, cV, ckU, bzu, jv, pb, qt, akn, aqw, eW, ag, cT, bk, fD, dc, aA, bP, ux, aPm, vD, jz, bdj, bNE, xZ, IW, ai, xw, io, cM, hi, Ov, DM, ak, B, aaR, oD, fy, pP, fY, fi, ae, gv, MW, sw, ar, cK, bd, pi, dP, aY, ahq, jd, ap, b, aF, wa, bBv, dk, qa, wv, MY, ey, gZ, eV, d, bb, MX, bjQ, vf, ciR, ff, cbS, sK, u, dh, o, fh, I, cz, xq, aGn, rB, vX, JJ, ckV, bPT, jH, ao, rQ, ch, aE, Ou, HV, I, vZ, xa, acE, lb, A, di, HS, wf, bj, jQ, m, qs, aX, ty, sG, h, bWm, iZ, y, aV, dj, ma, hW, oS, be, J, P, ti, T, aez, jl, aCB, aM, to, jT, nk, bzy, DI, jN, bh, at, eG, rb); #c1(NOS2) c2(NP_000616) c3(7587) c4(33701, 46758, 59815, 20644, 72872) c5(dx, gK, IJ, en, pV, Fk, dN, bx, F, bao, MW, iU, vB, Ka, eW, sJ, j, hM, bzL, cO, aw, adL, rF, aK, fx, dv, cy, aAo, oS, ahq, wd, vh, gB, e, Pn, dl, hG, mR, jU, bOr, JF, aez, gl, R, g, pb, Oe, og, cB, jH, aC, bK, sH, du, is, QC, gY, yi, fl, Re, GI, cV, x, aqg, hR, kN, pq, Ew, aml, gE, gs, sS, bm, wK, Ox, DO, bY, tO, cT, bk, i, dc, bq, aA, NO, bT, bP, bPT, wa, fl, td, aPm, He, vD, jz, fy, mE, Kc, ig, ix, sF, xZ, vp, U, zX, cM, co, Ov, ip, OH, ml, f, sR, aG, tv, aaZ, B, cs, iJ, av, aVt, pP, aFZ, yJ, fi, zl, V, ae, Bs, Fv, n, cd, gv, IR, Io, eX, ny, ar, qX, gC, qH, pi, bu, PJ, JY, qW, aH, ckW, aY, aGx, P, fw, xe, vH, cz, eF, TQ, aDI, bsh, bp, vL, ll, gG, b, LX, aF, ak, MU, aDD, bg, dk, A, z, ey, pi, d, wZ, bb, kW, eA, jd, gz, CR, g, zx, akP, X, ciR, ff, aJ, Dq, dQ, xd, u, aE, ri, aZ, da, sz, I, im, kt, atr, gL, ad, BZ, IX, Ki, aDU, rB, et, et, ckV, gt, aUd, bdj, ao, eV, iC, ch, eQ, hT, aZP, Qx, aZO, IS, zO, VT, I, Mp, TP, cK, C, bL, er, bf, gU, xa, Sc, ciK, IW, wR, gn, gN, IY, axA, jc, di, Iv, nl, eM, wf, al, bj, JK, aW, jQ, m, qs, o, aX, sG, h, wN, ik, y, pN, qB, fP, aV, jZ, aXH, Ou, ma, hW, ez, ap, afx, hZ, be, dB, J, fh, jo, ti, T, aox, Oi, aDA, jl, Yl, aM, xg, jT, ce, zE, bzy, fD, Ic, eD, by, DI, auy, pZ, rw, bh, at, eG, DM, rb, gl); #c1(NOS3) c2(NP_000594) c3(7588) c4(33702, 46759, 59816, 20645, 72873) c5(mI, dD, vB, hM, cp, vr, LL, hu, dl, om, mR, wY, asa, mz, xc, aC, ME, pb, HC, tO, bk, fD, bq, aA, ug, X, vD, sF, iG, ho, cM, hi, fm, sr, rr, ak, av, fy, wK, V, ae, cd, IR, uu, bNE, xd, aY, bWJ, apU, aG, acA, vY, pi, tg, aE, da, sX, be, gL, um, wL, rB, uf, ao, mA, yr, Ns, bxm, aED, xh, xa, gE, PI, jw, m, cr, or, wF, tP, bd, bR, ckX, Ic, ckZ, fP, tM, dM, tC, ud, sA, eH, bf, O, at, bQ, va, gB, og, aRh, du, bp, GI, gt, dS, mx, Fv, bT, bP, wa, fl, iP, dj, ve, mk, ix, cA, U, f, md, bu, wH, Bs, gv, Hh, qH, aH, tm, Ig, am, wn, z, bb, eA, jd, q, QX, CO, mL, o, fh, tw, kF, dK, aPe, aZ, ckY, ch, gd, HV, Xm, lb, k, JC, eO, wN, Gs, aq, ez, nQ, tp, sj, sB, gV, T, axk, eN, ii, hq, gf, dx, IJ, eX, dN, sE, Ka, eW, eD, jU, aD, g, ha, vc, aip, fx, hR, aDb, akn, bmX, bez, aEq, TM, bW, ai, uD, na, mI, B, yJ, le, GI, v, aR, bjQ, dO, fw, uK, iu, b, aF, bg, tG, clb, ZR, vf, bjU, gh, ri, aBh, aNu, NT, wp, IX, et, US, hU, bmt, IS, xf, vg, iC, wf, vH, qs, LS, sG, ayB, Aq, tF, ik, wb, aaJ, ti, jl, aM, Y, acK, ajv, cgD, aPd, ap, eG, gK, IK, eC, sJ, tH, cO, cla, gO, dv, cy, t, wv, tE, gl, sH, gs, xO, ro, os, we, i, dc, Nn, gk, td, Zx, IW, Co, y, ed, mm, DF, bm, adL, fz, Ih, cK, er, gO, aaW, uS, ia, vh, eR, id, yU, sU, xg, MY, ey, gZ, mQ, aO, bX, ar, VM, u, wR, PJ, sQ, I, im, by, G, aAB, vw, bPT, eQ, aJy, dh, I, bL, A, di, gc, bj, oy, aX, F, qr, aV, ma, si, acu, P, j, aj, gF, sK, Nq, agc, bh, ahZ, LQ); #c1(NOSIP) c2(NP_057037) c3(7589) c4(33703, 46760, 59817, 20646, 72874) c5(yq, DJ); #c1(NOSTRIN) c2(NP_001034813) c3(7590) c4(33704, 46761, 59818, 20647, 72875) c5(bh, cz, bb, gv); #c1(NOTCH1) c2(NP_060087) c3(7591) c4(33705, 46762, 59819, 20648, 72876) c5(akQ, B, aw, Zy, gG, Ip, aJT, w, bV, bW, adr, e, O, vr, zi, aEa, t, fp, jU, fH, g, og, jH, aC, bK, cs, gm, bp, ft, ed, x, fx, hR, mm, su, bgc, jE, BX, fc, ie, ag, cT, fD, pt, yC, X, Dv, iP, jz, eu, wy, bw, U, y, co, ip, pz, f, N, bu, bE, k, iv, av, fy, bm, iT, V, afz, ny, Fr, iA, fJ, sP, JY, qW, gt, anG, arJ, bzM, jR, tl, oM, apT, b, jq, Dm, m, ic, jC, BQ, d, jh, ra, jd, re, hV, q, jV, QE, ar, RF, VM, oO, jG, u, amO, da, acH, I, qL, acv, ad, as, G, sf, ew, baG, Mw, et, cld, clc, VH, wV, nV, afT, cC, wP, o, yA, uE, bL, A, vd, fr, pR, gw, Iv, CT, nT, jQ, pA, c, aX, il, fq, h, F, cU, Gs, rR, aV, fU, gR, cV, an, J, W, T, fO, ji, cr, nP, by, AP, jT, qp, pp, Yv, IG, ja, rb); #c1(NOTCH2) c2(XP_011539821) c3(7592) c4(33706, 46763, 59820, 20649, 72877) c5(EO, bL, gB, ale, b, k, iP, BY, w, ew, Ni, iG, O, bf, U, jR, bKi, y, cp, jh, jT, Os, jd, fq, h, hV, q, bu, hN, ar, RF, cle, WF, JY, u, akd, iT, g, gG, acH, V, I, cV, elf, hZ, sH, be, Fs, gm, bp, J, wV, bLu, P, bgg, ji, nP, by, aM, iw, wh, nV, da, os, wP, cT, qP, ew, aA, zD, re, ap); #c1(NOTCH3) c2(NP_000426) c3(7593) c4(33707, 46764, 59821, 20650, 72878) c5(B, aw, dN, dB, sA, w, cO, bW, e, O, t, gB, cI, cc, og, wo, bp, ME, aip, hR, aL, abS, fy, ie, cT, xb, ahp, aA, EO, id, wK, X, ve, IW, bw, y, co, mI, f, vQ, clg, oD, av, JD, iT, iF, V, v, gv, IR, bq, clj, fw, VE, ap, b, bg, fl, BQ, aO, d, jh, bb, kW, re, vf, q, ar, u, dh, acv, IX, G, QI, baG, et, uf, ao, agQ, hT, aJy, aE, IS, OI, Au, di, bL, A, adK, vZ, Iv, MT, aX, Tq, sG, clh, aV, HI, cV, J, dt, T, fO, ME, cli, bh, at); #c1(NOTCH4) c2(NP_004548) c3(7594) c4(33708, 46765, 59822, 20651, 72879) c5(mZ, fl, nr, cY, aF, gE, aby, ns, BY, nm, nt, ng, kY, nn, PI, no, np, BQ, aW, m, aX, sG, ak, q, vQ, cU, aaZ, y, iv, bw, gg, aV, u, aE, pW, da, dj, aC, J, j, gv, T, Ca, cy, iA, O, jH, wV, nV, tW, wP, o, bh, iu, rb); #c1(NOTUM) c2(NP_848588) c3(7595) c4(33709, 46766, 59823, 20652, 72880) c5(g); #c1 (NOVA1) c2(NP_002506) c3(7596) c4(33710, 46767, 59824, 20653, 72881) c5(oy, ak, afx, bK, akH, alF, clk, O, ap); #c1(NOVA2) c2(NP_002507) c3(7597) c4(33711, 46768, 59825, 20654, 72882) c5(bL, by, f, b, bx, X, uC, dB, qP, mk, qa, di, Uq, O, cA, U, xw, cM, at, qs, bQ, bb, t, re, cll, bu, aFA, ar, y, bK, hV, av, aOB, u, o, oJ, hW, V, cV, BC, pF, aza, J, cz, W, Js, T, aDA, cy, Pk, et, elm, wh, nV, aY, clk, aq, G, UW, ih, Gn, w, fP, iT, fz, dc, I, aA, RB, oT); #c1(NOV) c2(NP_002505) c3(7598) c4(33712, 46769, 59826, 20655, 72883) c5(fr, A, b, k, cY, dB, kB, w, bf, vp, fx, y, gO, oy, BO, aX, jk, h, B, es, cU, X, O, bw, av, aV, u, cl, fe, sH, ft, iA, et, jG, aM, hU, eQ, Le, ag, XH, i, bOO); #c1(NOX1) c2(NP_001258744) c3(7599) c4(33713, 46770, 59827, 20656, 72884) c5(dx, bL, wa, A, b, cY, aF, dD, BY, w, di, cO, U, aX, mI, f, CK, ar, B, cs, OA, u, RG, V, I, sH, du, J, ad, W, P, T, ji, x, YY, kN, jU, xd, fn, bh, aG); #c1(NOX3) c2(NP_056533) c3(7600) c4(33714, 46771, 59828, 20657, 72885) c5(nk, cy, t, fP, P, di, bw); #c1(NOX4) c2(NP_001137308) c3(7601) c4(33715, 46772, 59829, 20658, 72886) c5(bL, hV, bW, b, k, cY, IW, dB, O, w, di, cO, bf, ey, Co, sx, y, cp, hh, co, aX, dN, kJ, f, F, q, cy, X, fv, ff, cs, bw, gg, xd, u, dh, LK, fi, ma, jE, I, LR, J, ad, bm, IX, P, x, bb, aM, ao, gE, dS, ch, bY, aE, ag, fD, bh, at, ap); #c1(NOX5) c2(NP_001171708) c3(76D2) c4(33716, 46773, 59830, 20659, 72887) c5(bP, dx, B, b, w, id, cO, bf, A, dv, f, ar, me, du, gJ, P, co, bq, hR, et, aM, py, acw, fn, dn, di, at); #c1(NOXA1) c2(NP_001242997) c3(7603) c4(33717, 46774, 59831, 20660, 72888) c5(dx, bL, f, b, du, ad, dv, ar, cs); #c1(NOX01) c2(NP_653204) c3(7604) c4(33718, 46775, 59832, 20661, 72889) c5(aaa, f, bvW, bu, ar, YY); #c1(NPAP1) c2(NP_061831) c3(7605) c4(33719, 46776, 59833, 20662, 72890) c5(agw, aX, rv); #c1(NPAS2) c2(NP_002509) c3(7606) c4(33720, 46777, 59834, 20663, 72891) c5(eJ, oC, A, jv, b, aQf, ak, B, eX, aY, w, jT, y, jl, cz, u, tQ); #c1(NPAS3) c2(NP_001158221) c3(7607) c4(33721, 46778, 59835, 20664, 72892) c5(ak, hW, aai, k, vu, nU, xJ, he, w, jN, cA, O); #c1(NPAS4) c2(NP_849195) c3(7608) c4(33722, 46779, 59836, 20665, 72893) c5(HN, cV); #c1 (NPAT) c2(NP_002510) c3(7609) c4(33723, 46780, 59837, 20666, 72894) c5(re, Wh, cT, i, fH, fJ, iT, cq); #c1(NPB) c2(NP_683694) c3(7610) c4(33724, 46781, 59838, 20667, 72895) c5(dC, cln, kF, eZ); #c1(NPBWR1) c2(NP_005276) c3(7611) c4(33725, 46782, 59839, 20668, 72896) c5(ao, A, aw, Y, B, bf); #c1(NPC1) c2(NP_000262) c3(7612) c4(33726, 46783, 59840, 20669, 72897) c5(dx, acE, by, b, LF, rT, rd, mk, akR, w, di, z, ai, U, xl, cln, jl, eZ, clp, dL, AX, f, bu, ky, awd, ar, o, O, bDd, V, I, bK, du, LG, fO, v, P, co, T, II, Nh, qx, clo, pi, fM, pq, anO, aVR, eT, HN, AB, ep, aof, fN, bh, aA, at, Wo, ap); #c1(NPCIL1) c2(NP_001095118) c3(7613) c4(33727, 46784, 59841, 20670, 72898) c5(hR, ka, ch, dD, dE, eH, aah, bf, aA, at, ZT); #c1(NPC2) c2(NP_006423) c3(7614) c4(33728, 46785, 59842, 20671, 72899) c5(Dr, acE, b, dB, ai, aX, eZ, hV, v, bm, o, em, og, I, LG, gv, dt, aYf, jl, gF, clo, ac, jE, nV, u, aDH, ep, bh); #c1(NPDC1) c2(NP_056207) c3(7615) c4(33729, 46786, 59843, 20672, 72900) c5(u); #c1(NPEPL1) c2(NP_001191801) c3(7616) c4(33730, 46787, 59844, 20673, 72901) c5(u, y); #c1(NPEPPS) c2(NP_006301) c3(7617) c4(33731, 46788, 59845, 20674, 72902) c5(A, JH, b, X, Hk, eu, aw, y, B, WO, ar, Up, pN, HE, av, sh, da, hb, Mi, T, Fr, jU, u, ih, ag, fl); #c1(NPFF) c2(NP_003708) c3(7618) c4(33732, 46789, 59846, 20675, 72903) c5(hn, cV); #c1(NPFFR2) c2(NP_001138228) c3(7619) c4(33733, 46790, 59847, 20676, 72904) c5(aA, at, cV); #c1(NPHP1) c2(NP_000263) c3(7620) c4(33734, 46791, 59848, 20677, 72905) c5(bP, xc, vR, fD, nQ, wd, nU, vU, SE, bln, vo, aLg, wt, KQ, GV, TD, et, SD, aW); #c1(NPHP3) c2(NP_694972) c3(7621) c4(33735, 46792, 59849, 20678, 72906) c5(clq, bP, xc, aCg, fD, nQ, nW, vU, bKw, bTd, aLg, Nz, wt, CI, clr, aA, SD); #c1(NPHP4) c2(NP_001278522) c3(7622) c4(33736, 46793, 59850, 20679, 72907) c5(cr, cls, nW, vU, aLg, Nx, clt, clu, et, SD); #c1(NPHS1) c2(NP_004637) c3(7623) c4(33737, 46794, 59851, 20680, 72908) c5(bP, fl, td, gw, BP, eC, vR, di, sU, aw, ey, KY, fe, wd, f, aE, fY, te, Ad, wB, I, clv, sH, bd, dt, vw, PZ, et, aFd, hU, fD, vJ, xf, he); #c1(NPHS2) c2(NP_001284504) c3(7624) c4(33738, 46795, 59852, 20681, 72909) c5(bP, dx, dM, td, eC, wn, fe, di, sU, agy, vp, aeH, gO, dv, wd, vG, aLV, bf, aE, te, Ad, wB, du, bd, dt, P, vw, PZ, hR, et, aw, aM, aFd, pk, UW, acQ, EI, fl, fD, vJ, al at, he); #c1(NPL) c2(NP_001186979) c3(7625) c4(33739, 46796, 59853, 20682, 72910) c5(A, b, jJ, tR, ns, nm, nt, ak, nr, nn, wX, no, np, U, KH, fq, B, vu, fP, aE, V, arH, SU, ti, jH, he, fl, di, ng); #c1(NPLOC4) c2(NP_060391) c3(7626) c4(33740, 46797, 59854, 20683, 72911) c5(X); #c1(NPM1) c2(NP_001032827) c3(7627) c4(33741, 46798, 59855, 20684, 72912) c5(en, aw, dB, w, pz, e, M, bvN, t, yh, dl, fH, bEx, fe, lb, cs, po, fO, cV, fx, jT, jE, ag, cT, i, pt, bvJ, eu, U, y, co, pp, f, N, bu, iv, fy, bm, cj, V, FK, hf, WL, iA, fJ, dY, gR, ej, ci, TA, b, jL, ic, d, Tp, q, jV, Tr, jG, u, by, as, G, yG, bFJ, Dj, fg, aff, A, fr, Ld, jl, Qm, h, cU, n, cB, IP, an, J, gm, W, P, QI, T, bp, oM, ad, pc, UE, bh); #c1(NPM2) c2(NP_001273610) c3(7628) c4(33742, 46799, 59856, 20685, 72913) c5(h, u, J); #c1 (NPNT) c2(NP_001028219) c3(7629) c4(33743, 46800, 59857, 20686, 72914) c5(aX, aZ, I, DF, u, y); #c1(NPPC) c2(NP_077720) c3(7630) c4(33744, 46801, 59858, 20687, 72915) c5(dx, A, dN, sO, aNU, rU, di, cO, cM, dv, cy, sT, bBf, f, k, aRv, o, sz, GS, hW, Bs, du, Fs, bd, iD, hR, et, su, aY, Ic, yE, xr, dc, bq, at, ap); #c1(NPR1) c2(NP_000897) c3(7631) c4(33745, 46802, 59859, 20688, 72916) c5(A, b, X, vY, di, cO, jh, qs, aX, B, hG, vE, av, fY, I, sH, P, hR, et, tO, bq, aA, at, ap); #c1(NPR2) c2(NP_003986) c3(7632) c4(33746, 46803, 59860, 20689, 72917) c5(rM, W, qs, mI, bb, I, b, rU, pD, fw, bBk, yE, di, adp, cO, bBf, ap); #c1(NPR3) c2(NP_000899) c3(7633) c4(33747, 46804, 59861, 20690, 72918) c5(qs, A, hW, Bs, jR, cy, uK, di, jU, cO, wf, bb, aA, at, aO, ap); #c1(NPRL2) c2(NP_006536) c3(7634) c4(33748, 46805, 59862, 20691, 72919) c5(d, W, rU, mI, re, bp, bBk, yE, co, ar, cO, fy, bBf, e); #c1(NPRL3)

c2(NP_001034565) c3(7635) c4(33749, 46806, 59863, 20692, 72920) c5(Fh, Ck, jR); #c1(NPS) c2(NP_001025184) c3(7636) c4(33750, 46807, 59864, 20693, 72921) c5(abu, cy, f, b, pG, gz, xk, tR, ih, IX, dd, fy, IW, wX, Co); #c1(NPSR1) c2(NP_001287863) c3(7637) c4(33751, 46808, 59865, 20694, 72922) c5(abu, tR, aIV, Kc, wX, Jx, cy, fq, DM, f, clw, vu, JF, qu, aCH, da, baH, aC, aD, ti, aqt, aZ, qe, jH, nk, dP, ih, Ai, DI, fP, gz, gf); #c1(NPTN) c2(NP_001154835) c3(7638) c4(33752, 46809, 59866, 20695, 72923) c5(bnS, Hk, pn, di, at, u, y); #c1(NPTX1) c2(NP_002513) c3(7639) c4(33753, 46810, 59867, 20696, 72924) c5(re, fU, V, iT); #c1(NPTX2) c2(NP_002514) c3(7640) c4(33754, 46811, 59868, 20697, 72925) c5(ake, clx, b, w, bw, bj, O, fC, kW, kJ, mR, adQ, nR, bgS, nl, nW, cM, cz, awT, T, bgQ, akc, sK, os, ag); #c1(NPTXR) c2(NP_055108) c3(7641) c4(33755, 46812, 59869, 20698, 72926) c5(fh, fU, mI, b, cO); #c1(NPVF) c2(NP_071433) c3(7642) c4(33756, 46813, 59870, 20699, 72927) c5(bw, di, dA); #c1(NPW) c2(NP_001092926) c3(7643) c4(33757, 46814, 59871, 20700, 72928) c5(gd, auy, cly, cy); #c1 (NPYIR) c2(NP_000900) c3(7644) c4(33758, 46815, 59872, 20701, 72929) c5(to, ih, A, bb, I, cV, Bs, f, iZ, z, hS, vS, xq, dd, aWt, dc, di, aA, ap, Gn); #c1(NPY2R) c2(NP_000901) c3(7645) c4(33759, 46816, 59873, 20702, 72930) c5(rd, hS, dd, cA, y, oy, Wj, rh, iZ, dh, o, Yk, dj, si, I, cV, gs, TD, ih, jd, di, aA, Gn); #c1(NPY5R) c2(XP_011530316) c3(7646) c4(33760, 46817, 59874, 20703, 72931) c5(wX, si, aqQ, I, eX, jJ, tR, ih, jm, dd, Jj, z, bf, aA, aM, u, gF, y, Gn); #c1(NPY) c2(NP_000896) c3(7647) c4(33761, 46818, 59875, 20704, 72932) c5(dx, B, aw, aeB, dD, dB, aE, eH, w, dd, cO, bf, e, O, at, dv, cy, rh, aQd, IV, oN, g, fe, sH, du, Gl, jv, tO, clA, ag, fD, dc, bq, aA, bP, fl, vD, rd, hS, wX, cA, hW, OJ, cM, TC, bYc, yE, mI, f, Go, iv, fi, dA, cx, v, eX, VP, zf, clz, dO, aY, fw, cIB, yq, Gn, aG, b, Ey, vY, qa, ey, aO, d, bb, TQ, es, ff, Gj, aM, u, dh, o, fh, I, hv, xq, wx, wW, Kc, Tv, he, TD, ih, rv, Iv, QU, bL, A, azm, k, tR, di, akD, wf, oy, qs, Wj, jl, fq, hB, blh, M, iZ, y, pN, RB, dj, si, aeh, cV, Fs, J, T, gF, ac, Sp, to, qp, jN, ap, Jj); #c1(NQO1) c2(NP_000894) c3(7648) c4(33762, 46819, 59876, 20705, 72933) c5(dx, B, pV, aZ, Gm, gG, dB, Ip, w, cO, aw, e, O, IH, dv, cy, b, t, gB, dl, fH, Zv, oP, g, og, du, bp, Re, GI, x, fx, hR, BX, fc, bm, os, ag, cT, i, fN, bq, aA, Dr, X, iP, sF, bf, cA, bw, U, y, co, ip, f, N, cs, bu, Be, Mp, iv, av, fy, hD, iT, jM, jB, ali, V, fl, IT, aJV, bt, Fr, qD, JY, GB, py, gA, tl, ji, qh, ci, ap, afE, ny, am, aF, z, aoi, ey, aO, cIC, d, jh, bb, re, iW, je, q, fJ, ar, ff, sR, as, fv, jG, u, dh, o, da, il, qL, ad, G, wq, pD, rB, et, jU, cW, jH, nV, ch, GM, aE, dn, HV, I, akX, yA, Gn, GK, lb, A, gN, di, eM, Bz, hP, jx, aX, I, bj, h, F, oE, M, ik, n, qB, aV, dj, fU, cV, an, J, W, jo, ti, T, fO, jl, by, qe, aM, to, VF, jT, Y, Ic, jN, at, eG, ja); #c1(NQO2) c2(NP_001277151) c3(7649) c4(33763, 46820, 59877, 20706, 72934) c5(A, b, X, ajc, bj, y, aX, ag, Qi, f, N, oE, ik, B, cB, ju, av, u, oN, jB, il, cV, ir, bK, J, GI, jE, bm, he, ih, eB, i, Gn); #c1(NROB1) c2(NP_000466) c3(7650) c4(33764, 46821, 59878, 20707, 72935) c5(pM, clF, A, aw, b, fN, cY, cs, clD, aN, wn, BY, di, il, dx, IW, U, bUr, aK, y, bbg, c, dv, I, pp, jk, AX, nU, PA, bCS, bgp, es, aDx, agd, ik, B, bbu, ar, u, da, iF, fe, bo, V, nQ, jH, lb, clE, aiU, du, j, ad, cIG, T, Ga, ji, Hh, iA, Dd, yA, jU, iz, bgu, W, US, jV, wp, UZ, OW, UR, QG, yD, UW, bgr, yE, bO, XH, fl, I, UT, aA, jj, mI, afm, ap); #c1(NRID1) c2(NP_068370) c3(7651) c4(33765, 46822, 59879, 20708, 72936) c5(dx, ak, b, aQf, ns, nm, nt, nq, nr, nn, no, np, y, cy, mI, hV, jV, X, av, u, tQ, dj, nQ, qL, du, bfP, nV, aY); #c1(NRID2) c2(NP_005117) c3(7652) c4(33766, 46823, 59880, 20709, 72937) c5(b, vQ, gv, bh, al, eG); #c1(NRIH2) c2(NP_001243576) c3(7653) c4(33767, 46824, 59881, 20710, 72938) c5(dx, GD, A, aw, b, X, dB, hS, aBx, Lq, U, fx, y, d, gB, co, aX, il, zn, f, q, e, cU, ik, B, Lf, cs, n, av, fy, u, o, rR, QD, V, I, du, v, J, T, jl, iA, ad, yA, VF, bnG, aYm, py, Dj, i, aA, at); #c1(NRIH3) c2(NP_001123573) c3(7654) c4(33768, 46825, 59882, 20711, 72939) c5(dx, bL, gB, fr, dD, au, di, A, BM, jl, h, f, UV, az, B, da, em, V, I, du, ft, P, dv, eX, dL, dS, fN, aA, at); #c1(NRIH4) c2(NP_001193907) c3(7655) c4(33769, 46826, 59883, 20712, 72940) c5(dx, bm, gB, b, ka, IM, eH, au, di, iL, z, Jx, e, aO, d, bb, Oi, vC, f, q, az, ar, u, o, jH, gD, em, ali, I, Vc, Be, du, v, gL, JT, P, II, Qt, gA, Mp, jU, xd, rd, KK, py, fc, ch, ag, cT, gu, fP, i, fN, I, bh, aA, at, bca); #c1(NRI12) c2(NP_071285) c3(7656) c4(33770, 46827, 59884, 20713, 72941) c5(dx, by, en, aw, dN, sE, dB, vB, w, hM, cO, bf, fx, O, cp, dv, cy, all, gB, e, cl, zR, gl, gD, gG, ajc, aC, du, fO, bp, ft, x, gx, jT, dL, gg, pb, BX, sS, fN, bdB, ag, cT, bk, i, bq, aA, bT, AI, fi, cY, fE, Fm, eu, mk, IW, bw, U, Co, y, co, fm, ip, rr, B, bu, ky, cs, av, bm, em, auU, V, NZ, Dp, eX, ny, gC, iA, xd, nb, P, add, gA, JO, ap, adJ, bt, b, aF, MS, oi, yU, ic, z, Mr, d, jh, re, q, yp, X, ar, ff, hb, aaP, u, dh, o, da, I, TK, LR, dT, ad, IX, agl, aZ, jU, iw, hS, he, gd, rv, I, aZU, Mp, Pp, A, fr, bbU, pR, sv, mW, bqc, dn, iL, al, sx, m, aX, wp, fq, amK, F, cU, hN, ik, aV, jH, cV, be, J, jo, T, II, Pk, aM, Ic, gu, fP, bh, at, eG, h); #c1(NRI13) c2(NP_001070937) c3(7657) c4(33771, 46828, 59885, 20714, 72942) c5(A, MZ, b, k, X, aF, eu, hM, O, bf, U, gF, y, gB, it, aX, pp, Qe, h, B, q, jF, hN, mR, Pm, cs, av, u, o, gD, fx, V, I, cV, aC, J, fO, ad, W, P, T, II, mY, jT, iw, qt, gt, bm, Ic, eX, cT, i, fl, Oi, aA); #c1(NR2C1) c2(NP_001027458) c3(7658) c4(33772, 46829, 59886, 20715, 72943) c5(A, eG, B); #c1(NR2C2) c2(NP_001278623) c3(7659) c4(33773, 46830, 59887, 20716, 72944) c5(bm, A, b, sO, bsC, LM, cbO, y, co, aX, h, B, q, X, jU, av, u, aNN, fe, J, ad, T, fx, su, bsA, mb, Nq, ag, i, bjF, eG); #c1(NR2E1) c2(NP_001273031) c3(7660) c4(33774, 46831, 59888, 20717, 72945) c5(g, d, hW, ak, QZ, et, e, FY); #c1(NR2E3) c2(NP_055064) c3(7661) c4(33775, 46832, 59889, 20718, 72946) c5(clK, b, aw, ayr, nQ, clJ, mI, bFr, ea, cIL, ell, y, yn, clH, nE, nR, u, nW, aW); #c1(NR2F1) c2(NP_005645) c3(7662) c4(33776, 46833, 59890, 20719, 72947) c5(A, b, X, di, U, y, cr, nU, vQ, oJ, cIM, aV, u, awS, V, sH, W, T, av, wh, B, gA); #c1(NR2F2) c2(NP_001138627) c3(7663) c4(33777, 46834, 59891, 20720, 72948) c5(dx, aNi, A, aw, b, fi, X, cs, fe, di, bw, U, y, co, cr, pp, nU, wN, q, bKA, fv, B, iv, av, aV, u, aE, awS, BS, du, V, I, Be, oJ, BT, J, fO, ad, P, dv, T, aAE, wh, bm, ag, aC, at, eG); #c1(NR2FG) c2(NP_005225) c3(7664) c4(33778, 46835, 59892, 20721, 72949) c5(V, b, u, ad, cs, U, eG); #c1(NR3C1) c2(NP_001018085) c3(7665) c4(33779, 46836, 59893, 20722, 72950) c5(dx, by, ak, aw, aeB, dD, dB, aqt, ns, sJ, nm, dd, nq, nr, nn, bf, no, np, adr, oU, O, cp, bQ, cy, iR, qc, t, gB, e, Kg, Pn, ia, hi, tU, yG, gl, cc, mz, vO, aqQ, vN, ajy, afh, fO, bp, gY, vc, GI, re, fx, jT, xx, iz, gs, dS, ie, jZ, yE, xr, pv, bk, i, UJ, nt, aA, rn, cIR, iF, X, cO, jf, rd, mk, mA, kY, cA, xU, cM, co, DG, pz, mI, f, cT, bu, Em, B, cs, IL, av, fy, bm, QO, em, V, dc, IM, cx, bd, Hq, eX, bq, VP, zf, vF, aAE, W, du, wp, OW, aY, er, fw, sh, JO, qO, clQ, bPt, Xt, fD, ap, b, aF, eR, Ey, m, Fq, yU, sU, tG, xg, gZ, gF, d, wZ, bkO, bb, jd, q, Cu, pn, vu, dQ, tg, oO, ar, Uq, aM, u, nj, aVS, fh, clQ, kF, hb, I, bLX, aVY, gL, ad, G, wq, aZ, cfp, afj, Ha, jH, axG, ig, pY, DR, DM, he, pa, ih, gd, agf, OI, fl, I, OS, hd, cIN, A, pF, TQ, fr, pR, Ik, aOv, di, vg, bZQ, fs, Bz, dl, cf, oy, c, qs, jl, il, wr, qr, oE, aC, amH, iZ, ik, y, Mi, aV, Ry, dj, fU, hW, cV, J, sC, dt, P, T, II, aDA, Bb, ft, qT, cIP, DI, fP, agc, iB, at, eG, gf, hz); #c1(NR3C2) c2(NP_000892) c3(7666) c4(33780, 46837, 59894, 20723, 72951) c5(dx, f, aw, dN, IA, dB, aqt, cO, gO, dv, mR, mz, sH, iv, gJ, IL, fx, hR, mm, cIS, cT, Fq, i, dc, bq, aA, eQ, rn, sU, bP, gk, clU, aic, cA, U, cM, ed, ak, cs, vE, hj, V, dA, eX, cK, aY, Fu, cf, fw, jP, ap, b, bLL, qa, cIT, Gx, gZ, aO, bb, mL, jG, u, dh, Fw, ad, n/v, et, et, DR, ih, hd, bL, aOv, cIV, di, C, sx, qs, aV, dj, du, hW, Nc, sB, dt, T, bh, eG); #c1(NR4A1) c2(NP_001189162) c3(7667) c4(33781, 46838, 59895, 20724, 72952) c5(dx, bL, by, hV, b, jE, cs, eu, A, ak, iL, aic, ajw, bw, U, e, y, d, co, aX, h, f, q, bu, ra, do, jT, B, iv, aDp, aV, u, oJ, g, em, V, I, aC, du, dB, gm, bp, J, dv, T, x, ad, lb, wh, bm, Ic, ag, cT, aA, at, eG); #c1(NR4A2) c2(NP_006177) c3(7668) c4(33782, 46839, 59896, 20725, 72953) c5(jp, ak, b, acE, jj, aqs, bg, mk, aWt, Dy, cA, U, bj, y, co, aX, f, q, bu, ar, oJ, cs, mm, aV, u, da, Pz, V, cV, aC, be, ad, W, GR, iN, by, JY, Ew, wh, Ty, fc, Ic, HN, PB, xe, agw, i, aA, gl, ap); #c1(NR4A3) c2(NP_008912) c3(7669) c4(33783, 46840, 59897, 20726, 72954) c5(bP, dx, ak, b, GL, dD, aiW, dB, eR, Nq, kB, A, di, atV, bf, aO, aDW, aNH, qs, dv, aX, ajn, vR, clW, Qu, f, q, yx, M, y, n, yW, fy, u, aE, oJ, pw, du, aHM, I, B, aC, LR, J, Zr, Dp, IR, IX, T, cV, Gg, cy, D, aM, wh, Lc, aai, hS, MP, Ns, h, cT, xK, IS, NA, iB, yk, aA, ci, QV); #c1(NR5A1) c2(NP_004950) c3(7670) c4(33784, 46841, 59898, 20727, 72955) c5(PG, aw, b, afg, X, jj, wy, wn, fe, bf, bbz, bUr, jw, cM, yy, Hq, am, UZ, jk, Nl, asU, agd, clY, O, Ls, av, bfn, UR, em, NT, I, bbu, Fw, J, W, PS, QI, T, UL, clX, iA, Ap, PH, aM, bgu, wp, aY, iz, ih, yE, bO, dc, asT, UT, aA, eG, Lp); #c1(NR5A2) c2(NP_001263393) c3(7671) c4(33785, 46842, 59899, 20728, 72956) c5(00, b, iL, bw, y, cp, yg, ja, f, LI, bu, M, cs, jG, u, cV, qL, J, ad, aiL, Qt, iA, fp, jH, ag, fP); #c1(NRGA1) c2(NP_001265475) c3(7672) c4(33786, 46843, 59900, 20729, 72957) c5(d, wV, A, b, B, Nq, Ns, e, wP, kM, sf, od, u, fp, y); #c1(NRAP) c2(NP_006166) c3(7673) c4(33787, 46844, 59901, 20730, 72958) c5(cK acg, sK); #c1(NRARP) c2(NP_001004354) c3(7674) c4(33788, 46845, 59902, 20731, 72959) c5(g); #c1(NRBP1) c2(XP_005264331) c3(7675) c4(33789, 46846, 59903, 20732, 72960) c5(M, A, B, b); #c1(NRBP2) c2(NP_848659) c3(7676) c4(33790, 46847, 59904, 20733, 72961) c5(asQ); #c1(NRCAM) c2(NP_001032209) c3(7677) c4(33791, 46848, 59905, 20734, 72962) c5(IV, aX, V, aRw, IP, vt, nU, ad, W, aQL, nV, y, cs, x, hW, Gj, cz, u, U, cM, O); #c1(NRD1) c2(XP_011539823) c3(7678) c4(33792, 46849, 59906, 20735, 72963) c5(jh, A, il, cV, Be, aN, T, y, ik, u, o); #c1(NRDE2) c2(NP_060440) c3(7679) c4(33793, 46850, 59907, 20736, 72964) c5(aX, aw, cy); #c1(NREP) c2(NP_001135947) c3(7680) c4(33794, 46851, 59908, 20737, 72965) c5(aC, di, ew, O); #c1(NRF1) c2(NP_001280092) c3(7681) c4(33795, 46852, 59909, 20738, 72966) c5(o, A, I, b, cV, bm, f, MP, cc, KK, B, iL, cO, bf, av, fh, u, y, aM); #c1(NRG1) c2(NP_001153467) c3(7682) c4(33796, 46853, 59910, 20739, 72967) c5(dx, es, oC, ak, clZ, b, X, afY, ahS, QI, vB, ana, qa, ds, Bg, cO, cA, kF, O, gZ, bj, pi, aO, cp, d, qf, co, aX, LI, eA, bw, il, wr, f, e, gT, EM, vu, ar, y, hS, av, aV, u, dh, Fg, jN, yJ, Ew, du, hW, cy, I, sB, bFF, Qz, v, ahO, T, bp, afa, bq, fy, bb, fx, to, ao, nV, rQ, uJ, aY, xM, adu, he, agb, ag, xq, iD, o, i, ji, yq, at, Jj); #c1(NRG2) c2(NP_001171864) c3(7683) c4(33797, 46854, 59911, 20740, 72968) c5(bb, u, qr, y, cG); #c1(NRG3) c2(NP_001010848) c3(7684) c4(33798, 46855, 59912, 20741, 72969) c5(oy, Ew, ali, hW, rQ, ak, ahS, FE, zm, ahO, di, o, cO, bw, cy, xw, u, bq, y); #c1(NRG4) c2(NP_612640) c3(7685) c4(33799, 46856, 59913, 20742, 72970) c5(A, nQ, I, fN, mI, Si, ard, fP, B, i, aA, dL, nW, jU); #c1(NRGN) c2(NP_001119653) c3(7686) c4(33800, 46857, 59914, 20743, 72971) c5(A, yQ, cV, f, he, B, ak, O, cq); #c1(NRIP1) c2(XP_005261122) c3(7687) c4(33801, 46858, 59915, 20744, 72972) c5(b, X, wy, yU, cO, y, cp, am, sG, Kk, ar, cs, av, u, em, dA, aC, ad, hR, dL, fp, jH, fN, bq, eG);

c1(NRIP2) c2(NP_113662) c3(7688) c4(33802, 46859, 59916, 20745, 72973) c5(at); #c1(NRK) c2(NP_940867) c3(7689) c4(33803, 46860, 59917, 20746, 72974) c5(jQ, jz, lv, J); #c1(NRL) c2(XP_011535103) c3(7690) c4(33804, 46861, 59918, 20747, 72975) c5(alM, nQ, ayr, mI, Bt, bFr, emb, cma, cmc, yn, nE, nR, nW); #c1(NRM) c2(NP_001257638) c3(7691) c4(33805, 46862, 59919, 20748, 72976) c5(aC, m, cT); #c1(NRN1) c2(NP_001265639) c3(7692) c4(33806, 46863, 59920, 20749, 72977) c5(KS, xw, ky, fw, b); #c1(NRP1) c2(NP_001019799) c3(7693) c4(33807, 46864, 59921, 20750, 72978) c5(dx, r, dB, aGb, w, e, O, dv, t, aPN, bze, g, aC, iv, Wc, bp, fx, jT, VG, ie, we, ag, cT, bk, i, dc, bq, wa, X, jz, yD, iG, ate, cA, bw, U, cM, tp, co, f, bu, gX, B, cs, aPM, av, fy, bm, yJ, fi, V, ny, YU, hV, du, aY, fw, tl, UT, Ig, b, ia, z, d, aiT, re, Tp, q, ar, fM, Tr, fv, u, dh, acv, pk, ad, Fo, et, aE, A, azm, k, bVA, acH, wf, jQ, aX, LI, h, M, Cz, ik, y, fU, gR, cV, aza, J, gV, P, T, by, ac, qp, Nu, G, Oi, eG); #c1(NRP2) c2(NP_003863) c3(7694) c4(33808, 46865, 59922, 20751, 72979) c5(wa, A, JC, b, zh, pR, dB, hS, yD, w, kY, O, bw, U, hP, VJ, y, co, aX, wd, h, f, LI, Ct, M, apP, ar, B, cs, fv, av, u, adQ, yJ, V, bp, ad, Fo, T, vw, fx, cz, et, iG, bun, jR, Cr, i, UT, aA); #c1(NRSN1) c2(NP_542454) c3(7695) c4(33809, 46866, 59923, 20752, 72980) c5(en, kE, Pv, jz, EN, Iv, iL, zL, jD, jQ, jl, yQ, re, CR, aEU, cs, iT, dj, hW, SV, ae, cV, kt, J, P, II, Oa, alg, aEN); #c1(NRSN2) c2(NP_079234) c3(7696) c4(33810, 46867, 59924, 20753, 72981) c5(aal); #c1(NRTN) c2(XP_011526343) c3(7697) c4(33811, 46868, 59925, 20754, 72982) c5(qW, ak, Jy, aJm, aJI, cmd, Y, ahS, v, Qz, ag, ahO, ds, bj); #c1(NRXN1) c2(NP_001129131) c3(7698) c4(33812, 46869, 59926, 20755, 72983) c5(aua, WW, aQR, hS, ak, ahk, cM, oy, S, emf, nU, zb, CG, Yk, ma, hW, KH, aC, dc, cz, KE, AP, rQ, aQT, aY, hT, aE, cme, Wk, ahm); #c1(NRXN2) c2(NP_055895) c3(7699) c4(33813, 46870, 59927, 20756, 72984) c5(Wk, rQ, u, bfS, KH); #c1(NRXN3) c2(NP_001098720) c3(7700) c4(33814, 46871, 59928, 20757, 72985) c5(Yk, oC, hT, hW, dA, nU, Nq, cz, W, Ns, rQ, di, aA, iN, ar, Gj, at, iu, IV, O); #c1(NSA2) c2(NP_055701) c3(7701) c4(33815, 46872, 59929, 20758, 72986) c5(l, bf, ey, et, hT, aM); #c1(NSD1) c2(XP_005266018) c3(7702) c4(33816, 46873, 59930, 20759, 72987) c5(b, aua, or, aRw, bbT, h, nU, cz, hS, xr, tm, T, co, qw, Nl, Fh, n, mF, buc, rb, cp); #c1(NSDHL) c2(XP_011529480) c3(7703) c4(33817, 46874, 59931, 20760, 72988) c5(cmg, nU, dt, cgf, bjv, bfe); #c1(NSF) c2(NP_006169) c3(7704) c4(33818, 46875, 59932, 20761, 72989) c5(acE, OG, bdx, hW, cV, bdy, iZ, jT, bj, Wj, jx); #c1(NSFLIC) c2(NP_001193665) c3(7705) c4(33819, 46876, 59933, 20762, 72990) c5(jH, rr, ey, fP, b); #c1(NSG1) c2(NP_001274692) c3(7706) c4(33820, 46877, 59934, 20763, 72991) c5(iA, hV); #c1(NSMAF) c2(NP_001138244) c3(7707) c4(33821, 46878, 59935, 20764, 72992) c5(aX, b, cO); #c1(NSMCE2) c2(NP_775956) c3(7708) c4(33822, 46879, 59936, 20765, 72993) c5(A, bb, lb, f, ix, avF); #c1(NSMF) c2(NP_001124441) c3(7709) c4(33823, 46880, 59937, 20766, 72994) c5(Ag, US, aMW, yD, cmh, Af, T, UT); #c1(NSRP1) c2(NP_001248396) c3(7710) c4(33824, 46881, 59938, 20767, 72995) c5(dB, ff, iv); #c1(NSUN2) c2(NP_001180384) c3(7711) c4(33825, 46882, 59939, 20768, 72996) c5(yK, f, nU, cmi, Eo, bZv, QZ, u, y); #c1(NSUN3) c2(NP_071355) c3(7712) c4(33826, 46883, 59940, 20769, 72997) c5(ji); #c1(NSUN5) c2(NP_001161819) c3(7713) c4(33827, 46884, 59941, 20770, 72998) c5(V, b, ag, Be, qL, T, zO, iv, O, u, y, alM); #c1(NSUN7) c2(NP_078953) c3(7714) c4(33828, 46885, 59942, 20771, 72999) c5(am); #c1(NT5C1B) c2(NP_001002006) c3(7715) c4(33829, 46886, 59943, 20772, 73000) c5(bb, jJ, CH, ap); #c1(NT5C1B-RDH14) c2(NP_001186032) c3(7716) c4(33830, 46887, 59944, 20773, 73001) c5(jJ); #c1(NT5C2) c2(NP_036361) c3(7717) c4(33831, 46888, 59945, 20774, 73002) c5(nX, Kt, b, k, w, di, IW, y, oy, aX, I, pp, uj, t, h, ajo, dl, fy, u, nW, adL, nQ, ui, J, bp, ad, IR, IX, G, sS, DO, cmj, IS, fl, aA); #c1(NT5C3A) c2(NP_001002010) c3(7718) c4(33832, 46889, 59946, 20775, 73003) c5(eX, b, XI, mW, mk, sJ, bf, y, m, I, h, zP, q, pB, NB, u, gl, g, cmk, ae, cV, Xn, byK, aM, GY, ag, Bm, fl, aU, Xe, aHB); #c1(NT5C) c2(NP_001239306) c3(7719) c4(33833, 46890, 59947, 20776, 73004) c5(h); #c1(NT5DC1) c2(NP_689942) c3(7720) c4(33834, 46891, 59948, 20777, 73005) c5(aX); #c1(NT5DC3) c2(NP_001026871) c3(7721) c4(33835, 46892, 59949, 20778, 73006) c5(bw, h, jT); #c1(NT5E) c2(NP_001191742) c3(7722) c4(33836, 46893, 59950, 20779, 73007) c5(gK, aw, b, bx, X, eu, CE, jc, di, y, rY, h, zP, bu, nL, zN, O, Jl, cs, zQ, aV, u, dr, CH, n, is, be, aC, LR, dk, J, ad, P, zS, aX, BV, mm, jU, aOo, jH, of, dy, ig, ch, kj, jR, na, cT, zO, I, aU, ap); #c1(NT5M) c2(NP_064586) c3(7723) c4(33837, 46894, 59951, 20780, 73008) c5(dt, fO); #c1(NTAN1) c2(NP_775745) c3(7724) c4(33838, 46895, 59952, 20781, 73009) c5(t, di); #c1(NTF3) c2(NP_001096124) c3(7725) c4(33839, 46896, 59953, 20782, 73010) c5(asQ, ak, bf, kE, b, cG, vD, ahS, EE, dk, A, ds, dV, cI, cA, aqL, O, aO, iy, jR, ag, aX, Vr, h, f, fw, cy, tF, dZ, k, cM, qu, gg, fy, aq, o, g, aHN, dj, hW, cV, bK, v, et, cz, ahO, cml, bb, Mw, OA, aM, jH, ao, Y, aY, eG, tW, er, PY, he, ex, ih, gd, rV, dc, I, vt, zn, y, HS); #c1(NTF4) c2(XP_011525310) c3(7726) c4(33840, 46897, 59954, 20783, 73011) c5(ao, ak, aX, ez, sr, cV, eG, nU, md, qr, cz, pQ, fq, A, ds, HS, cmm, cy, u, y, iy); #c1(NTHL1) c2(NP_002519) c3(7727) c4(33841, 46898, 59955, 20784, 73012) c5(sa, V, b, bu, by, qO, Qt, et, U, aV); #c1(NTM) c2(NP_001041674) c3(7728) c4(33842, 46899, 59956, 20785, 73013) c5(gk, bb, ez, ahq, iU, bV, cO, cA, hW, Wp); #c1(NTN1) c2(XP_006721658) c3(7729) c4(33843, 46900, 59957, 20786, 73014) c5(dx, B, b, X, aF, dB, w, U, y, co, aX, f, q, cU, cs, av, fy, u, dh, asQ, V, cV, aC, du, bp, ad, jo, dv, Qt, x, iA, jR, zS, at, ap); #c1(NTN4) c2(NP_067052) c3(7730) c4(33844, 46901, 59958, 20787, 73015) c5(A, b, hT, dU, w, u, ap); #c1(NTNG1) c2(XP_011539324) c3(7731) c4(33845, 46902, 59959, 20788, 73016) c5(nU, V, dA, ak, jJ, Qx, U, cz, bj, gl); #c1(NTNG2) c2(NP_115925) c3(7732) c4(33846, 46903, 59960, 20789, 73017) c5(m, ak, nU, cz, i, fx, Qx); #c1(NTPCR) c2(NP_115700) c3(7733) c4(33847, 46904, 59961, 20790, 73018) c5(vQ); #c1(NTRK1) c2(NP_001007793) c3(7734) c4(33848, 46905, 59962, 20791, 73019) c5(B, aw, zh, jt, dB, Ip, w, ak, bf, aHx, e, cmn, jT, cy, b, LN, kJ, Mu, cl, g, og, ahO, od, Jj, Lb, Tp, fx, Kb, pb, TJ, aKv, ag, cT, bk, i, dc, Dr, cmo, AI, X, vD, ahS, wy, ix, dV, bw, U, Co, cM, co, Qc, mI, f, N, gX, dZ, O, cs, av, fy, iT, vR, V, VP, W, iY, aY, nc, er, jR, pj, fG, QI, T, pv, hV, ahU, am, bg, A, aFh, ic, d, nU, q, es, yp, dQ, fM, Tr, ar, yW, aM, u, o, da, VD, cjS, bDv, gL, cz, IX, vS, agi, jG, jU, yG, wV, nV, hU, ch, aLQ, cjU, iq, wP, agf, fg, QU, Qv, k, fr, bDu, OJ, vl, m, bjC, aX, I, Tq, fq, h, F, yx, M, y, cB, aV, fU, cV, PL, J, dt, jo, uF, asO, jl, nP, by, ac, HL, TY, qp, YQ, Tv, HM, fP, iB, eG, DM, rb); #c1(NTRK2) c2(NP_001018075) c3(7735) c4(33849, 46906, 59963, 20792, 73020) c5(amC, oC, ak, ahU, b, k, X, oa, EL, jJ, HG, bg, dk, dd, rV, cA, U, cM, aqQ, cmq, ag, co, aX, Tq, f, aqU, q, cU, iZ, ajJ, O, aqz, cs, qu, ar, av, Tv, iR, dh, o, yJ, dj, fU, hW, V, cV, qA, ad, IL, auw, aqR, cz, vv, j, GL, qp, Ey, aY, ih, er, aE, HM, aaf, cmp, dc, ji, aA, eG, rb); #c1(NTRK3) c2(NP_001007157)

c3(7736) c4(33850, 46907, 59964, 20793, 73021) c5(B, b, oa, ahS, jJ, tR, dk, A, di, jR, O, cA, bw, U, y, aqQ, aX, h, hV, es, ar, ff, qu, Kw, rV, jb, u, aHN, dj, YV, V, cV, Be, wX, cz, W, ahO, T, aHJ, aeC, nV, aY, ch, boL, wz, ih, avL, eG, rb); #c1(NTS) c2(NP_006174) c3(7737) c4(33851, 46908, 59965, 20794, 73022) c5(ak, iG, b, X, aF, iP, ud, DC, A, di, kY, Fr, U, xw, bj, e, d, co, jU, yE, uj, fq, f, q, uB, zB, ar, B, cs, fv, fy, u, o, zb, da, fi, fU, V, IP, oJ, ui, cmr, ad, W, T, oE, Ze, Tp, cz, fM, wh, hU, bm, tW, zo, hn, he, ag, oi, fP, Yv); #c1(NTSR1) c2(NP_002522) c3(7738) c4(33852, 46909, 59966, 20795, 73023) c5(A, b, iP, di, C, cA, U, e, cM, d, co, sG, Wk, Tp, uB, tF, ar, cs, fy, da, dj, vR, hW, V, fl, bp, ad, W, T, fM, ag, fP, fg); #c1(NTSR2) c2(NP_036476) c3(7739) c4(33853, 46910, 59967, 20796, 73024) c5(yE); #c1(NUAK1) c2(NP_055655) c3(7740) c4(33854, 46911, 59968, 20797, 73025) c5(aX, V, b, cY, px, q, fO, U, jT, u, y); #c1(NUAK2) c2(NP_112214) c3(7741) c4(33855, 46912, 59969, 20798, 73026) c5(aX, b, X, vQ, lu, av); #c1(NUB1) c2(NP_001230280) c3(7742) c4(33856, 46913, 59970, 20799, 73027) c5(dB, b); #c1(NUBP1) c2(NP_001265435) c3(7743) c4(33857, 46914, 59971, 20800, 73028) c5(Ak, I, f, xw, cV); #c1(NUBP2) c2(NP_036357) c3(7744) c4(33858, 46915, 59972, 20801, 73029) c5(Ak, btO, I, btl, i); #c1(NUBPL) c2(NP_001188502) c3(7745) c4(33859, 46916, 59973, 20802, 73030) c5(hW, kW, bxo, di, aV, bF); #c1(NUCB1) c2(NP_006175) c3(7746) c4(33860, 46917, 59974, 20803, 73031) c5(vQ); #c1(NUCB2) c2(NP_005004) c3(7747) c4(33861, 46918, 59975, 20804, 73032) c5(A, aw, b, aeB, rd, bf, ey, y, bb, f, bu, am, B, u, hW, I, cM, by, P, T, eX, gF, bq, aA, ap); #c1(NUCKS1) c2(NP_073568) c3(7748) c4(33862, 46919, 59976, 20805, 73033) c5(bj, U, aw, V, b); #c1(NUDCD1) c2(NP_001121683) c3(7749) c4(33863, 46920, 59977, 20806, 73034) c5(co, bb, b, X, h, B, J, jG, A, av, re); #c1(NUDCD3) c2(NP_056147) c3(7750) c4(33864, 46921, 59978, 20807, 73035) c5(bm); #c1(NUDC) c2(XP_011538831) c3(7751) c4(33865, 46922, 59979, 20808, 73036) c5(t, h, A, G, J); #c1(NUDTI0) c2(NP_001291892) c3(7752) c4(33866, 46923, 59980, 20809, 73037) c5(bxj, A, pV, yV, xO, Pj, Pc, qB, Pb, Pk, IV, aE); #c1(NUDTI1) c2(NP_060629) c3(7753) c4(33867, 46924, 59981, 20810, 73038) c5(Pp, pw, Pk, Ph, wp, nc, Dp, aN, dt, Pc, Pb, jw, Gi, A, Pm); #c1(NUDTI5) c2(NP_060753) c3(7754) c4(33868, 46925, 59982, 20811, 73039) c5(iw); #c1(NUDTI9) c2(NP_001099040) c3(7755) c4(33869, 46926, 59983, 20812, 73040) c5(aeQ, fC, nQ, ayr, nW, Bu, yn, Ik); #c1(NUDT1) c2(NP_945191) c3(7756) c4(33870, 46927, 59984, 20813, 73041) c5(gG, fU, V, b, bj, f, v, aof, A, aiL, GI, rB, et, T, U, fy, u, aE); #c1(NUDT21) c2(NP_008937) c3(7757) c4(33871, 46928, 59985, 20814, 73042) c5(w); #c1(NUDT2) c2(NP_671702) c3(7758) c4(33872, 46929, 59986, 20815, 73043) c5(qL, mI, u, y); #c1(NUDT3) c2(NP_006694) c3(7759) c4(33873, 46930, 59987, 20816, 73044) c5(Jt, aA, dA); #c1(NUDT6) c2(NP_009014) c3(7760) c4(33874, 46931, 59988, 20817, 73045) c5(wF, fU, aX, V, py, jR, ik, i, qB, ar, U, at, eG, fx, fY); #c1(NUDT7) c2(NP_001099133) c3(7761) c4(33875, 46932, 59989, 20818, 73046) c5(bm); #c1(NUF2) c2(NP_663735) c3(7762) c4(33876, 46933, 59990, 20819, 73047) c5(co, aw, V, b, dB, bu, ck, di, bV, ar, fy, bb, by, u, bq); #c1(NUFIP1) c2(NP_036477) c3(7783) c4(33877, 46934, 59991, 20820, 73048) c5(QZ, aA); #c1(NUFIP2) c2(NP_065823) c3(7764) c4(33878, 46935, 59992, 20821, 73049) c5(f, hW, rQ, nU, P, KK, EE, bwb, hS, cz, bxr, KB, aD, cy, xw, aq); #c1(NUGGC) c2(NP_001010906) c3(7765) c4(33879, 46936, 59993, 20822, 73050) c5(bAS); #c1 (NUMA1) c2(NP_001273490) c3(7766) c4(33880, 46937, 59994, 20823, 73051) c5(b, iR, J, yy, i, gj, fx, u, y); #c1(NUMB) c2(NP_001005745) c3(7767) c4(33881, 46938, 59995, 20824, 73052) c5(dx, co, b, h, du, w, T, o, O, x, bh, mm, u, jG, y, n); #c1(NUMBL) c2(NP_001276909) c3(7768) c4(33882, 46939, 59996, 20825, 73053) c5(O, b, cV); #c1(NUP153) c2(NP_001265138) c3(7769) c4(33883, 46940, 59997, 20826, 73054) c5(hg, gL, ag, P, II, cB); #c1(NUP155) c2(NP_001265241) c3(7770) c4(33884, 46941, 59998, 20827, 73055) c5(sX, BT, mL, P, ap); #c1(NUP205) c2(NP_055950) c3(7771) c4(33885, 46942, 59999, 20828, 73056) c5(bdT, co, bZ); #c1(NUP210) c2(NP_079199) c3(7772) c4(33886, 46943, 60000, 20829, 73057) c5(U, bb, V, bT); #c1(NUP214) c2(NP_005076) c3(7773) c4(33887, 46944, 60001, 20830, 73058) c5(by, en, gE, bS, b, X, ak, aiW, pD, aN, ns, ea, nm, nt, nq, nr, nn, Vo, no, np, aK, U, y, OB, d, co, aX, ae, yN, VX, AX, f, e, q, jV, bu, M, aC, re, dQ, O, cB, iv, ct, kX, av, fy, u, iT, pA, V, apx, beW, lb, el, cs, BC, FC, fO, J, cms, P, T, II, Kv, cy, ad, jG, YU, DM, ao, iL, aq, Zl, fw, cT, jT, bk, cV, bgo, nU, cK, h); #c1(NUP35) c2(NP_001274513) c3(7774) c4(33888, 46945, 60002, 20831, 73059) c5(bq); #c1(NUP37) c2(NP_076962) c3(7775) c4(33889, 46946, 60003, 20832, 73060) c5(Pv); #c1(NUP43) c2(NP_942590) c3(7776) c4(33890, 46947, 60004, 20833, 73061) c5(P, kV, b, yM); #c1(NUP50) c2(XP_005261370) c3(7777) c4(33891, 46948, 60005, 20834, 73062) c5(at); #c1(NUP62) c2(NP_001180286) c3(7778) c4(33892, 46949, 60006, 20835, 73063) c5(A, bS, b, gG, KN, w, kY, bZ, ai, xw, U, y, TC, d, cy, kJ, f, q, e, Kz, ar, B, WF, fy, u, o, V, cmt, GS, v, gL, BV, P, T, bt, aj, ao, bm, zM, bdY, iT, amb, aA); #c1(NUP85) c2(NP_001290205) c3(7779) c4(33893, 46950, 60007, 20836, 73064) c5(BO, cO); #c1(NUP88) c2(NP_002523) c3(7780) c4(33894, 46951, 60008, 20837, 73065) c5(V, b, P, U, u, y); #c1(NUP93) c2(XP_005256320) c3(7781) c4(33895, 46952, 60009, 20838, 73066) c5(dA); #c1(NUP98) c2(NP_005378) c3(7782) c4(33896, 46953, 60010, 20839, 73067) c5(aw, b, k, eu, EN, w, cA, m, co, h, ak, N, q, M, n, iv, jG, fy, hD, dj, hW, J, hi, P, T, ew, ao, hX, bm, ie, G, fg, pl, gR, bh, pJ, ci); #c1(NUPL2) c2(NP_031368) c3(7783) c4(33897, 46954, 60011, 20840, 73068) c5(y0); #c1(NUPR1) c2(NP_001035948) c3(7784) c4(33898, 46955, 60012, 20841, 73069) c5(Dr, A, b, bn, aKo, bw, U, y, jx, kJ, aQk, f, ra, EN, B, u, mz, V, I, W, T, fx, nV, ep, ag, i, aA); #c1(NUS1) c2(NP_612468) c3(7785) c4(33899, 46956, 60013, 20842, 73070) c5(aX, b); #c1(NUSAP1) c2(NP_001230071) c3(7786) c4(33900, 46957, 60014, 20843, 73071) c5(fl, aw, qL, B, A, aMi); #c1(NUTF2) c2(XP_005255828) c3(7787) c4(33901, 46958, 60015, 20844, 73072) c5(P); #c1(NUTM1) c2(NP_001271221) c3(7788) c4(33902, 46959, 60016, 20845, 73073) c5(d, awc, pw, awA, b, awz, aJW, wy, T, Jw, Lu, e); #c1(NUTM2A) c2(XP_011538424) c3(7789) c4(33903, 46960, 60017, 20846, 73074) c5(Tw); #c1(NUTM2B) c2(XP_005270192) c3(7790) c4(33904, 46961, 60018, 20847, 73075) c5(Tw); #c1(NVL) c2(NP_001230075) c3(7791) c4(33905, 46962, 60019, 20848, 73076) c5(bb, cO); #c1(NWD1) c2(NP_001007526) c3(7792) c4(33906, 46963, 60020, 20849, 73077) c5(A, B); #c1(NXF1) c2(NP_001074960) c3(7793) c4(33907, 46964, 60021, 20850, 73078) c5(aw, b, ka, iU, ig, sJ, bvB, iL, gE, al, m, co, aX, IZ, fq, re, f, F, bu, Li, aV, aE, ri, da, ax, ez, il, im, aC, nl, dB, bvC, bp, by, P, aem, T, II, aZ, pi, dH, jH, bvx, eQ, ix, iT, xX, fl); #c1(NXF2B) c2(NP_001093156) c3(7794) c4(33908, 46965, 60022, 20851, 73079) c5(pM, wP, cT, wV); #c1(NXF3) c2(NP_071335) c3(7795) c4(33909, 46966, 60023, 20852, 73080) c5(Nq); #c1(NXF5) c2(NP_116564) c3(7796) c4(33910, 46967, 60024, 20853, 73081) c5(nz, nU, jw); #c1(NXN) c2(NP_001192248) c3(7797) c4(33911, 46968, 60025, 20854, 73082) c5(ak); #c1(NXNL1) c2(NP_612463) c3(7798) c4(33912, 46969, 60026, 20855, 73083) c5(ml, f, nW, TD); #c1(NXNL2) c2(NP_001155097) c3(7799) c4(33913, 46970, 60027, 20856, 73084) c5(c0); #c1(NXPE1) c2(NP_689528) c3(7800) c4(33914, 46971, 60028, 20857, 73085) c5(bq, jH); #c1(NXPE2) c2(NP_872301) c3(7801) c4(33915, 46972, 60029, 20858, 73086) c5(oy, td); #c1(NXPE4) c2(NP_001071107) c3(7802) c4(33916, 46973, 60030, 20859, 73087) c5(bq); #c1(NXPH1) c2(NP_689958) c3(7803) c4(33917, 46974, 60031, 20860, 73088) c5(oy, bP, A, cy, fD, cV, nU, vU, bln, agT, qa, wt, bw, bf, et); #c1(NXPH2) c2(NP_009157) c3(7804) c4(33918, 46975, 60032, 20861, 73089) c5(am, cV, X, cO, av, Fg); #c1(NXT1) c2(XP_011527532) c3(7805) c4(33919, 46976, 60033, 20862, 73090) c5(A, b, k, X, Zy, iP, jz, i, w, lv, iG, gE, bw, U, pz, fx, y, jQ, aiH, M, jT, aX, jd, t, h, B, F, q, vQ, bu, cU, ra, ik, O, cB, iv, jG, fy, u, e, n, g, d, V, il, Fs, gm, bp, Yl, W, P, T, fO, J, nP, by, pJ, jV, iR, ie, G, aJt, cT, gR, ji, jC, at); #c1(NXT2) c2(NP_001229546) c3(7806) c4(33920, 46977, 60034, 20863, 73091) c5(atn, fl, nU, axK, UY, aYQ); #c1(NYAP2) c2(NP_065915) c3(7807) c4(33921, 46978, 60035, 20864, 73092) c5(ayJ, aA, at, bj, I); #c1(NYX) c2(NP_072089) c3(7808) c4(33922, 46979, 60036, 20865, 73093) c5(ayl, ayr, Pa, ml, Bu, J, dZ, dV, cmu, nW, Ik); #c1(OARD1) c2(NP_659500) c3(7809) c4(33923, 46980, 60037, 20866, 73094) c5(v); #c1(OAS1) c2(NP_001027581) c3(7810) c4(33924, 46981, 60038, 20867, 73095) c5(en, X, aiW, A, iL, gE, al, m, aX, aFb, AX, B, aV, jZ, cfu, sQ, I, gL, P, II, pq, aE, bh); #c1(OAS2) c2(NP_001027903) c3(7811) c4(33925, 46982, 60039, 20868, 73096) c5(en, Dg, AX, B, aE, A, ky, iL, jZ); #c1(OAS3) c2(NP_006178) c3(7812) c4(33926, 46983, 60040, 20869, 73097) c5(aE, jT, en, Zz, X, re, AX, ahM, jz, fO, B, A, ky, Iv, iL, Dq, di, ad, jZ, jQ); #c1(OASL) c2(NP_003724) c3(7813) c4(33927, 46984, 60041, 20870, 73098) c5(m, en, I, aiW, al, jZ); #c1(OAT) c2(NP_001165285) c3(7814) c4(33928, 46985, 60042, 20871, 73099) c5(wn, xa, cM, jx, aeQ, aXh, cB, aE, aat, bpX, nQ, cmv, v, dt, bDA, pk, bV, cmw, sc, zS, aA, cmx); #c1(OAZ1) c2(NP_001287949) c3(7815) c4(33929, 46986, 60043, 20872, 73100) c5(m, A, b, cV, X, B, aC, jm, fy, eO, av, at, gl, cM, ap); #c1(OAZ2) c2(NP_002528) c3(7816) c4(33930, 46987, 60044, 20873, 73101) c5(cV); #c1(OBFC1) c2(XP_006718039) c3(7817) c4(33931, 46988, 60045, 20874, 73102) c5(V, LR, Ce, oJ, U, ap); #c1(OBP2A) c2(NP_001280118) c3(7818) c4(33932, 46989, 60046, 20875, 73103) c5(fy, by, co, V, b, Qm, X, F, B, dB, q, bp, bu, A, II, cs, x, U, ad, av, pp); #c1(OBSCN) c2(NP_001092093) c3(7819) c4(33933, 46990, 60047, 20876, 73104) c5(V, b, mR, aW, fM, iK, sK); #c1(OBSL1) c2(NP_001166879) c3(7820) c4(33934, 46991, 60048, 20877, 73105) c5(oD, aCv, kG, aCt, cmy); #c1(OC90) c2(NP_001073868) c3(7821) c4(33935, 46992, 60049, 20878, 73106) c5(aRh, HE); #c1(OCA2) c2(NP_000266) c3(7822) c4(33936, 46993, 60050, 20879, 73107) c5(b, bHD, bHB, aMr, w, ic, iL, U, Vn, y, SV, d, m, aX, apx, IZ, ml, hV, XP, e, aPN, X, RQ, av, fy, u, i, I, cV, Dg, aeM, bp, dB, dt, II, jl, hR, nV, st, aeq, cmz, DO, cmA, iV, cT, agw, tl, I, yA, rv); #c1(OCIAD1) c2(NP_001073308) c3(7823) c4(33937, 46994, 60051, 20880, 73108) c5(X); #c1(OCIAD2) c2(NP_001014446) c3(7824) c4(33938, 46995, 60052, 20881, 73109) c5(ar, js, n); #c1(OCLM) c2(NP_071770) c3(7825) c4(33939, 46996, 60053, 20882, 73110) c5(er, ez); #c1(OCLN) c2(NP_001192183) c3(7826) c4(33940, 46997, 60054, 20883, 73111) c5(bL, b, xa, gE, adr, y, gO, co, bb, ml, f, q, ar, iv, aV, bm, aWY, zv, ao, T, aPK, aH, Y, u, mE, ag, fP, rr, DM); #c1(OCM2) c2(NP_006179) c3(7827) c4(33941, 46998, 60055, 20884, 73112) c5(jC, aX); #c1(OCM) c2(XP_011513787) c3(7828) c4(33942, 46999, 60056, 20885, 73113) c5(aX, cbQ, q, jC, bm, auV); #c1(OCRL) c2(NP_000267) c3(7829) c4(33943, 47000, 60057, 20886, 73114) c5(bP, gw, er, aPA, nz, nU, Lm, mg, aAb, TW); #c1(ODAM) c2(NP_060325) c3(7830) c4(33944, 47001, 60058, 20887, 73115) c5(aX, ahF, b, T, u, y); #c1(ODC1) c2(NP_001274117) c3(7831) c4(33945, 47002, 60059, 20888, 73116) c5(bm, by, A, aw, ny, b, bx, fr, PA, Ip, hS, ic, eO, bw, U, ft, hP, e, cM, d, co, aX, fv, jd, bba, f, N, q, jV, bu, aMH, jm, ik, y, cs, ar, jG, fy, u, dh, jH, cl, SA, sB, V, il, cV, lb, el, ht, J, fO, Yl, W, P, T, aox, bt, x, bb, ad, kN, qW, jE, qp, aY, bed, hT, ie, boi, fw, B, ag, cT, jT, fg, bk, fD, dc, aC, ew, at, ct, MS, ap); #c1(ODF1) c2(NP_077721) c3(7832) c4(33946, 47003, 60060, 20889, 73117) c5(dA, aC, qd, zJ, bf, aM); #c1(ODF3B) c2(NP_001014440) c3(7833) c4(33947, 47004, 60061, 20890, 73118) c5(aV, kF); #c1(ODF4) c2(NP_694552) c3(7834) c4(33948, 47005, 60062, 20891, 73119) c5(tl); #c1(OFCC1) c2(XP_011513347) c3(7835) c4(33949, 47006, 60063, 20892, 73120) c5(azz, hW, ack); #c1(OFD1) c2(NP_003602) c3(7836) c4(33950, 47007, 60064, 20893, 73121) c5(cmB, aeQ, asd, eF, FR, bsm, anU, nU, xc, Nz, ahN, cmC); #c1(OGDH) c2(NP_001003941) c3(7837) c4(33951, 47008, 60065, 20894, 73122) c5(ake, cmD, bK, f, v, at, bT, o); #c1(OGDHL) c2(NP_001137468) c3(7838) c4(33952, 47009, 60066, 20895, 73123) c5(bb, re, et, iT, b); #c1(OGFOD1) c2(NP_060703) c3(7839) c4(33953, 47010, 60067, 20896, 73124) c5(bq, cT, at, dh); #c1(OGFR) c2(NP_031372) c3(7840) c4(33954, 47011, 60068, 20897, 73125) c5(nV, b, ra, X, hV, F, ag, og, x, bw, av); #c1(OGG1) c2(NP_002533) c3(7841) c4(33955, 47012, 60069, 20898, 73126) c5(gK, B, aw, Gm, rR, Zy, gG, jt, dB, bf, e, Up, cU, jT, iy, b, t, Gp, fH, oJ, g, aC, cs, of, bp, Ce, Gl, x, fx, hR, kN, wh, QJ, BX, os, ag, bk, i, dc, aA, bP, GD, X, iP, mk, GM, kY, bw, U, cM, tp, co, ip, f, bu, O, JX, iv, av, fy, bm, iT, is, V, v, Qz, HW, ny, iA, pi, fJ, Vx, GB, aY, in, tl, ji, am, q, dk, au, ic, nS, fD, d, jh, kW, jd, re, cmE, es, ra, ar, ff, n, sR, u, o, Zz, il, atr, gL, ad, qO, Sq, rB, ct, aWN, aJA, ch, hT, Dj, I, vZ, yA, IA, GK, A, pR, gN, jc, di, jR, iL, sx, aW, Px, aX, I, hP, h, F, qr, az, ik, y, xt, aV, Xu, si, ez, J, W, P, T, jl, by, aM, Mp, Sv, Oi, at, eG); #c1(OGN) c2(NP_054776) c3(7842) c4(33956, 47013, 60070, 20899, 73127) c5(W, iF); #c1(OGT) c2(NP_858058) c3(7843) c4(33957, 47014, 60071, 20900, 73128) c5(ag, A, aw, I, b, sO, X, aF, f, HN, bf, cO, Be, B, ch, bw, bM, u, BQ, y, aM); #c1(OIP5) c2(NP_009211) c3(7844) c4(33958, 47015, 60072, 20901, 73129) c5(d, fl, b, il, bu, ik, aA, by, e); #c1(OIT3) c2(NP_689848) c3(7845) c4(33959, 47016, 60073, 20902, 73130) c5(g, ob); #c1(OLA1) c2(NP_001011708) c3(7846) c4(33960, 47017, 60074, 20903, 73131) c5(u, y); #c1(OLFM1) c2(NP_001269540) c3(7847) c4(33961, 47018, 60075, 20904, 73132) c5(bm, A, aq, q, aN, vJ, al, aK, o, jx); #c1(OLFM2) c2(NP_477512) c3(7848) c4(33962, 47019, 60076, 20905, 73133) c5(qr); #c1(OLFM4) c2(NP_006409) c3(7849) c4(33963, 47020, 60077, 20906, 73134) c5(by, A, b, U, hP, M, bb, h, B, bu, cU, cs, fi, V, dA, ad, T, iA, hR, ao, ag, aA, at, eG); #c1(OLFML2B) c2(NP_056256) c3(7850) c4(33964, 47021, 60078, 20907, 73135) c5(dx, du, Fg); #c1(OLIG1) c2(NP_620450) c3(7851) c4(33965, 47022, 60079, 20908, 73136) c5(g, byw, fy, td, k, cJ, Fs, bp, qP, w, zb, qu, rV, aV, aq, O); #c1(OLIG2) c2(XP_005260965) c3(7852) c4(33966, 47023, 60080, 20909, 73137) c5(b, k, jq, jt, cfk, HG, w, O, y, BO, aX, Tg, h, f, es, chu, zb, qu, u, o, g, hW, cJ, Fs, jJ, T, rV, bNh, Ut, ao, aq, jR, OJ, qP, apT); #c1(OLIG3) c2(NP_786923) c3(7853) c4(33967, 47024, 60081, 20910, 73138) c5(oy, jH, at, I, dA, aC, aV, da, ig, di, hR, aE); #c1(OLR1) c2(NP_001166103) c3(7854) c4(33968, 47025, 60082, 20911, 73139) c5(dx, bL, id, b, adW, dD, z, aN, eH, fl, di, cO, bf, fD, y, qs, dv, bb, dN, f, aO, u, o, mz, fz, I, aC, Bs, sH, du, eX, cK, aM, aL, dS, Ic, OI, bq, aA, at, ap); #c1(OMD) c2(NP_005005) c3(7855) c4(33969, 47026, 60083, 20912, 73140) c5(qu, rV, b); #c1(OMG) c2(NP_002535) c3(7856) c4(33970, 47027, 60084, 20913, 73141) c5(aiJ, bb, EM, nU, cz, ds, iD, aV, ahX); #c1(OMP) c2(NP_006180) c3(7857) c4(33971, 47028, 60085, 20914, 73142) c5(l, alE, ow, VT); #c1(ONECUT1) c2(NP_004489) c3(7858) c4(33972, 47029, 60086, 20915, 73143) c5(d, co, b, I, dA, qL, Gd, kJ, q, ag, cs, bw, bf, bm, e); #c1(ONECUT2) c2(NP_004843) c3(7859) c4(33973, 47030, 60087, 20916, 73144) c5(g, b, Fg, gm); #c1(OPA1) c2(NP_056375) c3(7860) c4(33974, 47031, 60088, 20917, 73145) c5(lg, b, alN, xg, AB, di, dV, cO, U, ho, e, cmG, d, bb, cdv, kW, oj, cmH, f, q, qr, dZ, mg, awS, bgW, oD, aNN, ez, fC, bK, v, bN, pQ, awT, T, cmF, ar, cr, acU, ao, wz, er, mU, cdu, na, cdt, cG, vL); #c1(OPA3) c2(NP_001017989) c3(7861) c4(33975, 47032, 60089, 20918, 73146) c5(fC, alN, ml, md, cmJ, cmK, awS, cml, vL); #c1(OPCML) c2(NP_001012393) c3(7862) c4(33976, 47033, 60090, 20919, 73147) c5(b, X, gG, bf, ho, O, oy, f, q, bu, ar, fH, av, g, i, dA, T, fx, jT, f J, jR, Qa, E, ji, ap); #c1(OPHN1) c2(XP_005262327) c3(7863) c4(33977, 47034, 60091, 20920, 73148) c5(aY, nx, nz, nU, cmL, dc, cM); #c1(OPN1LW) c2(NP_064445) c3(7864) c4(33978, 47035, 60092, 20921, 73149) c5(A, avX, b, X, aF, cmO, jz, aN, sJ, O, U, xw, kV, y, jQ, alS, co, ps, ml, nU, cmM, Be, B, iv, pB, av, fy, u, Qx, Dp, og, Kx, jh, lb, cs, J, bp, ad, P, T, fO, jT, aCr, ast, cT, cmN, h); #c1(OPN1MW2) c2(NP_001041646) c3(7865) c4(33979, 47036, 60093, 20922, 73150) c5(b, HN, EM, jR, adM, cO); #c1(OPN1SW) c2(NP_001699) c3(7866) c4(33980, 47037, 60094, 20923, 73151) c5(aw, b, fr, gw, eu, aGq, w, C, iL, z, jy, re, aW, co, t, ml, g, oO, jG, Uy, jZ, gm, gv, G, od, ji, ct, J, jT, yG, cmP, ag, ie, mU, dY, bnV, ih, pl, gR, bh, h); #c1(OPN3) c2(NP_055137) c3(7867) c4(33981, 47038, 60095, 20924, 73152) c5(fU, cy, q, eO, aD, aV); #c1(OPN4) c2(NP_001025186) c3(7868) c4(33982, 47039, 60096, 20925, 73153) c5(da, A, b, cV, B, eX, NJ, pt, y, cO, iN, oM, at, u, tQ); #c1(OPN5) c2(NP_859528) c3(7869) c4(33983, 47040, 60097, 20926, 73154) c5(hW, ak, u, q, y); #c1(OPRK1) c2(NP_000903) c3(7870) c4(33984, 47041, 60098, 20927, 73155) c5(sa, f, Ey, dd, cA, gZ, G, cM, Wj, hF, aqB, Jr, t, h, aqs, hB, oE, Go, O, IV, fy, n, dj, hW, jG, J, P, Gl, iN, jT, Gj, qp, aY, cmQ, hn, cT, dc, oR, jP, ci, RB); #c1(OPRL1) c2(NP_001186948) c3(7871) c4(33985, 47042, 60099, 20928, 73156) c5(b, cV, hn, fK, Ey, aCB, Wf, iN, Gj, IV); #c1(OPRM1) c2(NP_000905) c3(7872) c4(33986, 47043, 60100, 20929, 73157) c5(B, Gt, hY, cmT, dd, bV, cO, Jx, e, O, avt, qc, gB, dl, EA, IV, aOb, Dt, aFE, aTY, Gl, jT, re, cmQ, hn, cT, i, dc, pt, aA, bT, aPm, aqu, Id, hS, vR, aCB, cA, cM, co, js, f, Go, fy, CG, Gr, Js, pi, aY, fG, hE, abw, jP, RB, b, GL, z, gZ, jD, d, Qi, vf, yp, ff, Wf, Gj, u, fh, da, I, jO, hv, cz, cmS, xq, iN, ch, cmR, he, ih, I, A, C, gE, bAt, al, Wj, aX, hk, sG, aqs, hB, oE, y, ma, hW, cV, be, P, Sw, oM, to, xM, aDd, aUe, fP, jN, at, eG); #c1(OPTC) c2(XP_011507708) c3(7873) c4(33987, 47044, 60101, 20930, 73158) c5(lg, ez, EM, Bu, qr, di, aW); #c1(OPTN) c2(NP_001008214) c3(7874) c4(33988, 47045, 60102, 20931, 73159) c5(A, b, xg, w, dV, bZ, ai, y, bbO, zJ, ml, f, md, qr, Vr, bdT, dZ, cmU, B, KL, Ig, u, cmV, g, ez, cV, pk, v, Ih, Fo, cmF, fx, ajd, ao, er, PY, zM, i, vL, aG); #c1(OR10A2) c2(NP_001004460) c3(7875) c4(33989, 47046, 60103, 20932, 73160) c5(cmW); #c1(OR10A4) c2(NP_997069) c3(7876) c4(33990, 47047, 60104, 20933, 73161) c5(bP, dx, dM, aw, Io, b, Ka, ig, en, NH, cA, bf, y, yK, qs, dv, ae, wG, ak, bu, aO, pq, u, aE, I, du, by, P, bt, bq, et, aM, jH, dO, f, NG, dS, Ck, mA, vH, ag, pH, fD, di, aA, at, afd, ap); #c1(OR10C1) c2(NP_039229) c3(7877) c4(33991, 47048, 60105, 20934, 73162) c5(rh, aA, di, mA); #c1(OR10J1) c2(NP_036483) c3(7878) c4(33992, 47049, 60106, 20935, 73163) c5(qf, ap); #c1(OR10J3) c2(NP_001004467) c3(7879) c4(33993, 47050, 60107, 20936, 73164) c5(m, b, I, eQ, aE, iT, bf, aA, aM, u, re, y, ap); #c1(OR10J5) c2(NP_001004469) c3(7880) c4(33994, 47051, 60108, 20937, 73165) c5(A, xb, di, amh, cA, bf, U, y, m, bQ, B, NJ, u, V, I, aC, be, eX, aM, jH, mA, xe, bAh); #c1(OR10K1) c2(NP_001004473) c3(7881) c4(33995, 47052, 60109, 20938, 73166) c5(dx, by, A, b, fr, au, di, asm, bTh, bf, U, adr, e, y, d, m, bNQ, co, cy, ae, re, B, bu, az, do, ar, cs, u, iT, V, I, aC, du, ad, W, P, dv, cmX, ft, aM, py, bal, mA, fP, bq, at, eG); #c1(OR10K2) c2(NP_001004476) c3(7882) c4(33996, 47053, 60110, 20939, 73167) c5(is, da, aGc, atr, dP, aJA, fq, eQ, bc, Jn, jc, di, nl, bJO, bq, ai, jT, u, y); #c1(OR10R2) c2(NP_001004472) c3(7883) c4(33997, 47054, 60111, 20940, 73168) c5(b, cmY, di, iL, bb, bf, y, m, co, aX, fq, rr, q, mL, wY, UM, u, aC, bt, cy, jT, aM, jH, wu, DO, bq, aT); #c1(OR10T2) c2(NP_001004475) c3(7884) c4(33998, 47055, 60112, 20941, 73169) c5(awV, dj, b, Y, fq, ajl, jH, ad, m, do, fP, aYz, cs, Oi, aT, at, u, aE, y, cp); #c1(OR10X1) c2(NP_001004477) c3(7885) c4(33999, 47056, 60113, 20942, 73170) c5(gk, JH, X, jz, di, wf, bf, y, jQ, m, co, cy, av, aOo, u, da, I, aC, j, bq, bb, aM, ag, fP, ahp, aX, ap); #c1(OR10Z1) c2(NP_001004478) c3(7886) c4(34000, 47057, 60114, 20943, 73171) c5(jH, aX, b, I, aC, nl, eX, F, iU, j, do, fP, fx, i, vp, ey, u, aA, y); #c1(OR11A1) c2(NP_039225) c3(7887) c4(34001, 47058, 60115, 20944, 73172) c5(m); #c1(OR12D2) c2(NP_039224) c3(7888) c4(34002, 47059, 60116, 20945, 73173) c5(m); #c1(OR12D3) c2(NP_112221) c3(7889) c4(34003, 47060, 60117, 20946, 73174) c5(m, P, aV); #c1(OR13C3) c2(NP_001001961) c3(7890) c4(34004, 47061, 60118, 20947, 73175) c5(bq, Ik); #c1(OR13C4) c2(NP_001001919) c3(7891) c4(34005, 47062, 60119, 20948, 73176) c5(bw); #c1(OR13F1) c2(NP_001004485) c3(7892) c4(34006, 47063, 60120, 20949, 73177) c5(pN); #c1(OR13G1) c2(NP_001005487) c3(7893) c4(34007, 47064, 60121, 20950, 73178) c5(Jy, eR, y, bb, sG, mL, eX, bu, u, iT, fh, nl, j, by, IR, IX, Oi, cy, IS, rr, bq, at, re, ap); #c1(OR13J1) c2(NP_001004487) c3(7894) c4(34008, 47065, 60122, 20951, 73179) c5(Ck); #c1(OR14J1) c2(NP_112208) c3(7895) c4(34009, 47066, 60123, 20952, 73180) c5(m, aE); #c1(OR1A1) c2(NP_055380) c3(7896) c4(34010, 47067, 60124, 20953, 73181) c5(aum); #c1(OR1C1) c2(NP_036485) c3(7897) c4(34011, 47068, 60125, 20954, 73182) c5(m, A, aX, sG, b, q, iu, ag, eX, bq, aC, Oi, ai, u, y); #c1(OR1D2) c2(NP_002539) c3(7898) c4(34012, 47069, 60126, 20955, 73183) c5(T); #c1(OR1E1) c2(NP_003544) c3(7899) c4(34013, 47070, 60127, 20956, 73184) c5(KM); #c1(OR1E2) c2(NP_003545) c3(7900) c4(34014, 47071, 60128, 20957, 73185) c5(oy); #c1(OR1J2) c2(NP_473448) c3(7901) c4(34015, 47072, 60129, 20958, 73186) c5(cmZ); #c1(OR1K1) c2(NP_543135) c3(7902) c4(34016, 47073, 60130, 20959, 73187) c5(Ns, Nq); #c1(OR1L8) c2(NP_001004454) c3(7903) c4(34017, 47074, 60131, 20960, 73188) c5(bb); #c1(OR1M1) c2(NP_001004456) c3(7904) c4(34018, 47075, 60132, 20961, 73189) c5(aC); #c1(OR1N1) c2(NP_036495) c3(7905) c4(34019, 47076, 60133, 20962, 73190) c5(d, mz, id, I, b, jH, aq, q, m, di, bq, wf, bf, aM, u, e, y, ap); #c1(OR1N2) c2(NP_001004457) c3(7906) c4(34020, 47077, 60134, 20963, 73191) c5(Ns, Nq); #c1(OR2A25) c2(NP_001004488) c3(7907) c4(34021, 47078, 60135, 20964, 73192) c5(fh, at, bb, bq, ap); #c1(OR2AG1) c2(NP_001004489) c3(7908) c4(34022, 47079, 60136, 20965, 73193) c5(da, b, jJ, Ip, cM, cp, m, aX, re, qu, Gj, iT, xy, Yk, hW, aqQ, I, aC, bK, be, iN, rV, azW, aY, ih, uO, dc, Ri, rr); #c1(OR2AK2) c2(NP_001004491) c3(7909) c4(34023, 47080, 60137, 20966, 73194) c5(bP, di, wf, bf, aO, m, bb, q, cna, ez, I, aC, j, gv, W, IX, cy, et, aM, IR, MP, IS, fD, bh, at); #c1(OR2AT4) c2(NP_001005285) c3(7910) c4(34024, 47081, 60138, 20967, 73195) c5(fP); #c1(OR2B2) c2(NP_149046) c3(7911) c4(34025, 47082, 60139, 20968, 73196) c5(da, avX, qd, acK, be, jz, aFy, uH, xb, sV, aA, jQ); #c1(OR2B3) c2(NP_001005226) c3(7912) c4(34026, 47083, 60140, 20969, 73197) c5(da, bf, m); #c1(OR2B6) c2(NP_036499) c3(7913) c4(34027, 47084, 60141, 20970, 73198) c5(rh, aF, aA, di, mA); #c1(OR2C1) c2(NP_036500) c3(7914) c4(34028, 47085, 60142, 20971, 73199) c5(oy); #c1(OR2F2) c2(NP_001004685) c3(7915) c4(34029, 47086, 60143, 20972, 73200) c5(Tk, jH, ach, at, fP); #c1(OR2G2) c2(NP_001001915) c3(7916) c4(34030, 47087, 60144, 20973, 73201) c5(jH, BL, V, b, h, q, j, ih, Oi, I, tE, i, z, bW, U, at, fx); #c1(OR2G3) c2(NP_001001914) c3(7917) c4(34031, 47088, 60145, 20974, 73202) c5(A, JH, asm, bf, ai, gZ, y, cy, Si, g, B, u, NT, aC, be, j, gv, aX, aM, xe, ih, bh, at, ap); #c1(OR2H2) c2(NP_009091) c3(7918) c4(34032, 47089, 60146, 20975, 73203) c5(m, gF, aV); #c1(OR2J2) c2(NP_112167) c3(7919) c4(34033, 47090, 60147, 20976, 73204) c5(m, id, b, qd, xb, T, at, O); #c1(OR2J3) c2(NP_001005216) c3(7920) c4(34034, 47091, 60148, 20977, 73205) c5(m, cnb, u, y); #c1(OR2L2) c2(NP_001004686) c3(7921) c4(34035, 47092, 60149, 20978, 73206) c5(bP, jH, pV, I, qB, mA, fP, aO, fD, bf, Pl, at, u, y, aM); #c1(OR2M3) c2(NP_001004689) c3(7922) c4(34036, 47093, 60150, 20979, 73207) c5(PJ, gk, jH, aC, nl, bu, ig, bt, by, cnc); #c1(OR2M4) c2(NP_059974) c3(7923) c4(34037, 47094, 60151, 20980, 73208) c5(mz, bb, ez, b, ql, mA, fP, di, bq, aX); #c1(OR2M7) c2(NP_001004691) c3(7924) c4(34038, 47095, 60152, 20981, 73209) c5(aLQ, Ic, as, aA, u, y); #c1(OR2S2) c2(NP_063950) c3(7925) c4(34039, 47096, 60153, 20982, 73210) c5(do); #c1(OR2T10) c2(NP_001004693) c3(7926) c4(34040, 47097, 60154, 20983, 73211) c5(mz, cn, aaa, b, I, m, nO, j, by, aoY, mR, xe, vp, IL, BL, at, dl); #c1(OR2T12) c2(NP_001004692) c3(7927) c4(34041, 47098, 60155, 20984, 73212) c5(QD, m, by, aaa, V, aC, t, eX, bu, W, G, di, cl, U, at, u, eG, y); #c1(OR2T1) c2(NP_112166) c3(7928) c4(34042, 47099, 60156, 20985, 73213) c5(m, b, I, eQ, bf, u, y, aM); #c1(OR2T2) c2(NP_001004136) c3(7929) c4(34043, 47100, 60157, 20986, 73214) c5(bP, jl, qs, bb, fD, I, m, j, bu, by, NJ, di, amh, fH, cy, at, f J); #c1(OR2T33) c2(NP_001004695) c3(7930) c4(34044, 47101, 60158, 20987, 73215) c5(iU, da, jE, bQ, bb, I, qd, aC, aiU, eX, q, bu, m, dy, fP, cy, by, bm, re, iT); #c1(OR2T4) c2(NP_001004696) c3(7931) c4(34045, 47102, 60159, 20988, 73216) c5(m, I, aDD, ad, cs, Oi, et); #c1(OR2T5) c2(NP_001004697) c3(7932) c4(34046, 47103, 60160, 20989, 73217) c5(m, hW, aY, bu, hS, dc, aC, bq, by, cM); #c1(OR2W1) c2(NP_112165) c3(7933) c4(34047, 47104, 60161, 20990, 73218) c5(m); #c1(OR2Y1) c2(NP_001001657) c3(7934) c4(34048, 47105, 60162, 20991, 73219) c5(PJ, Gr, X, rr, aFy, av, pq); #c1(OR2Z1) c2(NP_001004699) c3(7935) c4(34049, 47106, 60163, 20992, 73220) c5(bh, gv); #c1(OR3A1) c2(NP_002541) c3(7936) c4(34050, 47107, 60164, 20993, 73221) c5(X, dD, aE, di, z, U, y, wr, tF, tE, av, u, dh, V, aC, bK, xf, gv, W, T, aUW, ex, dn, bh, aOB); #c1(OR4A15) c2(NP_001005275) c3(7937) c4(34051, 47108, 60165, 20994, 73222) c5(m); #c1(OR4C12) c2(NP_001005270) c3(7938) c4(34052, 47109, 60166, 20995, 73223) c5(Nk); #c1(OR4C13) c2(NP_001001955) c3(7939) c4(34053, 47110, 60167, 20996, 73224) c5(dB); #c1(OR4C6) c2(NP_001004704) c3(7940) c4(34054, 47111, 60168, 20997, 73225) c5(aA); #c1(OR4D10) c2(NP_001004705) c3(7941) c4(34055, 47112, 60169, 20998, 73226) c5(cp); #c1(OR4K13) c2(NP_001004714) c3(7942) c4(34056, 47113, 60170, 20999, 73227) c5(cy); #c1(OR4P4) c2(NP_001004124) c3(7943) c4(34057, 47114, 60171, 21000, 73228) c5(aA); #c1(OR4S2) c2(NP_001004059) c3(7944) c4(34058, 47115, 60172, 21001, 73229) c5(aA); #c1(OR51A2) c2(NP_001004748) c3(7945) c4(34059, 47116, 60173, 21002, 73230) c5(dA); #c1(OR51A7) c2(NP_001004749) c3(7946) c4(34060, 47117, 60174, 21003, 73231) c5(at); #c1(OR51E1) c2(NP_689643) c3(7947) c4(34061, 47118, 60175, 21004, 73232) c5(oy, IV, A, oa, B); #c1(OR51E2) c2(NP_110401) c3(7948) c4(34062, 47119, 60176, 21005, 73233) c5(A, 8); #c1(OR51F2) c2(NP_001004753) c3(7949) c4(34063, 47120, 60177, 21006, 73234) c5(Eo); #c1(OR51V1) c2(NP_001004760) c3(735D) c4(34064, 47121, 60178, 21007, 73235) c5(ae); #c1(OR52B2) c2(NP_001004052) c3(7951) c4(34065, 47122, 60179, 21008, 73236) c5(bw); #c1(OR52B4) c2(NP_001005161) c3(7352) c4(34066, 47123, 60180, 21009, 73237) c5(do); #c1(OR52D1) c2(NP_001005163) c3(7953) c4(34067, 47124, 60181, 21010, 73238) c5(do); #c1(OR52E6) c2(NP_001005167) c3(7954) c4(34068, 47125, 60182, 21011, 73239) c5(do); #c1(OR5211) c2(NP_001005169) c3(7955) c4(34069, 47126, 60183, 21012, 73240) c5(1); #c1(OR5212) c2(NP_001005170) c3(7956) c4(34070, 47127, 60184, 21013, 73241) c5(by, eA, bvW, bu); #c1(OR52K1) c2(NP_001005171) c3(7957) c4(34071, 47128, 60185, 21014, 73242) c5(iw, m, aAd, hN, at); #c1(OR52K2) c2(NP_001005172) c3(7958) c4(34072, 47129, 60186, 21015, 73243) c5(aC, ax, rn, dH); #c1(OR52M1) c2(NP_001004137) c3(7959) c4(34073, 47130, 60187, 21016, 73244) c5(W); #c1(OR5D18) c2(NP_001001952) c3(7960) c4(34074, 47131, 60188, 21017, 73245) c5(bq); #c1(OR5H2) c2(NP_001005482) c3(7961) c4(34075, 47132, 60189, 21018, 73246) c5(bT); #c1(OR5H6) c2(NP_001005479) c3(7962) c4(34076, 47133, 60190, 21019, 73247) c5(en, rr, aA, u, Mp, y); #c1(OR5K1) c2(NP_001004736) c3(7963) c4(34077, 47134, 60191, 21020, 73248) c5(ld, ax, b, eE, pN, end, Bb, et, dH); #c1(OR5K2) c2(NP_001004737) c3(7964) c4(34078, 47135, 60192, 21021, 73249) c5(ld, BL, dP, lq, aC, Jn, xe, di, cy, aA, yd, uf); #c1(OR5V1) c2(NP_110503) c3(7965) c4(34079, 47136, 60193, 21022, 73250) c5(m, P); #c1(OR6B1) c2(NP_001005281) c3(7966) c4(34080, 47137, 60194, 21023, 73251) c5(py, aY, fO, aE, az, au, dc, bh, mm, pi, cne, cM); #c1(OR6B2) c2(NP_001005853) c3(7967) c4(34081, 47138, 60195, 21024, 73252) c5(IJ, b, xb, vZ, II, bf, U, e, y, d, co, bb, ae, fq, re, q, mL, ik, ar, u, iT, Id, V, il, bc, gv, W, aZ, ahp, cy, cmX, aM, lq, amH, Bu, fP, dX, bh, rr); #c1(OR6C1) c2(NP_001005182) c3(7968) c4(34082, 47139, 60196, 21025, 73253) c5(do); #c1(OR6F1) c2(NP_001005286) c3(7969) c4(34083, 47140, 60197, 21026, 73254) c5(bP, pV, bf, U, y, bQ, re, eX, iT, qB, u, bLI, nl, V, I, jH, aC, cs, j, ad, W, IX, et, aM, IR, eQ, IS, yd, at); #c1(ORGK2) c2(NP_001005279) c3(7970) c4(34084, 47141, 60198, 21027, 73255) c5(bL, co, bb, I, b, aC, iu, xf, W, vZ, tE, bq, at, u, y); #c1(OR6K3) c2(NP_001005327) c3(7971) c4(34085, 47142, 60199, 21028, 73256) c5(jH, gk, bb, V, aC, iu, re, j, fP, mA, iT, co, di, y, ahp, bf, U, xe, u, aO, aM); #c1(OR6K6) c2(NP_001005184) c3(7972) c4(34086, 47143, 60200, 21029, 73257) c5(jH, id, b, m, aC, Ic, iU, HZ, by, aoY, co, fP, Rj, bf, aA, xe, wW, aM); #c1(OR6N1) c2(NP_001005185) c3(7973) c4(34087, 47144, 60201, 21030, 73258) c5(ao, I, aC, eX, sF, bf, aA, u, y, aM); #c1(OR6N2) c2(NP_001005278) c3(7974) c4(34088, 47145, 60202, 21031, 73259) c5(ajn, I, aC, bc, j, ih, gZ, u, y); #c1(OR6X1) c2(NP_001005188) c3(7975) c4(34089, 47146, 60203, 21032, 73260) c5(bb); #c1(OR6Y1) c2(NP_001005189) c3(7976) c4(34090, 47147, 60204, 21033, 73261) c5(ak, I, X, Ic, j, aY, y, dc, aC, bf, av, at, u, cM, aM); #c1(OR7C1) c2(NP_945182) c3(7977) c4(34091, 47148, 60205, 21034, 73262) c5(aC); #c1(OR7D2) c2(NP_787079) c3(7978) c4(34092, 47149, 60206, 21035, 73263) c5(bh, gv); #c1(OR7E24) c2(NP_001073404) c3(7979) c4(34093, 47150, 60207, 21036, 73264) c5(di, cO); #c1(OR8S1) c2(NP_001005203) c3(7980) c4(34094, 47151, 60208, 21037, 73265) c5(do); #c1(OR9K2) c2(NP_001005243) c3(7981) c4(34095, 47152, 60209, 21038, 73266) c5(W, cy, dP); #c1(OR9Q2) c2(NP_001005283) c3(7982) c4(34096, 47153, 60210, 21039, 73267) c5(Fg); #c1(ORA11) c2(NP_116179) c3(7983) c4(34097, 47154, 60211, 21040, 73268) c5(A, aw, bjA, b, eu, w, di, y, iy, pp, fq, ja, B, xl, u, nl, cng, cnf, P, II, Io, aX, aUZ); #c1(ORA13) c2(NP_689501) c3(7984) c4(34098, 47155, 60212, 21041, 73269) c5(A, b, B, ji, fy, u, y); #c1(ORAOV1) c2(NP_703152) c3(7985) c4(34099, 47156, 60213, 21042, 73270) c5(d, b, re, f, e, iT); #c1(ORC2) c2(NP_006181) c3(7986) c4(34100, 47157, 60214, 21043, 73271) c5(pR); #c1(ORC3) c2(NP_001184188) c3(7987) c4(34101, 47158, 60215, 21044, 73272) c5(A, B, cT, abf, P, w, fl, aD); #c1(ORC4) c2(NP_001177810) c3(7988) c4(34102, 47159, 60216, 21045, 73273) c5(alp, cnh, cT); #c1(ORC5) c2(NP_002544) c3(7989) c4(34103, 47160, 60217, 21046, 73274) c5(wh, b, h, M, do, oJ, n); #c1(ORC6) c2(NP_055136) c3(7990) c4(34104, 47161, 60218, 21047, 73275) c5(V, b, ad, alp, cs, x, U, cni); #c1(ORM1) c2(NP_000598) c3(7991) c4(34105, 47162, 60219, 21048, 73276) c5(dj, cy, b, aY, aaP, aE, sJ, T, cM, dc, fM, aA, jG, qe, gl); #c1(ORM2) c2(NP_000599) c3(7992) c4(34106, 47163, 60220, 21049, 73277) c5(aaP, Dq, jG, V); #c1(ORMDL3) c2(NP_001307731) c3(7993) c4(34107, 47164, 60221, 21050, 73278) c5(jH, nl, cy, aC, JR, f, Kc, aD, ti, O, I, aA, Mn, aE, qe); #c1(OS9) c2(NP_001017956) c3(7994) c4(34108, 47165, 60222, 21051, 73279) c5(aX, I, aC, di, at, aE); #c1(OSBP2) c2(NP_001269667) c3(7995) c4(34109, 47166, 60223, 21052, 73280) c5(jG, aW); #c1(OSBP) c2(NP_002547) c3(7996) c4(34110, 47167, 60224, 21053, 73281) c5(ag, Fy, Pk, eX, b); #c1(OSBPL10) c2(NP_001167531) c3(7997) c4(34111, 47168, 60225, 21054, 73282) c5(bL, eX, q, eH, Fy, bm, o); #c1(OSBPL11) c2(NP_073613) c3(7998) c4(34112, 47169, 60226, 21055, 73283) c5(fl, eX, bf, aA, aM, ap); #c1(OSBPL1A) c2(NP_060500) c3(7999) c4(34113, 47170, 60227, 21056, 73284) c5(aA, cV, cp); #c1(OSBPL2) c2(NP_001265578) c3(8000) c4(34114, 47171, 60228, 21057, 73285) c5(bgN); #c1(OSBPL3) c2(NP_056365) c3(8001) c4(34115, 47172, 60229, 21058, 73286) c5(HI, fl); #c1(OSBPL5) c2(NP_065947) c3(8002) c4(34116, 47173, 60230, 21059, 73287) c5(bw, b, ag); #c1(OSBPL6) c2(NP_001188409) c3(8003) c4(34117, 47174, 60231, 21060, 73288) c5(ac, cz); #c1(OSBPL8) c2(NP_001003712) c3(8004) c4(34118, 47175, 60232, 21061, 73289) c5(dx, du); #c1(OSBPL9) c2(XP_011538901) c3(8005) c4(34119, 47176, 60233, 21062, 73290) c5(bqN, dA); #c1(OSCAR) c2(NP_001269278) c3(8006) c4(34120, 47177, 60234, 21063, 73291) c5(dx, bf, du, dv, be); #c1(OSER1)

c2(XP_011527155) c3(8007) c4(34121, 47178, 60235, 21064, 73292) c5(d, qs, A, f, aOT, bu, fe, di, gF, by, e); #c1(OSGEP) c2(NP_060277) c3(8008) c4(34122, 47179, 60236, 21065, 73293) c5(et, di, alp, ac, qK); #c1(OSGIN1) c2(NP_892026) c3(8009) c4(34123, 47180, 60237, 21066, 73294) c5(jE, bb, b, bm, f, q, jo, ff, u, y); #c1(OSM) c2(NP_065391) c3(8010) c4(34124, 47181, 60238, 21067, 73295) c5(bL, f, b, gK, cY, cO, eH, w, id, Dy, ji, vl, A, y, jT, aX, yE, aEa, aDw, qd, zh, q, aC, mR, B, k, cs, NB, Hs, u, O, g, em, ax, rN, I, cV, qL, Oq, be, fO, J, gL, gv, W, ME, T, Jj, ad, vA, pi, av, jU, dH, cW, aV, da, bq, bm, hT, gd, cT, oi, fP, fq, iB, bh, aA); #c1(OSMR) c2(NP_001161827) c3(8011) c4(34125, 47182, 60239, 21068, 73296) c5(cW, jh, vR, aw, b, cnj, m, cY, ad, X, P, fl, T, cs, aC, ar, aaK, fy, u, av, y); #c1(OSR1) c2(XP_006712005) c3(8012) c4(34126, 47183, 60240, 21069, 73297) c5(avO, d, qs, A, bb, dA, Jt, f, aOT, bu, fe, di, gF, by, e); #c1(OSR2) c2(NP_001135934) c3(8013) c4(34127, 47184, 60241, 21070, 73298) c5(eG, Nq); #c1(OSTF1) c2(NP_036515) c3(8014) c4(34128, 47185, 60242, 21071, 73299) c5(FU, at, aV, o, dA); #c1(OSTM1) c2(NP_054747) c3(8015) c4(34129, 47186, 60243, 21072, 73300) c5(zl, cnk, akg, cnl, LG); #c1(OTC) c2(NP_000522) c3(8016) c4(34130, 47187, 60244, 21073, 73301) c5(fn, gK, hT, aw, Rx, aF, cnm, fN, jB, gB, bn, di, xl, aeQ, aiz, UK, cno, q, bqC, aeA, aiC, o, em, Ps, ma, bfJ, gH, nW, Bu, dt, KK, UT, BW, aig, aVd, c, Lc, gs, ch, hg, ayl, ni, cnn, ayr, aA, gw, Ik, ap); #c1(OTOA) c2(NP_001155155) c3(8017) c4(34131, 47188, 60245, 21074, 73302) c5(alH, ao, enp); #c1(OTOF) c2(NP_004793) c3(8018) c4(34132, 47189, 60246, 21075, 73303) c5(alH, cnq, beV, na, hM, Bx, ow); #c1(OTOG) c2(NP_001264198) c3(8019) c4(34133, 47190, 60247, 21076, 73304) c5(bj, bb, PY, cnr); #c1(OTOGL) c2(NP_775862) c3(8020) c4(34134, 47191, 60248, 21077, 73305) c5(cns); #c1(OTOL1) c2(NP_001073909) c3(8021) c4(34135, 47192, 60249, 21078, 73306) c5(auz); #c1(OTOP1) c2(NP_819056) c3(8022) c4(34136, 47193, 60250, 21079, 73307) c5(aRh, aRe); #c1(OTOR) c2(NP_064542) c3(8023) c4(34137, 47194, 60251, 21080, 73308) c5(cnt); #c1(OTP) c2(NP_115485) c3(8024) c4(34138, 47195, 60252, 21081, 73309) c5(Yv); #c1(OTUB1) c2(NP_060140) c3(8025) c4(34139, 47196, 60253, 21082, 73310) c5(X, vp, hU); #c1(OTUD1) c2(NP_001138845) c3(8026) c4(34140, 47197, 60254, 21083, 73311) c5(sJ); #c1(OTUD4) c2(NP_001096123) c3(8027) c4(34141, 47198, 60255, 21084, 73312) c5(d, jT, en, cB, b, cV, h, J, W, Xp, fU, T, cl, kY, ar, A, fy, u, e, y); #c1(OTUD7A) c2(NP_570971) c3(8028) c4(34142, 47199, 60256, 21085, 73313) c5(aNV, q, b, cO); #c1(OTUD7B) c2(XP_011508087) c3(8029) c4(34143, 47200, 60257, 21086, 73314) c5(q, b); #c1(OTULIN) c2(NP_612357) c3(8030) c4(34144, 47201, 60258, 21087, 73315) c5(b); #c1(OTX1) c2(NP_055377) c3(8031) c4(34145, 47202, 60259, 21088, 73316) c5(d, rQ, jR, cz, hS, A, u, e, y); #c1(OTX2) c2(NP_001257453) c3(8032) c4(34146, 47203, 60260, 21089, 73317) c5(g, avX, cnz, aMZ, HS, Mn, e, y, d, bb, kH, bj, cnv, ak, cnw, aNb, cB, u, Ry, fp, bgj, aSw, cnu, cnx, nW, bDj, Nx, chq, kl, pk, jR, cny, kD, biS); #c1(OVCA2) c2(NP_543012) c3(8033) c4(34147, 47204, 60261, 21090, 73318) c5(co, lb, eu, jR, X, jV, av); #c1(OVOL1) c2(NP_004552) c3(8034) c4(34148, 47205, 60262, 21091, 73319) c5(fq, b, cV); #c1(OVOL2) c2(NP_067043) c3(8035) c4(34149, 47206, 60263, 21092, 73320) c5(b); #c1(OXA1L) c2(NP_005006) c3(8036) c4(34150, 47207, 60264, 21093, 73321) c5(aw, b, X, pR, iU, pD, wy, D, O, U, adr, e, y, aIL, d, co, aX, il, ag, t, re, f, F, q, fr, do, kz, ik, aO, ar, av, u, iT, V, I, cV, el, ft, ais, G, T, cy, fx, fp, yG, aq, nG, os, Ru, gd, dX, i, I, at, ap);

c1(OXCT1) c2(NP_000427) c3(8037) c4(34151, 47208, 60265, 21094, 73322) c5(l, ch, q, cnA, aA, bm, O, cp); #c1(OXER1) c2(NP_683765) c3(8038) c4(34152, 47209, 60266, 21095, 73323) c5(d, qp, hW, I, Fw, Jq, cy, ag, P, w, dn, aX, aA, eN, A, e); #c1(OXGR1) c2(XP_005254103) c3(8039) c4(34153, 47210, 60267, 21096, 73324) c5(g); #c1(OXR1) c2(NP_001185461) c3(8040) c4(34154, 47211, 60268, 21097, 73325) c5(ao, f, v, dA); #c1(OXSR1) c2(NP_005100) c3(8041) c4(34155, 47212, 60269, 21098, 73326) c5(d, qs, A, f, aOT, bu, fe, di, fl, gF, by, e); #c1(OXT) c2(XP_011527540) c3(8042) c4(34156, 47213, 60270, 21099, 73327) c5(jJ, A, tu, bS, fr, dj, rd, mk, fU, di, bro, cA, e, cM, TC, d, co, eA, ahj, fq, zn, f, Dd, y, hb, aqV, av, u, dh, JB, ma, hW, pN, B, Bs, ft, Rj, Ej, yz, rQ, T, cV, x, cz, vv, Ew, qp, aai, aY, aq, agU, ih, cbH, Af, dc, od, aA, rr); #c1(OXTR) c2(NP_000907) c3(8043) c4(34157, 47214, 60271, 21100, 73328) c5(cku, b, fr, jJ, aqV, di, cA, ahq, gZ, cM, co, cy, eA, ahj, Wk, rr, f, aQj, as, av, fy, u, oJ, JB, fU, hW, an, sH, avS, cz, adM, rQ, T, bp, ft, vv, Ew, wh, qp, aY, UJ, amD, tO, ih, gu, agc, dc, aqK, aA, at, y); #c1(P2RX1) c2(NP_002549) c3(8044) c4(34158, 47215, 60272, 21101, 73329) c5(dj, ak, yN, f, je, ao, iU, M, cnB, u); #c1(P2RX2) c2(NP_001269093) c3(8045) c4(34159, 47216, 60273, 21102, 73330) c5(dj, yN, ak, ao, iU, M, hS, cnC, u); #c1(P2RX3) c2(XP_011543372) c3(8046) c4(34160, 47217, 60274, 21103, 73331) c5(M, ao, iU, yN, b, eG, ak, dj, ajM, yp, aUo, ft, u); #c1(P2RX4) c2(NP_001243725) c3(8047) c4(34161, 47218, 60275, 21104, 73332) c5(M, ao, yN, ak, dj, iU, ih, hS, iZ, di, cO, u, aW); #c1(P2RX5) c2(NP_001191448) c3(8048) c4(34162, 47219, 60276, 21105, 73333) c5(yg, ao, M, yN, b, qL, h, ak, J, iU, dj, do, fP, bpB, jG, u, ja, y, ic); #c1(P2RXG) c2(NP_001153026) c3(8049) c4(34163, 47220, 60277, 21106, 73334) c5(fh, ao, bb, yN, b, ak, dj, QV, iU, M, di, bq, OG, at, u, ap); #c1(P2RX7) c2(NP_002553) c3(8050) c4(34164, 47221, 60278, 21107, 73335) c5(Dr, oC, A, awg, b, cO, iU, ns, Ey, m, qa, nt, nq, nr, nn, cA, bf, no, gZ, aO, gO, TH, M, np, aX, I, aW, ag, cp, wG, h, ak, cT, yp, iZ, ar, cM, n, aV, u, dh, aoh, dj, vR, xc, nQ, cV, aC, auA, v, fO, J, yN, QK, og, eX, cy, jU, et, wW, aM, to, qW, ao, nV, hU, abv, pS, hX, ie, B, ih, aY, zT, nm, fP, jN, i, dc, I, di, at, wr, y, ic); #c1(P2RY11) c2(NP_002557) c3(8051) c4(34165, 47222, 60279, 21108, 73336) c5(bq, do, id, bk, b); #c1(P2RY12) c2(NP_795345) c3(8052) c4(34166, 47223, 60280, 21109, 73337) c5(dx, bL, id, b, He, aZm, vZ, cnB, bf, aO, go, m, bb, f, eN, wY, kX, o, cV, du, cd, BZ, jm, aR, eX, bq, aM, at, Ic, fD, di, gl, ap); #c1(P2RY13) c2(NP_795713) c3(8053) c4(34167, 47224, 60281, 21110, 73338) c5(dx, dv, du, jH); #c1(P2RY14) c2(NP_055694) c3(8054) c4(34168, 47225, 60282, 21111, 73339) c5(jH); #c1(P2RY1) c2(NP_002554) c3(8055) c4(34169, 47226, 60283, 21112, 73340) c5(dx, f, k, iU, A, ic, O, m, Fp, yN, ak, M, B, kX, u, tK, dj, du, P, ao, eN, cT, at); #c1(P2RY2) c2(NP_788085) c3(8056) c4(34170, 47227, 60284, 21113, 73341) c5(dx, ak, b, fr, iU, A, di, ic, y, M, qs, dv, bb, yN, zJ, B, q, cU, u, o, dj, cV, du, v, bp, ft, P, iA, pi, sP, ao, fw, ag, bk, bq); #c1(P2RY4) c2(NP_002556) c3(8057) c4(34171, 47228, 60285, 21114, 73342) c5(cV); #c1(P2RY6) c2(NP_001264134) c3(8058) c4(34172, 47229, 60286, 21115, 73343) c5(ed, k, uj, ui, cV, bp, ag); #c1(P2RY8) c2(XP_005274835) c3(8059) c4(34173, 47230, 60287, 21116, 73344) c5(t, ajy, nU, J, G, iv, aq); #c1(P3H2) c2(NP_001127890) c3(8060) c4(34174, 47231, 60288, 21117, 73345) c5(cnD, g, aX, b, o, u, y); #c1(P3H3) c2(NP_055077) c3(8061) c4(34175, 47232, 60289, 21118, 73346) c5(asL, ao, en, b, bwk, u, aXQ, aXP, be, Vr, w, T, o, Pv, tF, OA, Ba, cG, y); #c1(P3H4) c2(NP_006446) c3(8062) c4(34176, 47233, 60290, 21119, 73347) c5(IY, Jd); #c1

(P4HA1) c2(NP_000908) c3(8063) c4(34177, 47234, 60291, 21120, 73348) c5(u, y); #c1(P4HA2) c2(XP_005272177) c3(8064) c4(34178, 47235, 60292, 21121, 73349) c5(oy, cV, X, DM, eu, DI, u, y); #c1(P4HB) c2(NP_000909) c3(8065) c4(34179, 47236, 60293, 21122, 73350) c5(A, b, aE, sJ, cO, bf, al, xU, y, cp, ed, bb, ae, AX, f, q, bu, aC, O, u, dh, fh, aag, I, cV, qL, mc, v, by, P, II, bq, aYY, anf, aM, ao, PY, eo, kA, akX, at, h); #c1(P4HTM) c2(NP_808807) c3(8066) c4(34180, 47237, 60294, 21123, 73351) c5(fr, beO, beQ, ft); #c1(PA2G4) c2(NP_006182) c3(8067) c4(34181, 47238, 60295, 21124, 73352) c5(g, A, b, Mi, B, bu, T, rb, ar, u, y); #c1(PABPC1) c2(XP_005250918) c3(8068) c4(34182, 47239, 60296, 21125, 73353) c5(co, DG, f, B, ape, P, A, ik, II, OA, u, y, apz); #c1(PABPC3) c2(NP_112241) c3(8069) c4(34183, 47240, 60297, 21126, 73354) c5(dA); #c1(PABPC4L) c2(NP_001108206) c3(8070) c4(34184, 47241, 60298, 21127, 73355) c5(qf, at); #c1(PABPN1) c2(NP_004634) c3(8071) c4(34185, 47242, 60299, 21128, 73356) c5(AA, Am, en, nl, cnE, dt, oD, o, Au, aKG, bZS, fy, bAn, xl, apz); #c1(PACRG) c2(NP_001073848) c3(8072) c4(34186, 47243, 60300, 21129, 73357) c5(ahN, qf, aMI, aWI, am, t, pR, vU, J, G, Bm, jG, bj); #c1(PACS1) c2(NP_060496) c3(8073) c4(34187, 47244, 60301, 21130, 73358) c5(nU, rd, P, IV, aA, cnF); #c1(PACS2) c2(NP_001094383) c3(8074) c4(34188, 47245, 60302, 21131, 73359) c5(bb); #c1(PACSIN1) c2(XP_011512843) c3(8075) c4(34189, 47246, 60303, 21132, 73360) c5(d, HI, si, e, oH, ik, fH, fJ); #c1(PACSIN2) c2(NP_001171899) c3(8076) c4(34190, 47247, 60304, 21133, 73361) c5(A, J); #c1(PAD14) c2(XP_011539452) c3(8077) c4(34191, 47248, 60305, 21134, 73362) c5(en, b, qd, X, wy, ig, ic, bW, bf, e, y, d, Ag, aX, sm, py, zc, f, jf, fP, nZ, ar, aO, cs, UM, aV, u, dh, QH, il, cV, aC, be, aeM, v, gY, T, Ca, J, ad, Lx, aM, jH, auJ, bbF, Ic, aE, Lo, Lu, Af, at, ap); #c1(PAEP) c2(NP_001018059) c3(8078) c4(34192, 47249, 60306, 21135, 73363) c5(B, aw, w, hM, bf, pz, O, vr, CN, eE, kX, g, arp, aC, od, jT, dL, pq, aiL, wh, bIH, fN, De, ag, cT, dc, aZA, Kt, cY, Dv, eu, ig, U, cM, co, rY, pp, f, vQ, bu, cs, av, bm, V, nl, gv, iA, if, aY, pv, b, aGk, z, gZ, bb, atF, Be, re, q, X, ar, u, aE, kF, im, qL, ad, pF, CF, ao, cnH, fl, y, A, EN, CE, di, C, iL, gE, al, cnG, jx, aX, ja, cU, oJ, jZ, yd, cV, bwU, P, T, II, by, aM, hq, agc, bh, eG, aCR); #c1(PAF1) c2(NP_001243755) c3(8079) c4(34193, 47250, 60307, 21136, 73364) c5(b, nf, g, ag, mY, bm, ajH); #c1 (PAFAH1B1) c2(NP_000421) c3(8080) c4(34194, 47251, 60308, 21137, 73365) c5(dx, aw, FT, bdZ, pz, BO, bQ, cy, kT, t, kX, TP, Jl, bK, sH, du, fO, vc, Q, QZ, jT, pq, tO, cT, qP, pH, pJ, hS, NH, pK, JE, y, yt, co, ps, N, iv, fy, hD, aew, cnl, FR, Vm, cK, fw, pj, ji, ci, pv, afE, b, tG, Fm, nU, beb, jV, ap, jG, u, o, gL, pF, G, Io, oV, wd, iw, mk, he, fg, acb, aiF, Xd, aeX, jR, vg, eM, dl, aX, h, gT, M, n, aiH, J, P, cz, pc, NG, MP, bM, at); #c1(PAFAH1B2) c2(NP_001171675) c3(8081) c4(34195, 47252, 60309, 21138, 73366) c5(amo, gL); #c1(PAFAH2) c2(XP_011539830) c3(8082) c4(34196, 47253, 60310, 21139, 73367) c5(at); #c1(PAG1) c2(XP_011515867) c3(8083) c4(34197, 1047254, 60311, 21140, 73368) c5(A, avX, b, X, aF, jz, aN, hS, O, U, xw, kV, y, jQ, alS, co, t, h, nU, ps, Be, iZ, jT, B, iv, pB, av, fy, u, Qx, Dp, og, Kx, jh, lb, cs, J, bp, gv, T, fO, bt, ad, hw, aCr, ast, bh); #c1(PAGE1) c2(NP_003776) c3(8084) c4(34198, 47255, 60312, 21141, 73369) c5(A, aX, b, B, wy, ac); #c1(PAGE4) c2(NP_008934) c3(8085) c4(34199, 47256, 60313, 21142, 73370) c5(A, aX, V, b, B, bu, aw, U, wy); #c1(PAGE5) c2(NP_001013453) c3(8086) c4(34200, 47257, 60314, 21143, 73371) c5(ck, aX, b); #c1(PAGR1) c2(NP_078792) c3(8087) c4(34201, 47258, 60315, 21144, 73372) c5(bjV, by, wu, Zz, P, X, aF, qJ, f, azG, cT, bu, cv, BY, y, bzq, av, cp, u, aW, aeo); #c1(PAH) c2(NP_000268) c3(8088) c4(34202, 47259, 60316, 21145, 73373) c5(Ib, nU, pV, b, adf, gw, A, Co, gF, y, jh, co, cy, pp, ni, cz, f, q, ik, fx, qB, as, fy, u, bk, em, ajs, hW, il, an, cs, KL, ad, dt, IX, cnK, eX, iy, Bb, Ap, qe, IR, cnJ, bm, Ai, IS, cnL, i, HV, sc, qh, PK); #c1(PAICS) c2(NP_001072992) c3(8089) c4(34203, 47260, 60317, 21146, 73374) c5(PS, f, A, b, afg); #c1 (PAIP1) c2(NP_006442) c3(8090) c4(34204, 47261, 60318, 21147, 73375) c5(at); #c1(PAIP2) c2(XP_011541730) c3(8091) c4(34205, 47262, 60319, 21148, 73376) c5(f, T, II, n); #c1(PAK1) c2(NP_002567) c3(8092) c4(34206, 47263, 60320, 21149, 73377) c5(by, nU, aw, b, X, EM, eu, w, sU, iL, U, A, e, y, d, BO, co, aX, cl, bj, f, q, bu, ar, B, cs, hV, av, ZU, u, dh, o, ff, mz, bm, V, aC, aSw, dB, v, gL, ad, W, jo, T, iD, fy, Dd, aol, jT, nV, eF, dP, aq, Ic, P, bnq, agk, Ol, od, yA, fh, eG, Xm); #c1(PAK1IP1) c2(NP_060376) c3(8093) c4(34207, 47264, 60321, 21150, 73378) c5(f); #c1(PAK2) c2(NP_002568) c3(8094) c4(34208, 47265, 60322, 21151, 73379) c5(PJ, o, A, X, aol, f, bu, qL, P, Dd, II, z, av, ZU, u, jD, y, sU); #c1(PAK3) c2(NP_001121639) c3(8095) c4(34209, 47266, 60323, 21152, 73380) c5(dx, nU, b, aeX, jz, HG, cnM, hS, A, U, xw, e, y, jQ, d, BO, co, aX, t, KA, f, jV, bu, cU, cc, B, cB, fy, u, LK, oJ, du, V, cV, Ib, nx, nz, LR, gm, v, P, dv, hq, JY, aoO, wh, qp, G, he, m, cT, i, I, Ez); #c1(PAK4) c2(NP_001014832) c3(8096) c4(34210, 47267, 60324, 21153, 73381) c5(d, by, A, Dd, b, bj, f, q, bu, od, ad, T, B, cs, hw, ZU, aol, e, O, rR); #c1(PAK6) c2(NP_001263646) c3(8097) c4(34211, 47268, 60325, 21154, 73382) c5(A, b, f, B, i, I, u, y); #c1(PAK7) c2(NP_065074) c3(8098) c4(34212, 47269, 60326, 21155, 73383) c5(b, Y, bj, er, he, bu, y, U, by, u, aW); #c1(PALB2) c2(NP_078951) c3(8099) c4(34213, 47270, 60327, 21156, 73384) c5(A, b, X, MS, di, kY, hw, bf, y, aX, ak, ar, B, pt, av, u, ajt, ff, fe, gO, aC, afn, zU, aff, Up, pq, qN, cnO, ag, agm, cnN, oM, at); #c1(PALD1) c2(NP_055246) c3(8100) c4(34214, 47271, 60328, 21157, 73385) c5(oy, dx, dv, b, kJ, du, ad, ag, ar, fv, cs, x, hw, aA, u, y); #c1(PALLD) c2(NP_001159580) c3(8101) c4(34215, 47272, 60329, 21158, 73386) c5(dx, eX, b, hw, y, qf, dv, bb, kJ, f, fv, cs, ar, pP, fh, du, ad, x, u, cnP, ag, hq, at, ap); #c1(PALM2-AKAP2) c2(NP_009134) c3(8102) c4(34216, 47273, 60330, 21159, 73387) c5(yD); #c1(PAM16) c2(NP_057153) c3(8103) c4(34217, 47274, 60331, 21160, 73388) c5(yE, A, OW); #c1 (PAM) c2(NP_620177) c3(8104) c4(34218, 47275, 60332, 21161, 73389) c5(aw, fd, sJ, w, hM, JC, ey, y, bjV, co, aX, aGt, B, alx, aZB, ar, O, fy, u, cl, g, iF, I, cV, Fw, nl, J, bp, aZD, bmt, ih, iB, aA, yC, gl); #c1(PAMR1) c2(NP_001001991) c3(8105) c4(34219, 47276, 60333, 21162, 73390) c5(c, nz, N, bu, fg, by, xl); #c1(PAN2) c2(NP_001120932) c3(8106) c4(34220, 47277, 60331163391) c5(U, V, b); #c1(PAN3) c2(NP_787050) c3(8107) c4(34221, 47278, 60335, 21164, 73392) c5(ag, bb); #c1(PANK1) c2(NP_612189) c3(8108) c4(34222, 47279, 60336, 21165, 73393) c5(axi, f, v, PE); #c1(PANK2) c2(NP_705902) c3(8109) c4(34223, 47280, 60337, 21166, 73394) c5(aAt, PC, xM, f, v, QI, HS, PD, bM, PE, axi, aPY); #c1(PANX1) c2(NP_056183) c3(8110) c4(34224, 47281, 60338, 21167, 73395) c5(jH, aX, X, P, fP, jU, O); #c1 (PANX2) c2(NP_443071) c3(8111) c4(34225, 47282, 60339, 21168, 73396) c5(bb, rY, O); #c1(PAOX) c2(NP_690875) c3(8112) c4(34226, 47283, 60340, 21169, 73397) c5(A, bb, B, co, ar, bk, u, y); #c1(PAPD7) c2(XP_005248291) c3(8113) c4(34227, 47284, 60341, 21170, 73398) c5(Bu, f, re, ak, co, U, iT, V); #c1(PAPL) c2(NP_001004318) c3(8114) c4(34228, 47285, 60342, 21171, 73399) c5(q, I, vQ); #c1(PAPOLA) c2(NP_001238935) c3(8115) c4(34229, 47286, 60343, 21172, 73400) c5(vq, eK, V, J, zY, eu, w, bk, cO, bf, aA, jl, zW, wT); #c1(PAPOLG) c2(NP_075045) c3(8116) c4(34230, 47287, 60344, 21173, 73401) c5(vq, aX, fJ, b, fH); #c1(PAPPA2) c2(NP_068755) c3(8117) c4(34231, 47288, 60345, 21174, 73402) c5(gA, eQ, b); #c1(PAPPA) c2(NP_002572) c3(8118) c4(34232, 47289, 60346, 21175, 73403) c5(bP, dx, id, aw, b, X, Dv, ix, cO, Eh, y, aHA, co, oJ, tg, av, u, wp, m, sj, du, aNS, dU, dv, hR, wh, dO, aq, eQ, hq, acp, Nq, Ns, oi, fP, fD, bq, at, eG); #c1(PAPSS1) c2(NP_005434) c3(8119) c4(34233, 47290, 60347, 21176, 73404) c5(bb, b, q, gv, iL, bh, at, bm); #c1(PAPSS2) c2(NP_001015880) c3(8120) c4(34234, 47291, 60348, 21177, 73405) c5(rM, bQ, ID, cnU, cnR, nU, wq, cnT, cnS, cnQ); #c1(PAQR3) c2(NP_001035292) c3(8121) c4(34235, 47292, 60349, 21178, 73406) c5(aX, V, fN, et, yA, aA, dL, U); #c1(PAQR5) c2(NP_060175) c3(8122) c4(34236, 47293, 60350, 21179, 73407) c5(hW, eO); #c1(PAQR7) c2(XP_011539164) c3(8123) c4(34237, 47294, 60351, 21180, 73408) c5(dx, dv, du, dt, A, B); #c1(PARD3B) c2(NP_001289698) c3(8124) c4(34238, 47295, 60352, 21181, 73409) c5(t, aA, do); #c1(PARD3) c2(NP_001171714) c3(8125) c4(34239, 47296, 60353, 21182, 73410) c5(A, b, DO, dB, ig, w, C, e, d, jh, aX, wG, B, q, cl, gg, aq, da, LR, W, T, jl, jH, wh, st, u, ie, tl, yA); #c1(PARD6A) c2(NP_001032358) c3(8126) c4(34240, 47297, 60354, 21183, 73411) c5(co, aC, MP, od, fy, o); #c1(PARD6B) c2(NP_115910) c3(8127) c4(34241, 47298, 60355, 21184, 73412) c5(ak); #c1(PARG) c2(NP_001290415) c3(8128) c4(34242, 47299, 60356, 21185, 73413) c5(wK, jl, SV, b, Kj, bm, f, fl, O, cs, u, y); #c1(PARK2) c2(NP_004553) c3(8129) c4(34243, 47300, 60357, 21186, 73414) c5(B, Rx, dB, Ip, w, bf, O, zi, iy, t, ji, oN, lb, nz, zj, gm, bp, Re, x, jT, bAv, jE, bAQ, ag, pt, aA, GJ, bP, aWI, arB, X, H, bw, U, TD, y, V, co, f, cc, cs, av, fy, bm, cnW, em, ajs, rN, dA, v, kp, BV, alM, VP, pJ, JY, aNc, P, Qa, oM, bLG, b, acE, aF, bg, jV, nU, q, MV, pn, ff, pB, jG, u, da, alX, ad, G, zk, et, ajd, bBt, HN, eo, ih, Bm, fl, cG, bL, bUq, A, aMI, pR, gw, di, HS, iL, bj, aX, LI, h, xJ, bAr, M, aC, zp, n, cnV, nQ, GS, J, jo, bTz, T, II, GR, bM, cz, ac, aM, eJ, xM, agw, I, bh, at); #c1(PARL) c2(NP_001032728) c3(8130) c4(34244, 47301, 60358, 21187, 73415) c5(f, I, fC, eX, qr, at); #c1(PARM1) c2(NP_056208) c3(8131) c4(34245, 47302, 60359, 21188, 73416) c5(Jx, A, B, e0); #c1(PARN) c2(NP_001127949) c3(8132) c4(34246, 47303, 60360, 21189, 73417) c5(ag, b, cV); #c1(PARP12) c2(NP_073587) c3(8133) c4(34247, 47304, 60361, 21190, 73418) c5(en, f, II); #c1(PARP14) c2(NP_060024) c3(8134) c4(34248, 47305, 60362, 21191, 73419) c5(f0); #c1(PARP15) c2(NP_001106995) c3(8135) c4(34249, 47306, 60363, 21192, 73420) c5(bf); #c1(PARP1) c2(NP_001609) c3(8136) c4(34250, 47307, 60364, 21193, 73421) c5(dx, by, B, pV, Ob, Yq, cnY, aiW, dB, HG, w, lu, cO, aw, bNG, e, xl, gO, M, cy, kJ, t, dl, Gp, cI, cq, gl, R, g, cnX, Fx, aeM, aC, bK, du, gm, bp, ft, aaD, axM, cV, Tp, fx, jT, fp, pq, bm, DO, ag, cT, pH, iT, i, pt, aA, id, pD, cY, ie, vD, jz, eu, wy, kB, aeD, fU, NH, dV, kY, vp, ajw, Lr, U, cM, tp, co, px, f, agm, bu, dZ, ky, O, cs, av, fy, avg, pW, is, V, jh, iK, n, Qz, bq, cK, iA, buB, aYm, dY, qO, abs, zS, apM, ci, abB, hV, b, aF, m, ic, ey, d, eE, bb, yQ, fv, jd, re, nU, GR, q, es, nF, ar, Tr, HE, jG, u, dh, o, fh, Qo, Zz, I, afW, Mi, gL, ad, G, mW, et, et, Ut, WZ, iw, ao, nV, hU, py, vT, aE, zZ, gd, atb, fl, I, fj, cnZ, A, bf, iG, asx, fr, fw, gN, ea, jc, C, iL, bj, yw, aW, jQ, c, aX, il, h, oJ, cU, hN, ik, y, nl, aV, ag, ma, qB, nQ, Ea, sj, be, J, ei, W, P, T, fO, oM, jl, Pk, ac, aM, wU, zE, NG, po, Oi, X, at, iE); #c1(PARP2) c2(NP_001036083) c3(8137) c4(34251, 47308, 60365, 21194, 73422) c5(b, wn, ac, Hh, av, aV, u, y); #c1(PARP3) c2(NP_001003931) c3(8138) c4(34252, 47309, 60366, 21195, 73423) c5(dx, dv, cV, an, du, bk, i, as); #c1(PARP4) c2(NP_006428) c3(8139) c4(34253, 47310, 60367, 21196, 73424) c5(bm, jT, at, b, X, bj, q, J, I, i, x, av, bu, aq, dh); #c1(PARP6) c2(NP_064599) c3(8140) c4(34254, 47311, 60368, 21197, 73425) c5(U, et, V); #c1(PARP9) c2(NP_001139574) c3(8141) c4(34255, 47312, 60369, 21198, 73426) c5(b, iU, vB, sJ, jJ, qV, BH, eh, cy, eK, aof, f, q, oE, iv, gg, bm, LR, gm, j, aKK, dt, P, iN, cl, pi, MW, eF, dY, sN, gd, cT, aKP, zO, I); #c1(PARPBP) c2(XP_011536808) c3(8142) c4(34256, 47313, 60370, 21199, 73427) c5(pM, Ke, ag, fl, am, b, kJ, aga, bSX, yE, yy, Ih, pt, bw, oM); #c1(PARS2) c2(XP_011539505) c3(8143) c4(34257, 47314, 60371, 21200, 73428) c5(bb); #c1(PARVA) c2(NP_060692) c3(8144) c4(34258, 47315, 60372, 21201, 73429) c5(IV, b, cO); #c1(PARVB) c2(NP_001003828) c3(8145) c4(34259, 47316, 60373, 21202, 73430) c5(cy, b, jm, T, adF, at, u, y); #c1(PARVG) c2(NP_001131077) c3(8146) c4(34260, 47317, 60374, 21203, 73431) c5(Fs, b); #c1(PASD1) c2(NP_775764) c3(8147) c4(34261, 47318, 60375, 21204, 73432) c5(jT, ck, fO, kE, tI); #c1(PASK) c2(NP_001239048) c3(8148) c4(34262, 47319, 60376, 21205, 73433) c5(f, brm, cz, bf, ac, aM); #c1(PATE1) c2(NP_612151) c3(8149) c4(34263, 47320, 60377, 21206, 73434) c5(A, B); #c1(PATZ1) c2(NP_055138) c3(8150) c4(34264, 47321, 60378, 21207, 73435) c5(dx, wV, dv, b, wP, aiQ, du, wn, ck, jT); #c1(PAWR) c2(XP_006719498) c3(8151) c4(34265, 47322, 60379, 21208, 73436) c5(A, b, fr, cs, aN, jR, cA, bw, O, aK, zf, y, ih, co, aX, IZ, bj, f, CR, q, cU, ar, cM, hb, gg, apv, u, o, gG, hW, cV, ft, sB, v, bp, J, alF, Fo, xq, T, x, bb, iA, ad, Ut, ao, aY, P, fw, B, add, dc, eN, auU); #c1(PAX1) c2(NP_006183) c3(8152) c4(34266, 47323, 60380, 21209, 73437) c5(EO, azz, bga, bAZ, bBd, LD, re, coa, IJ, cC, IG, iT, e, bde, d); #c1(PAX2) c2(NP_000269) c3(8153) c4(34267, 47324, 60381, 21210, 73438) c5(bP, An, b, X, auo, dB, ene, A, Ni, zg, fx, y, jx, yg, fe, aX, kH, Be, aoW, B, Uq, cU, cob, li, uz, hb, cs, sV, UF, yG, u, eG, o, te, xc, ma, wB, FR, Ls, gJ, J, ad, dt, Nz, T, ff, ar, VP, iA, vA, et, aMx, W, pG, fD, avg, jo, uH, i, agQ, zS, vt, pR); #c1(PAX3) c2(NP_000429) c3(8154) c4(34268, 47325, 60382, 21211, 73439) c5(IJ, nU, b, jR, fr, DO, ahS, eu, hS, ic, O, aTh, Ld, aPN, QG, coe, aX, aLv, pL, ml, f, wN, arm, es, ND, Gs, co, apC, nA, cl, fU, cV, bjS, J, ahO, cy, cz, AP, kl, fM, EE, jT, aOO, Yg, cod, Nq, Bg, OJ, na, Ns, amS, XH, kD, bqW); #c1(PAX4) c2(NP_006184) c3(8155) c4(34269, 47326, 60383, 21212, 73440) c5(eX, aX, I, t, mB, bf, ND, fD, TT, cof, ey, aE, aM); #c1(PAX5) c2(NP_001267476) c3(8156) c4(34270, 47327, 60384, 21213, 73441) c5(amC, jl, ml, aw, dB, en, PZ, bf, O, e, xl, yg, it, jT, cy, Vx, col, qc, t, fP, cl, jq, fH, cq, awS, g, Ad, lb, afh, gm, bp, KK, avi, fx, hR, mO, pq, aDJ, yG, M, aZg, fc, ie, rS, cT, w, i, dc, bq, aA, GJ, coj, Dr, id, QF, bS, cG, X, aiV, oa, jz, aFy, hS, Ou, U, xw, aVC, cM, co, Ov, pp, ag, f, N, aWQ, bu, aaS, B, iv, av, fy, bm, iT, aEq, YV, V, fC, nl, gv, aVB, aff, atl, pi, fJ, YU, ate, anG, aY, er, fw, xe, og, wT, WH, b, Pv, qz, ajW, bg, d, bb, apG, re, hV, cok, g, es, IY, ar, VM, oO, jG, u, o, Zz, I, FL, Jt, j, by, pB, G, atm, avL, pD, pa, aeC, afj, Jd, jH, nV, ig, hX, iR, Bu, Bg, en, ih, fg, acF, fl, cgH, ds, TP, go, A, k, fr, gE, bPi, coi, cdP, axA, fe, AQ, aGA, JG, iC, wf, jR, bj, iK, jx, RX, qs, S, VD, cog, Aa, h, F, cU, aC, jQ, y, cB, XH, aV, dj, fU, E, di, m, an, J, W, P, T, fO, aX, nP, AP, fM, eJ, qp, bbF, Ic, Rd, eX, sf, coh, Yv, bh, at, eG, as); #c1(PAXG) c2(NP_001245391) c3(8157) c4(34271, 47328, 60385, 21214, 73442) c5(dx, ml, aw, sd, EM, w, bf, cor, aTh, O, cov, JZ, cou, mz, fe, du, Ij, QZ, fx, kl, cos, fy, f, ag, i, pt, aA, Bt, bNc, hS, ate, U, y, anJ, co, kH, anl, mL, DH, bu, k, B, nR, coc, V, dA, eX, mF, pk, aQB, jR, aEQ, kD, vL, uy, b, zx, cot, kW, nU, coo, aM, u, aqS, I, qA, aru, cz, coq, ct, aGi, ch, Bu, Ns, vZ, acK, bbN, A, con, cop, In, gn, di, asn, aX, fa, bkn, cB, cow, dj, ajG, hW, NV, nQ, KU, dt, Po, T, oM, by, AP, cft, pp, com, Nq, bFf, HM, rZ); #c1(PAX8) c2(NP_003457) c3(8158) c4(34272, 47329, 60386, 21215, 73443) c5(Dr, aw, b, cox, X, Sc, dB, aMP, Bd, hM, iq, e, jx, d, Bi, hV, cU, ra, EN, ar, av, fy, nV, te, fe, VD, Xu, aow, J, W, qp, T, aYz, iA, bwD, ii, QN, iu, nc, aq, og, zU, agQ, od, eG); #c1(PAX9) c2(NP_006185) c3(8159) c4(34273, 47330, 60387, 21216, 73444) c5(aX, zE, bjG, amQ, Nq, coy, ND, Ns, cl, amR, ckg, nP, apU, AP, bjD); #c1(PAXIP1) c2(NP_031375) c3(8160) c4(34274, 47331, 60388, 21217, 73445) c5(o); #c1(PBK) c2(XP_006716431) c3(8161) c4(34275, 47332, 60389, 21218, 73446) c5(ban, b, gG, pD, MS, ck, Iv, U, y, co, aX, E, f, q, es, eE, cs, u, kF, V, bp, ad, fx, jT, fl, i, fl, alQ); #c1(PBLD) c2(NP_001028255) c3(8162) c4(34276, 47333, 60390, 21219, 73447) c5(yi); #c1(PBOV1) c2(NP_067648) c3(8163) c4(34277, 47334, 60391, 21220, 73448) c5(A, i, b, B, nJ, O, aJ, fx, u, y); #c1(PBRM1) c2(NP_060783) c3(8164) c4(34278, 47335, 60392, 21221, 73449) c5(en, aw, nr, b, pR, gG, dB, ns, nm, nt, nq, iG, nn, no, np, y, hh, co, pw, Sl, ak, Mr, ff, u, dj, bp, jo, T, VP, he, ag); #c1(PBX1) c2(NP_001191890) c3(8165) c4(34279, 47336, 60393, 21222, 73450) c5(hg, apS, bf, ps, coz, cp, cU, t, IV, gl, oP, fe, lb, ajy, Jj, jT, iz, wh, ie, yE, cT, mD, aA, PG, avX, X, eu, rd, aiR, OV, y, bBS, f, e, aoe, B, iv, av, fy, bm, iF, rV, iA, pk, cf, b, wa, jy, d, q, jV, hb, oO, u, I, qu, G, pD, Mw, rQ, DR, pa, A, mW, di, Iv, jw, zY, m, aX, h, avW, yx, Ug, M, aC, oJ, HI, an, J, W, P, T, Ap, coA, vt, as); #c1(PBX2) c2(NP_002577) c3(8166) c4(34280, 47337, 60394, 21223, 73451) c5(da, jH, Mw, cy, I, m, h, HE, aX, fy); #c1(PBX3) c2(NP_001128250) c3(8167) c4(34281, 47338, 60395, 21224, 73452) c5(A, hf, h, B, J, HG, ig, Ns, bq, Nq); #c1(PBX4) c2(NP_079521) c3(8168) c4(34282, 47339, 60396, 21225, 73453) c5(t, G, AP); #c1(PCBD1) c2(NP_000272) c3(8169) c4(34283, 47340, 60397, 21226, 73454) c5(adf, DT, gE, bf, ahN, amo, bgK, zW, mz, Pu, I, Mi, fO, cz, MW, coB, et, aM, VE, bM, aA, vt); #c1(PCBD2) c2(NP_115527) c3(8170) c4(34284, 47341, 60398, 21227, 73455) c5(azt, I, BV, cs, x, lm, ad); #c1(PCBP1) c2(NP_006187) c3(8171) c4(34285, 47342, 60399, 21228, 73456) c5(b, u, q, P, nA, cK, bm, ap); #c1(PCBP2) c2(NP_001092090) c3(8172) c4(34286, 47343, 60400, 21229, 73457) c5(d, A, b, apx, gE, e); #c1(PCBP3) c2(NP_001123613) c3(8173) c4(34287, 47344, 60401, 21230, 73458) c5(ak); #c1(PCBP4) c2(XP_005265387) c3(8174) c4(34288, 47345, 60402, 21231, 73459) c5(A, avX, b, X, aF, jz, aN, O, U, xw, kV, y, jQ, alS, co, ps, h, nU, Be, B, iv, pB, aCr, fy, u, Qx, Dp, og, Kx, jh, lb, cs, J, bp, ad, T, fO, jT, av, ast); #c1(PCCA) c2(NP_000273) c3(8175) c4(34289, 47346, 60403, 21232, 73460) c5(XY, em, bb, V, coC, ar, at); #c1(PCCB) c2(NP_000523) c3(8176) c4(34290, 47347, 60404, 21233, 73461) c5(XY, em, coC, V, ar); #c1(PCDH10) c2(NP_116586) c3(8177) c4(34291, 47348, 60405, 21234, 73462) c5(by, aw, b, eu, hS, BY, iL, U, KH, ec, jT, t, re, nU, q, bu, cU, zp, Yr, jG, iT, R, V, J, fO, gm, G, zk, T, cz, M, rQ, IG, hT, Gh, bMw, UT, at); #c1(PCDH11X) c2(NP_001161832) c3(8178) c4(34292, 47349, 60406, 21235, 73463) c5(aQT, wp, Ks, he, jw, jv, o); #c1(PCDH11Y) c2(NP_116753) c3(8179) c4(34293, 47350, 60407, 21236, 73464) c5(jv, A, hW, he, cz); #c1(PCDH15) c2(NP_001136235) c3(8180) c4(34294, 47351, 60408, 21237, 73465) c5(ow, cy, coE, bq, cfO, ml, cO, nW, aC, Fy, aRb, o, alG, Bx, alE, IV, nR, coF, coD, alF); #c1(PCDH17) c2(XP_005266414) c3(8181) c4(34295, 47352, 60409, 21238, 73466) c5(Ez, fx, i, b, jh); #c1(PCDH18) c2(NP_001287757) c3(8182) c4(34296, 47353, 60410, 21239, 73467) c5(m, cV, bj, cp); #c1(PCDH19) c2(NP_001098713) c3(8183) c4(34297, 47354, 60411, 21240, 73468) c5(coG, hT, aw, KH, rQ, ec, IG, nz, nU, yH, Gh, hS, bMw, bb, zk, cz, zp); #c1(PCDH1) c2(NP_001265542) c3(8184) c4(34298, 47355, 60412, 21241, 73469) c5(cy, dP, fq, ti, aD, ge); #c1(PCDH20) c2(NP_073754) c3(8185) c4(34299, 47356, 60413, 21242, 73470) c5(bf, fy, Fg); #c1(PCDH7) c2(NP_001166994) c3(8186) c4(34300, 47357, 60414, 21243, 73471) c5(bb, dA, sX, cV, hS, i, bf, at, Qx); #c1(PCDH8) c2(NP_002581) c3(8187) c4(34301, 47358, 60415, 21244, 73472) c5(dx, A, b, du, dB, dv, QZ, at, u, y); #c1(PCDH9) c2(NP_065136) c3(8188) c4(34302, 47359, 60416, 21245, 73473) c5(rQ, b, Wk, cz, w, eO, aA, O); #c1(PCDHA1) c2(NP_061723) c3(8189) c4(34303, 47360, 60417, 21246, 73474) c5(ak, b); #c1(PCDHA4) c2(NP_061730) c3(8190) c4(34304, 47361, 60418, 21247, 73475) c5(ach, ak, GL, coH, jJ, Ey, qa, aM, VG, cA, bf, gZ, cM, Wj, bb, rr, f, oE, Gj, aV, em, dj, hW, I, hv, aQL, aaB, wq, eX, Sp, jH, aY, XH, jN, dc, aA, jP, Gn); #c1(PCDHA6) c2(NP_061732) c3(8191) c4(34305, 47362, 60419, 21248, 73476) c5(kn, yU, o, I, cp); #c1(PCDHB1) c2(NP_037472) c3(8192) c4(34306, 47363, 60420, 21249, 73477) c5(Qx, cV); #c1(PCDHB2) c2(NP_061759) c3(8193) c4(34307, 47360421, 21250, 73478) c5(dA); #c1(PCDHB3) c2(NP_061760) c3(8194) c4(34308, 47365, 60422, 21251, 73479) c5(dA); #c1(PCDHB8) c2(NP_061993) c3(8195) c4(34309, 47366, 60423, 21252, 73480) c5(aX); #c1(PCDHGA11) c2(NP_061737) c3(8196) c4(34310, 47367, 60424, 21253, 73481) c5(O, k); #c1(PCDHGA3) c2(NP_061739) c3(8197) c4(34311, 47368, 60425, 21254, 73482) c5(Nk); #c1(PCDHGB4) c2(NP_003727) c3(8198) c4(34312, 47369, 60426, 21255, 73483) c5(W, ar); #c1(PCDHGB6) c2(NP_061749) c3(8199) c4(34313, 47370, 60427, 21256, 73484) c5(u); #c1(PCDHGC3) c2(NP_002579) c3(8200) c4(34314, 47371, 60428, 21257, 73485) c5(W, U, T, V); #c1(PCED1B) c2(NP_001268358) c3(8201) c4(34315, 47372, 60429, 21258, 73486) c5(oy, o); #c1(PCF11) c2(NP_056969) c3(8202) c4(34316, 47373, 60430, 21259, 73487) c5(P); #c1(PCGF1) c2(NP_116062) c3(8203) c4(34317, 47374, 60431, 21260, 73488) c5(aC); #c1(PCGF2) c2(XP_005257698) c3(8204) c4(34318, 47375, 60432, 21261, 73489) c5(A, aw, b, B, jR, bu, T, by, u, y); #c1(PCGF3) c2(XP_006713915) c3(8205) c4(34319, 47376, 60433, 21262, 73490) c5(aHX, aHW, dA); #c1(PCGF6) c2(NP_001011663) c3(8206) c4(34320, 47377, 60434, 21263, 73491) c5(gm); #c1(PC) c2(XP_011543388) c3(8207) c4(34321, 47378, 60435, 21264, 73492) c5(gK, f, b, fE, jg, jL, avJ, y, cR, co, cy, dN, SS, nU, awx, vu, u, dT, pD, qe, aOo, ii, ch, rv, eG); #c1(PCID2) c2(NP_001120675) c3(8208) c4(34322, 47379, 60436, 21265, 73493) c5(aUM, eN, O, bpr); #c1(PCK1) c2(NP_002582) c3(8209) c4(34323, 47380, 60437, 21266, 73494) c5(dx, gK, eX, I, rh, ch, du, q, fD, bf, aA, o, aM); #c1(PCK2) c2(NP_001018083) c3(8210) c4(34324, 47381, 60438, 21267, 73495) c5(mz, eX, I, b, col, bm, YA, f, q, xj, fN, Oi, bf, ey, dL, aM); #c1(PCL0) c2(NP_055325) c3(8211) c4(34325, 47382, 60439, 21268, 73496) c5(nU, I, aY, ak, cz, do, bmi, dc, cA, cM, alM); #c1(PCM1) c2(NP_006188) c3(8212) c4(34326, 47383, 60440, 21269, 73497) c5(nV, si, coJ, TD, og, T, iv, oO, av, vt); #c1(PCMT1) c2(NP_001238978) c3(8213) c4(34327, 47384, 60441, 21270, 73498) c5(IJ, bf, jw, Ap, aE, aM); #c1(PCMTD1) c2(NP_001273711) c3(8214) c4(34328, 47385, 60442, 21271, 73499) c5(bq, md, sr, dA); #c1(PCNA) c2(NP_872590) c3(8215) c4(34329, 47386, 60443, 21272, 73500) c5(B, aw, zw, aHH, rR, gG, Vz, w, aHB, vp, ps, e, O, cy, ajF, kJ, t, DB, nZ, Me, azc, coK, cl, fH, wh, yG, gl, oP, g, fe, kM, lb, bK, cs, fO, gm, bp, ft, ME, zU, Jj, x, fx, jT, jC, aJH, cq, ata, mF, Qk, F, DD, ag, cT, iT, i, pt, aA, bT, dB, fl, pD, fi, cY, jz, eu, aJp, bf, bw, U, Oh, y, ed, co, px, ip, yE, f, jf, IN, bu, Be, aPh, iv, Qw, av, fy, bm, kq, wP, aEq, iF, jB, Bd, V, coL, v, Qz, gv, alf, alM, iy, iA, Lx, fJ, YU, Vx, ahT, GB, aJX, aen, py, cf, To, dY, Be, iu, qO, oM, kD, ci, ap, OG, ck, b, aEi, Hr, Bi, ic, Dg, Fr, vn, BQ, d, jh, Zg, zJ, MX, re, hV, PA, q, jV, es, X, mL, ar, aEr, hb, n, pB, Nf, jG, qT, u, dh, o, fh, da, jE, I, qL, LR, Fs, gL, ad, as, G, sf, ew, Ca, ct, aeC, wy, wd, Qx, apG, cW, wV, nV, Eu, hX, iR, hT, HN, GM, ex, aof, fl, I, C, GK, A, IO, iL, k, fr, Lv, HJ, mW, BY, og, Iv, JC, gE, ji, Nm, jQ, m, Ez, aX, il, Qm, h, aDQ, cU, aC, ik, oJ, cB, aV, jZ, fp, fU, cV, an, hZ, jd, GS, BC, J, W, P, T, II, bh, jl, nP, by, aYw, fM, aM, qp, ce, ale, vu, Ic, OW, jF, E, Lj, at, eG, ja, rb); #c1(PCNT) c2(NP_006022) c3(8216) c4(34330, 47387, 60444, 21273, 73501) c5(B, b, aHH, coM, cA, bf, y, yQ, ak, aq, o, hW, fO, ais, bp, coO, QZ, avF, aM, u, coN, WS); #c1(PCNXL2) c2(NP_055616) c3(8217) c4(34331, 47388, 60445, 21274, 73502) c5(U, at, bb, Id, I); #c1(PCNXL4) c2(NP_071940) c3(8218) c4(34332, 47389, 60446, 21275, 73503) c5(Qx); #c1(PCOLCE2) c2(NP_037495) c3(8219) c4(34333, 47390, 60447, 21276, 73504) c5(xq, ez); #c1(PCOLCE) c2(NP_002584) c3(8220) c4(34334, 47391, 60448, 21277, 73505) c5(er); #c1(PCP2) c2(NP_777555) c3(8221) c4(34335, 47392, 60449, 21278, 73506) c5(fv, sl); #c1(PCP4) c2(NP_006189) c3(8222) c4(34336, 47393, 60450, 21279, 73507) c5(wh, Fw, W, oJ, x, aq, iK); #c1(PCSK1) c2(NP_000430) c3(8223) c4(34337, 47394, 60451, 21280, 73508) c5(eX, rd, coP, hM, C, bf, ey, jw, coQ, cr, or, rh, ak, adR, DZ, adQ, aE, o, kF, I, dA, aC, be, mD, jT, aM, gs, ii, OW, ch, i, bq, di, aA, at, afm); #c1(PCSK1N) c2(NP_037403) c3(8224) c4(34338, 47395, 60452, 21281, 73509) c5(rb, aA, bS, o); #c1(PCSK2) c2(NP_001188457) c3(8225) c4(34339, 47396, 60453, 21282, 73510) c5(ao, ma, gs, I, ra, ch, DW, W, yE, nV, eO, bb, aA, jT, et, bq, o, gO); #c1(PCSK4) c2(NP_060043) c3(8226) c4(34340, 47397, 60454, 21283, 73511) c5(fy, T); #c1(PCSK5) c2(NP_001177411) c3(8227) c4(34341, 47398, 60455, 21284, 73512) c5(agG, bDk, du, hq, hQ, coR, acw, blp, aSw, bKS, sE, dv, LB, aZ, LA, bOD, aV, et, dx, bji); #c1(PCSK6) c2(NP_002561) c3(8228) c4(34342, 47399, 60456, 21285, 73513) c5(oy, FD, dO, yQ, b, dx, X, adr, du, cV, B, dv, w, y, A, O, av, u, coS, ic); #c1(PCSK7) c2(NP_004707) c3(8229) c4(34343, 47400, 60457, 21286, 73514) c5(yK, h, dB, ex, bh, gv, u, y); #c1(PCTP) c2(NP_001095872) c3(8230) c4(34344, 47401, 60458, 21287, 73515) c5(I, gB, jN, i); #c1(PCYT1A) c2(NP_005008) c3(8231) c4(34345, 47402, 60459, 21288, 73516) c5(IJ, coT, b, wy, ck, bW, kV, y, aX, bj, h, B, q, M, Mr, ik, O, A, jG, u, o, Lg, il, aC, fO, rw, kS, aL, wV, re, Nq, wP, Ns, bH, at); #c1(PCYT1B) c2(NP_001156736) c3(8232) c4(34346, 47403, 60460, 21289, 73517) c5(p); #c1(PDAP1) c2(NP_055706) c3(8233) c4(34347, 47404, 60461, 21290, 73518) c5(vq, b, eu, w, yn, cO, bf, zY, aoK, jl, re, as, zW, iT, V, an, Hh, J, eK, bk, aA, wT); #c1(PDCD10) c2(NP_665859) c3(8234) c4(34348, 47405, 60462, 21291, 73519) c5(g, hT, b, f, coU, do, OI); #c1(PDCD1) c2(NP_005009) c3(8235) c4(34349, 47406, 60463, 21292, 73520) c5(gE, Kt, b, gU, eM, jz, gn, mW, alV, IE, ix, Iv, iL, z, vp, aYE, y, jQ, m, aX, jd, fH, re, MU, yh, mR, HQ, Dd, jG, aV, u, gl, da, nl, im, aC, Oq, be, gL, vc, aE, T, II, vM, et, fJ, jH, ig, fc, jZ, rq, P, coV, fP, bq, iB, od, iu, bT); #c1(PDCD1LG2) c2(NP_079515) c3(8236) c4(34350, 47407, 60464, 21293, 73521) c5(DT, ix, z, e, d, m, aX, h, bu, ik, n, fH, aV, aE, V, il, aC, nl, gL, by, P, fJ, fc, rq, bY, cT, bh, iu, bT); #c1(PDCD2) c2(NP_001186391) c3(8237) c4(34351, 47408, 60465, 21294, 73522) c5(ji, co, b, jT, gm, J, T, iv, ar, fy, aE); #c1(PDCD4) c2(NP_001186421) c3(8238) c4(34352, 47409, 60466, 21295, 73523) c5(Dr, g, ml, jE, b, qd, X, amF, gG, mW, O, BY, w, IW, U, A, e, y, d, yg, co, cy, DE, kJ, h, f, q, jV, bu, ar, B, cs, av, u, gl, oJ, yJ, fi, V, il, jh, nl, gm, bp, ad, W, jo, T, ff, iD, x, nP, by, qe, wh, nV, iK, bm, jR, agb, m, cT, agQ, atR, Bi, jU); #c1(PDCD5) c2(NP_004699) c3(8239) c4(34353, 47410, 60467, 21296, 73524) c5(by, co, V, b, k, fr, ft, h, be, q, J, kB, iL, aC, ji, U, bu, jG, O); #c1(PDCD6) c2(NP_001254485) c3(8240) c4(34354, 47411, 60468, 21297, 73525) c5(by, co, aX, b, X, jG, bp, bu, xQ, i, cs, aw, av, ad, fx); #c1(PDCD6IP) c2(NP_001155901) c3(8241) c4(34355, 47412, 60469, 21298, 73526) c5(co, bb, b, I, Eo, P, dv, fl, aX, fy, dl); #c1(PDCD7) c2(NP_005698) c3(8242) c4(34356, 47413, 60470, 21299, 73527) c5(h); #c1(PDC) c2(NP_072098) c3(8243) c4(34357, 47414, 60471, 21300, 73528) c5(f, X, ml, aN, di, wh, cO, h, hV, hue, jU, av, JY, u, nW, ae, nz, J, fO, dB, kN, aib, pq, ao, bkZ, xM, HN, bY, ew, aA, dR, bT); #c1(PDCL2) c2(NP_689614) c3(8244) c4(34358, 47415, 60472, 21301, 73529) c5(by, bu); #c1(PDCL3) c2(NP_076970) c3(8245) c4(34359, 47416, 60473, 21302, 73530) c5(eJ); #c1(PDE10A) c2(NP_001124162) c3(8246) c4(34360, 47417, 60474, 21303, 73531) c5(bjk, iq, afx, bK, Ia, ak, IW, ao, he, v, ih, vu, hM, qB, GF, at, bq); #c1(PDE11A) c2(NP_001070664) c3(8247) c4(34361, 47418, 60475, 21304, 73532) c5(A, b, iF, jj, wy, agj, cA, Lr, coW, Hq, cy, am, jk, Jq, Km, avP, bLI, vN, W, ck, bbl, Lt, nk, aY, HR); #c1(PDE12) c2(NP_808881) c3(8248) c4(34362, 47419, 60476, 21305, 73533) c5(w); #c1(PDE1A) c2(NP_001003683) c3(8249) c4(34363, 47420, 60477, 21306, 73534) c5(dx, aY, t, du, G, zf); #c1(PDE1B) c2(NP_000915) c3(8250) c4(34364, 47421, 60478, 21307, 73535) c5(cT, xJ, afx); #c1(PDE1C) c2(NP_001177986) c3(8251) c4(34365, 47422, 60479, 21308, 73536) c5(IR, IV); #c1(PDE2A) c2(NP_001137311) c3(8252) c4(34366, 47423, 60480, 21309, 73537) c5(aC, aF, U, u, V); #c1(PDE3A) c2(NP_000912) c3(8253) c4(34367, 47424, 60481, 21310, 73538) c5(NT, am, aC, ch, IW, wn, di, cO, bq, ap); #c1(PDE3B) c2(NP_000913) c3(8254) c4(34368, 47425, 60482, 21311, 73539) c5(P, m, kF, I, k, t, Fs, Kh, IX, cT, hM, wt, IW, fq, Co, G); #c1(PDE4A) c2(NP_001104777) c3(8255) c4(34369, 47426, 60483, 21312, 73540) c5(asL, Ib, A, b, jz, cA, U, cM, jQ, aX, adv, DM, B, adO, aD, g, V, HV, v, cz, ti, aZ, cy, jT, aY, gd, cT, dc, I, at, ap); #c1(PDE4D) c2(NP_001098101) c3(8256) c4(34370, 47427, 60484, 21313, 73541) c5(dx, bL, nU, iq, ql, agT, qa, di, KF, bf, eP, A, pl, aO, dv, bh, brm, coY, yp, ik, yB, fh, wK, fD, sj, Fb, du, coX, xq, eX, bq, cy, dO, EZ, fw, cT, w, fz, dc, I, vZ, aA, at); #c1(PDE5A) c2(NP_001074) c3(8257) c4(34371, 47428, 60485, 21314, 73542) c5(fl, dN, sO, IW, xh, xf, sU, cO, bf, U, Co, y, aX, Ks, cK, f, tE, fH, xd, u, dh, adL, ma, V, VL, sH, mc, bd, IR, qt, P, T, bq, x, bb, hR, fJ, aM, hU, IX, ch, IS, bk, bh, bT, ap); #c1(PDE6A) c2(NP_000431) c3(8258) c4(34372, 47429, 60486, 21315, 73543) c5(coZ, nW, ml); #c1(PDE6B) c2(NP_000274) c3(8259) c4(34373, 47430, 60487, 21316, 73544) c5(nQ, cpb, ml, aCo, cpa, iU, ea, yn, ayr, nE, nW); #c1(PDE6C) c2(NP_006195) c3(8260) c4(34374, 47431, 60488, 21317, 73545) c5(nQ, Pa, xq, aQB, cpd, aQz, nE, cpc, ml); #c1(PDE6D) c2(NP_002592) c3(8261) c4(34375, 47432, 60489, 21318, 73546) c5(P, LR, cpe); #c1(PDE6G) c2(NP_002593) c3(8262) c4(34376, 47433, 60490, 21319, 73547) c5(cpf, nW, LR, yn); #c1(PDE6H) c2(NP_006196) c3(8263) c4(34377, 47434, 60491, 21320, 73548) c5(Pa, cph, cpg); #c1(PDE7A) c2(NP_001229247) c3(8264) c4(34378, 47435, 60492, 21321, 73549) c5(gd, cT, bk, yM, IW, I); #c1(PDE7B) c2(NP_061818) c3(8265) c4(34379, 47436, 60493, 21322, 73550) c5(cT); #c1(PDE8A) c2(NP_002596) c3(8266) c4(34380, 47437, 60494, 21323, 73551) c5(bq, P, bQ, kF); #c1(PDE8B) c2(NP_001025022) c3(8267) c4(34381, 47438, 60495, 21324, 73552) c5(cpk, Hq, iq, rh, cpi, v, bcK, W, vN, hM, o, xM, jk, bq, aA, cpj, avP, biT); #c1(PDE9A) c2(NP_001001567) c3(8268) c4(34382, 47439, 60496, 21325, 73553) c5(aY, aq, cA, cy, v); #c1(PDF) c2(NP_071736) c3(8269) c4(34383, 47440, 60497, 21326, 73554) c5(A); #c1(PDGFA) c2(NP_002598) c3(8270) c4(34384, 47441, 60498, 21327, 73555) c5(dx, bn, aw, zw, b, k, fr, afY, iP, cpl, dB, pv, sJ, w, dV, iG, IW, bw, Co, e, aO, d, Ag, fe, co, aX, eA, jd, hV, wv, cy, OC, dZ, ar, O, av, u, bQX, RJ, du, tl, gG, LR, Fs, j, by, IX, aHG, dv, T, fl, aZ, rT, cl, aeC, jT, gg, yG, aDJ, Jh, PY, agb, yE, et, iD, Af, Yv, bq, od, at, eG, aG); #c1(PDGFB) c2(NP_002599) c3(8271) c4(34385, 47442, 60499, 21328, 73556) c5(dx, jK, bn, b, k, X, aGv, iP, aav, aFe, w, ic, iG, IW, vp, bT, y, zl, co, aX, dv, jd, pz, ml, q, M, fr, cpm, O, bw, gg, u, bXf, cpn, bQX, g, du, fs, kP, hZ, sH, LR, J, gL, ft, lx, iJ, P, nV, aSb, j, Io, bh, cy, aYj, jG, pq, ao, bOY, hU, ch, cpo, jR, tO, ct, fl, T, pv, bp, h, aG); #c1(PDGFC) c2(NP_057289) c3(8272) c4(34386, 47443, 60500, 21329, 73557) c5(dx, Dr, fl, b, iP, dB, eC, y, pp, aX, ip, bxk, hV, q, cl, cs, bYO, u, Xu, sH, du, bp, ny, hU, BX, Nq, jR, tO, ape, Ns, apU); #c1(PDGFD) c2(NP_079484) c3(8273) c4(34387, 47444, 60501, 21330, 73558) c5(dx, A, b, iP, eu, di, iG, bw, bf, sx, yw, y, dv, bb, LN, et, f, B, u, fh, gG, du, tz, dB, T, bp, wd, hU, pp, jR, at); #c1(PDGFRA) c2(XP_006714102) c3(8274) c4(34388, 47445, 60502, 21331, 73559) c5(dx, IJ, B, pV, aZ, zh, EM, gG, Tw, Ty, w, aw, ps, fx, O, LL, t, cl, jq, fH, bkS, g, og, ayJ, du, jE, bp, ft, aqg, jT, fp, wh, F, ie, ag, cT, qP, bkQ, i, aTi, Al, cY, afY, aiE, eu, NH, bw, U, y, cps, tp, ak, N, IN, bu, iv, pH, av, fy, bm, iT, vR, V, FK, cy, Qt, cy, fJ, in, ape, apH, b, cpp, QB, z, cpq, bb, eA, jd, Qu, Tp, q, QE, DC, vu, ar, Tr, jG, u, o, bQX, FL, gL, by, G, iD, aeC, hX, aid, cpr, Bg, agb, agf, fg, aKO, A, k, fr, gw, jl, jR, hP, c, aX, h, wN, gT, M, aC, oJ, qB, cpt, fU, oS, Fs, J, QI, T, j, AP, fM, qp, NG, mo, Nq, bFf, XH, X, at, eG); #c1(PDGFRB) c2(NP_002600) c3(8275) c4(34389, 47446, 60503, 21332, 73560) c5(gK, B, pV, dB, aav, Tw, w, bKi, O, zi, iy, oS, cl, kX, g, fe, asQ, cpv, ft, od, cV, fx, jv, jE, bm, ag, cT, qP, pH, i, bkv, pJ, X, afY, wy, NH, kY, IW, U, Oh, y, bC, co, f, N, cy, cpw, av, fy, aBU, vR, V, Xr, LL, iY, jR, pj, aG, ck, b, oi, aiE, clg, eA, jd, q, cpu, ff, jG, u, o, bQX, bU, fs, LR, j, by, iD, jH, cdd, hU, VQ, eh, py, agb, fg, aKO, A, pK, k, fr, gw, aZK, og, di, jx, aX, LI, h, M, qB, tp, J, bks, dU, QI, T, pF, fM, jT, NG, vu, Jh, adu, Oi); #c1(PDGFRL) c2(XP_011542860) c3(8276) c4(34390, 47447, 60504, 21333, 73561) c5(d, V, dA, q, ix, T, iD, cs, ar, e); #c1(PDHA1) c2(NP_000275) c3(8277) c4(34391, 47448, 60505, 21334, 73562) c5(ake, A, aw, cpx, SS, aIU, bu, bM, aNO, at); #c1(PDHB) c2(NP_000916) c3(8278) c4(34392, 47449, 60506, 21335, 73563) c5(aNO, dB, cpy); #c1(PDHX) c2(NP_001128496) c3(8279) c4(34393, 47450, 60507, 21336, 73564) c5(nU, b, fl, bf, ey, m, Ml, kJ, f, bu, cpz, fv, av, aE, aay, R, mz, fs, I, by, T, eX, bq, aNO, aM, aKy, mB, hT, ag, mD, bT); #c1(PDIA2) c2(NP_006840) c3(8280) c4(34394, 47451, 60508, 21337, 73565) c5(cr, I, cV, q, amO, bf, su, u, y, aM); #c1(PDIA3) c2(NP_005304) c3(8281) c4(34395, 47452, 60509, 21338, 73566) c5(A, aw, b, X, DT, cA, e, y, gO, d, aX, am, h, B, q, vQ, bu, ar, n, kX, av, Hs, u, ajz, dj, gv, bh, f, eo, iT, akX, eG, re); #c1(PDIA4) c2(NP_004902) c3(8282) c4(34396, 47453, 60510, 21339, 73567) c5(fP); #c1(PDIA5) c2(NP_006801) c3(8283) c4(34397, 47454, 60511, 21340, 73568) c5(ez); #c1(PDIA6) c2(NP_001269633) c3(8284) c4(34398, 47455, 60512, 21341, 73569) c5(b, q, fH, u, fJ, y, cp); #c1(PDK1) c2(NP_001265478) c3(8285) c4(34399, 47456, 60513, 21342, 73570) c5(B, b, dB, A, tH, c0, U, Oh, y, co, bb, il, bpo, h, hV, bu, ik, cM, mR, u, Qx, V, I, J, fO, by, P, T, x, aX, ast, nV, Fr, Oi, aA); #c1(PDK2) c2(NP_001186828) c3(8286) c4(34400, 47457, 60514, 21343, 73571) c5(cK, aA, I, b); #c1(PDK3) c2(NP_001135858) c3(8287) c4(34401, 47458, 60515, 21344, 73572) c5(cY, cpA, ac, cG); #c1(PDK4) c2(NP_002603) c3(8288) c4(34402, 47459, 60516, 21345, 73573) c5(eX, I, ch, f, q, cO, cK, aA, at, bm, bT); #c1(PDLIM1) c2(NP_066272) c3(8289) c4(34403, 47460, 60517, 21346, 73574) c5(oB, f, aIM, o, azq); #c1(PDLIM2) c2(NP_067643) c3(8290) c4(34404, 47461, 60518, 21347, 73575) c5(V, b, f, jz, eC, U, wd, jQ); #c1(PDLIM3) c2(NP_001107579) c3(8291) c4(34405, 47462, 60519, 21348, 73576) c5(ml, fr, wy, bo, hR, q, mR, cs, TW, bm, TV, aC, fO, ft, P, od, rO, ad, TU, Io, TX, bT); #c1(PDLIM4) c2(NP_001124499) c3(8292) c4(34406, 47463, 60520, 21349, 73577) c5(ih, A, aw, b, bm, h, f, q, n, ad, DI, B, kY, cs, kF, u, DM, y, cp); #c1(PDLIM5) C2(NP_001011513) c3(8293) c4(34407, 47464, 60521, 21350, 73578) c5(bP, oC, f, bS, b, Hv, EM, jz, Ip, A, sF, iL, cA, U, y, jQ, Kp, h, ak, q, n, zm, mR, B, iv, oO, oD, jG, sK, u, zb, hW, V, I, cV, C, cs, J, aLD, P, II, ad, pq, Tv, pG, aY, tW, hT, G, ag, aIM, aXS, aA, at, wr, ib, lv); #c1(PDLIM7) c2(NP_005442) c3(8294) c4(34408, 47465, 60522, 21351, 73579) c5(by, A, aw, zw, b, cpB, gw, iX, eu, pD, Ip, Zs, Ku, anh, zL, jD, y, bkT, d, jh, co, jl, pp, f, e, q, bu, Mr, ciR, B, Pv, ar, kN, jM, u, aZC, cs, gm, J, aoN, T, II, fH, ad, fJ, cq, jT, lu, pS, aKa, bm, Yg, P, dY, aof, cT, aVx, CL, aEk, iB, aJV, IA, aEN); #c1(PDP1) c2(NP_001155251) c3(8295) c4(34409, 47466, 60523, 21352, 73580) c5(ake, b, SS, hT, J, P, Ny, aNO, cpC, bfT, baL); #c1(PDP2) c2(NP_065837) c3(8296) c4(34410, 47467, 60524, 21353, 73581) c5(aX, xj); #c1(PDPK1) c2(NP_001248745) c3(8297) c4(34411, 47468, 60525, 21354, 73582) c5(B, QF, b, dB, A, cO, U, y, co, aX, bpo, kJ, h, hV, q, bu, ik, cM, cs, mR, fy, u, Qx, cl, og, V, il, J, fO, ad, P, T, ar, Fr, by, ast, nV, amu, Oi, aA); #c1(PDPR) c2(NP_060460) c3(8298) c4(34412, 47469, 60526, 21355, 73583) c5(acg); #c1(PDRG1) c2(NP_110442) c3(8299) c4(34413, 47470, 60527, 21356, 73584) c5(f, bm, cs, b, ad); #c1(PDS5A) c2(NP_001093869) c3(8300) c4(34414, 47471, 60528, 21357, 73585) c5(aNS, fl, bb, b, cO); #c1(PDS5B) c2(NP_055847) c3(8301) c4(34415, 47472, 60529, 21358, 73586) c5(jh, o, A, V, b, cV, f, aNS, B, u, y); #c1(PDSS1) c2(NP_055132) c3(8302) c4(34416, 47473, 60530, 21359, 73587) c5(jl, an, bF, he, P, cpD, as, EW, EV); #c1(PDSS2) c2(NP_065114) c3(8303) c4(34417, 47474, 60531, 21360, 73588) c5(ake, co, aX, wd, EW, bd, Oc, fy, fD, EV, et, cpE, te); #c1(PDX1) c2(NP_000200) c3(8304) c4(34418, 47475, 60532, 21361, 73589) c5(bxj, A, b, bx, dD, gG, mC, bw, aNO, bf, ey, gF, Nf, Ml, kJ, f, bu, dl, cpz, VM, fv, aE, R, mz, cpG, fs, I, qq, by, T, eX, Fk, bq, cpF, aM, qp, aKy, ch, mB, mA, ag, fD, mD, aA); #c1(PDXDC1) c2(NP_001272374) c3(8305) c4(34419, 47476, 60533, 21362, 73590) c5(fl, dB); #c1(PDXK) c2(NP_003672) c3(8306) c4(34420, 47477, 60534, 21363, 73591) c5(gK, b, aq, dk, fy, bj); #c1(PDXP) c2(NP_064711) c3(8307) c4(34421, 47478, 60535, 21364, 73592) c5(mZ, aw, b, fr, ds, U, eD, yw, y, d, co, Dq, f, e, aFQ, ky, tE, aJO, av, u, iT, aEq, GS, V, cJ, bK, xf, KU, asM, ad, dt, bel, T, ar, Zd, cpH, ft, cW, alf, ale, Rd, TX, fD, di, re); #c1(PDYN) c2(XP_011527552) c3(8308) c4(34422, 47479, 60536, 21365, 73593) c5(dx, de, cpL, b, aqu, dj, aN, hS, gB, dd, ak, cA, Nw, gZ, kV, e, cM, TC, d, epi, cpK, hF, nQ, aqB, bj, f, do, oE, dl, alY, Go, iZ, bK, cpJ, Gj, aTV, Wj, oN, aqY, Ir, Gr, hW, Kx, alX, cV, jP, aYi, Gu, hv, v, aFE, fq, P, xq, rw, Gl, iN, di, kS, IV, aaJ, du, eB, KL, KR, xM, ape, zp, o, dc, si, abw, at, aY); #c1(PDZD2) c2(NP_835260) c3(8309) c4(34423, 47480, 60537, 21366, 73594) c5(A, aw, b, kh, pR, Nh, dB, cpM, O, w, akL, iL, cO, ai, re, bj, DK, y, d, jh, co, cy, pp, bn, h, f, F, g, jV, e, tF, B, hb, gg, fy, u, o, ff, mz, vR, cV, aC, v, J, jo, T, aj, gC, jT, dL, OA, Bi, ao, nV, Y, fN, HN, P, gd, iT, qO, bT); #c1(PDZD4) c2(NP_001290441) c3(8310) c4(34424, 47481, 60538, 21367, 73595) c5(gn, jx); #c1(PDZD7) c2(NP_001182192) c3(8311) c4(34425, 47482, 60539, 21368, 73596) c5(alH, cpN, ow, Gg, Gc, ml); #c1(PDZD8) c2(NP_776152) c3(8312) c4(34426, 47483, 60540, 21369, 73597) c5(P, hg); #c1(PDZK1) c2(XP_011507918) c3(8313) c4(34427, 47484, 60541, 21370, 73598) c5(dx, nX, nH, gC, b, bm, fP, du, g, fO, dv, A, T, eX, gE, rb, at, u, y, ap); #c1(PDZRN3) C2(NP_001290070) c3(8314) c4(34428, 47485, 60542, 21371, 73599) c5(bq, av, I); #c1(PDZRN4) c2(NP_001158067) c3(8315) c4(34429, 47486, 60543, 21372, 73600) c5(bj, ao, aV, bb, ak); #c1(PEAI5) c2(NP_001284505) c3(8316) c4(34430, 47487, 60544, 21373, 73601) c5(IO, b, k, X, dB, Ip, w, ic, bf, U, y, bQ, hV, O, av, fy, u, o, g, kF, I, cV, sB, bp, co, aM, nV, cT, gP); #c1(PEAK1) c2(NP_079052) c3(8317) c4(34431, 47488, 60545, 21374, 73602) c5(u, ag, Ml, b, kJ); #c1(PEAR1) c2(NP_001073940) c3(8318) c4(34432, 47489, 60546, 21375, 73603) c5(kX, at); #c1(PEBP1) c2(NP_002558) c3(8319) c4(34433, 47490, 60547, 21376, 73604) c5(kM, by, en, axx, b, X, A, kY, O, aw, U, adr, e, y, d, Ag, jT, aX, fv, h, f, q, bu, ik, B, cs, as, ar, av, fy, u, o, PJ, V, il, cV, an, aDM, Xc, fO, biv, aoS, T, bt, ad, jG, fM, bm, iT, nJ, ag, gA, xb, Af, bq, at, re); #c1(PEBP4) c2(NP_659399) c3(8320) c4(34434, 47491, 60548, 21377, 73605) c5(co, V, b, X, gm, di, fy, U, at, u, y); #c1(PECAM1) c2(XP_005276938) c3(8321) c4(34435, 47492, 60549, 21378, 73606) c5(dx, ml, aw, dN, dB, eC, eW, cO, bW, O, BO, dv, cy, Vx, kJ, t, aoF, Dc, R, g, aC, bvP, du, fO, Jj, fy, oQ, aXp, tO, ag, cT, fz, bq, beO, X, fE, eu, Iw, xO, y, ed, Ei, px, DM, f, vQ, B, cs, av, JD, CZ, ae, Bs, IR, aR, eX, ny, beQ, VE, zS, fO, ap, b, bg, eV, aO, jh, bb, MX, bX, hV, q, jV, QE, ar, ff, VM, jG, u, dh, o, qL, qC, cz, BZ, IX, G, Io, ct, aeC, jH, nV, Eu, ch, Cr, IS, fl, bL, A, k, pR, Jc, JC, wf, Ct, m, aX, or, oJ, aV, sH, ma, cV, Be, be, J, W, dU, jo, co, T, tf, mb, Ic, aDy, HM, DI, fP, atR, at); #c1(PECR) c2(NP_060911) c3(8322) c4(34436, 47493, 60550, 21379, 73607) c5(l, nU); #c1(PEG10) c2(NP_001035242) c3(8323) c4(34437, 47494, 60551, 21380, 73608) c5(jE, A, aX, b, Be, bm, q, ag, cT, T, z, QJ, u, y); #c1(PEG3) c2(NP_001139657) c3(8324) c4(34438, 47495, 60552, 21381, 73609) c5(bck, M, A, aX, b, cV, X, re, gG, gm, Ip, ag, GQ, od, iT, avx, O, av, Dd, u, y); #c1(PELI1) c2(XP_011531296) c3(8325) c4(34439, 47496, 60553, 21382, 73610) c5(Pz, I, mk, sK, Io, bf, hR, mO, aM); #c1(PELI2) c2(NP_067078) c3(8326) c4(34440, 47497, 60554, 21383, 73611) c5(bb); #c1(PELP1) c2(NP_001265170) c3(8327) c4(34441, 47498, 60555, 21384, 73612) c5(U, co, Be, V, b, ag, X, B, qL, ajL, A, T, ajV, iA, ar, av, u, hd, y, sT); #c1(PEMT) c2(NP_001254480) c3(8328) c4(34442, 47499, 60556, 21385, 73613) c5(b, di, bf, y, arY, qs, eX, q, nA, aV, u, o, fx, dL, aM, gt, ch, Ng, vT, Ns, i, fN, aA, at); #c1(PENK) c2(NP_001129162) c3(8329) c4(34443, 47500, 60557, 21386, 73614) c5(de, B, aw, b, fr, qa, bj, Ml, kJ, Jr, il, ak, do, ar, A, Wf, fv, Gj, aTV, cpO, SV, afx, bK, ft, cV, iN, fx, IV, PY, ag, xb, jN, i, fl); #c1(PEPD) c2(NP_000276) c3(8330) c4(34444, 47501, 60558, 21387, 73615) c5(m, CX, aX, I, b, fc, sX, gL, fW, Bo, bb, at, u, xp); #c1(PER1) c2(NP_002607) c3(8331) c4(34445, 47502, 60559, 21388, 73616) c5(f, pV, hM, bf, ajf, O, gO, Yj, aOb, aC, p, nz, yO, asM, fx, ag, i, dc, bq, aA, agP, jz, bw, U, cM, co, ak, B, cs, fy, iF, Gr, V, gb, bMF, Xo, eX, aY, dY, apU, ap, b, z, ey, arL, fD, nU, g, jG, u, bzf, aaQ, aZJ, Dg, Jt, cz, et, Yz, Bm, di, A, ZQ, xf, vl, jQ, cr, I, bxB, F, cU, tF, Gs, y, qB, aq, hW, J, P, T, nP, fM, aM, vU, Ng, Jz, bh, at); #c1(PER2) c2(NP_073728) c3(8332) c4(34446, 47503, 60560, 21389, 73617) c5(cpS, dM, Gt, dN, aQf, agP, eu, tR, U, A, ak, gE, aqV, Gy, U, Jz, ra, cM, M, Wj, LS, b, kJ, gc, h, f, g, aqD, cU, NJ, fP, y, cs, aQg, Gj, cpR, dh, o, ng, hW, V, aXV, aC, cpQ, ad, P, wX, eX, NS, bb, jT, jG, Yz, cpP, aY, u, hT, aXU, B, cT, I, dc, aA, at); #c1(PER3) c2(NP_001276790) c3(8333) c4(34447, 47504, 60561, 21390, 73618) c5(f, tr, b, Ng, w, ak, Og, bf, U, Oh, A, y, G, aQi, t, aqs, F, g, NJ, B, cs, bzq, aQg, jG, u, tQ, dj, V, ad, Fy, NS, x, pi, aM, jH, aaN, aY, P, fP, aA, jP); #c1(PERM1) c2(NP_001278296) c3(8334) c4(34448, 47505, 60562, 21391, 73619) c5(aNN, cc); #c1 (PERP) C2(NP_071404) c3(8335) c4(34449, 47506, 60563, 21392, 73620) c5(d, Ag, co, aX, b, X, e, jC, ji, u, auV); #c1(PES1) C2(NP_001230154) c3(8336) c4(34450, 47507, 60564, 21393, 73621) c5(X, ad, cs, av, u, y); #c1(PET100) c2(NP_001164626) c3(8337) c4(34451, 47508, 60565, 21394, 73622) c5(ake, acU); #c1(PET117) c2(NP_001158283) c3(8338) c4(34452, 47509, 60566, 21395, 73623) c5(aSW); #c1(PEX11A) c2(NP_003838) c3(8339) c4(34453, 47510, 60567, 21396, 73624) c5(ao); #c1(PEX12) c2(NP_000277) c3(8340) c4(34454, 47511, 60568, 21397, 73625) c5(cpT, cpU, nf, ajH, bB, mY, ac); #c1(PEX13) c2(NP_002609) c3(8341) c4(34455, 47512, 60569, 21398, 73626) c5(bE, cpW, ex, cpV, bB, cpX, nf); #c1(PEX14) c2(XP_011539880) c3(8342) c4(34456, 47513, 60570, 21399, 73627) c5(pk, cV, nf, cpY, bB, ajZ, u, y); #c1(PEX16) c2(NP_004804) c3(8343) c4(34457, 47514, 60571, 21400, 73628) c5(cpZ, nf, cqa, bB); #c1(PEX19) c2(NP_001180573) c3(8344) c4(34458, 47515, 60572, 21401, 73629) c5(Mh, nf, iP, cqb, bB, cA, fy); #c1(PEX1) c2(NP_000457) c3(8345) c4(34459, 47516, 60573, 21402, 73630) c5(bE, fN, bK, cpW, Nx, bB, mY, nf, ajH); #c1 (PEX26) c2(NP_001121121) c3(8346) c4(34460, 47517, 60574, 21403, 73631) c5(cpW, cqc, ex, cqd, bB, nf, ajH); #c1(PEX2) c2(NP_001165558) c3(8347) c4(34461, 47518, 60575, 21404, 73632) c5(A, LS, cV, nf, cqe, cqf, aA, bB, bb, mY, dh, ajH, bk); #c1(PEX3) c2(NP_003621) c3(8348) c4(34462, 47519, 60576, 21405, 73633) c5(mY, bB, abs, nf, cqg); #c1(PEX5) c2(NP_000310) c3(8349) c4(34463, 47520, 60577, 21406, 73634) c5(cqi, bE, cpW, er, cqh, bB, mY, nf, ajH, ez); #c1(PEX5L) c2(NP_001243679) c3(8350) c4(34464, 47521, 60578, 21407, 73635) c5(1); #c1(PEX6) c2(NP_000278) c3(8351) c4(34465, 47522, 60579, 21408, 73636) c5(bE, bK, nf, nU, cqk, ow, bB, mY, cqj, ajH); #c1(PEX7) c2(NP_000279) c3(8352) c4(34466, 47523, 60580, 21409, 73637) c5(yR, cql, aht, Mh, aBu, bt, bB, si, nv, ajH); #c1(PF4) C2(NP_002610) c3(8353) c4(34467, 47524, 60581, 21410, 73638) c5(dx, jK, gE, b, X, gz, eu, eW, xK, YH, z, y, Ei, cy, dN, h, av, u, Id, be, du, J, fO, dO, hR, jG, fm, Ig, nk, gt, bgh, gd, Dl, at, DM, ap); #c1(PF4V1) c2(NP_002611) c3(8354) c4(34468, 47525, 60582, 21411, 73639) c5(bL, hR, at, bk, b); #c1(PFDN4) c2(NP_002614) c3(8355) c4(34469, 47526, 60583, 21412, 73640) c5(oy, V, Eg, cB, U, u, y); #c1(PFDN5) c2(NP_002615) c3(8356) c4(34470, 47527, 60584, 21413, 73641) c5(nT, J, ag); #c1(PFDN6) c2(NP_001252525) c3(8357) c4(34471, 47528, 60585, 21414, 73642) c5(m); #c1(PFKFB1) c2(NP_001258733) c3(8358) c4(34472, 47529, 60586, 21415, 73643) c5(rf); #c1(PFKFB2) c2(NP_001018063) c3(8359) c4(34473, 47530, 60587, 21416, 73644) c5(aW, b); #c1(PFKFB3) C2(NP_001138915) c3(8360) c4(34474, 47531, 60588, 21417, 73645) c5(fi, hV, Pz, b, k, aC, f, cs, uH, rd, mk, w, bb, bw, aX, aA, at, u, dh, y); #c1(PFKFB4) c2(NP_004558) c3(8361) c4(34475, 47532, 60589, 21418, 73646) c5(A, b, B, w, bw, O); #c1(PFKL) C2(NP_002617) c3(8362) c4(34476, 47533, 60590, 21419, 73647) c5(Mw, acw, ak, ns, aC, nm, nt, ng, nr, nn, zk, no, np, aq, zp); #c1(PFKM) c2(NP_001160158) c3(8363) c4(34477, 47534, 60591, 21420, 73648) c5(l, b, ado, ch, akd, T, oD, at, u, y); #c1(PFKP) c2(NP_001229268) c3(8364) c4(34478, 47535, 60592, 21421, 73649) c5(aA, u, akd, y); #c1(PFN1) c2(NP_005013) c3(8365) c4(34479, 47536, 60593, 21422, 73650) c5(A, bS, b, dB, kY, ai, y, BO, f, g, Vr, kz, ar, B, Ek, OA, u, cgm, rR, uD, v, T, aj, ao, bm, PY, ag, jh); #c1(PFN2) c2(NP_002619) c3(8366) c4(34480, 47537, 60594, 21423, 73651) c5(en, ao, f, by, bu); #c1(PGA3) C2(NP_001073275) c3(8367) c4(34481, 47538, 60595, 21424, 73652) c5(aLH, by, bvW, bu); #c1(PGA4) c2(NP_001073276) c3(8368) c4(34482, 47539, 60596, 21425, 73653) c5(aLH); #c1 (PGA5) c2(NP_055039) c3(8369) c4(34483, 47540, 60597, 21426, 73654) c5(aLH, ali, fP, jH); #c1(PGAM1) c2(NP_002620) c3(8370) c4(34484, 47541, 60598, 21427, 73655) c5(d, Ag, jE, ak, V, b, f, g, bu, T, Af, ar, U, fy, bm, e, O, pg); #c1(PGAM2) c2(NP_000281) c3(8371) c4(34485, 47542, 60599, 21428, 73656) c5(BM, aeT, f, A, cgn, alg); #c1(PGAM4) c2(NP_001025062) c3(8372) c4(34486, 47543, 60600, 21429, 73657) c5(U, V, O); #c1(PGAP1) c2(NP_079265) c3(8373) c4(34487, 47544, 60601, 21430, 73658) c5(aC, bj, cy, cz); #c1(PGAP2) c2(NP_001138910) c3(8374) c4(34488, 47545, 60602, 21431, 73659) c5(f, b, fr, nU, ft, dt, cqq, cqo, cgp, mF); #c1(PGAP3) c2(NP_001278655) c3(8375) c4(34489, 47546, 60603, 21432, 73660) c5(KC, bzf, nU, pV, b, iF, ZQ, jz, Xo, A, hM, ak, z, bMF, bf, U, arL, vl, cM, gO, cU, co, cr, aZJ, bxB, agP, f, F, g, bu, cqr, tF, Gs, y, qB, fM, fy, u, nz, asM, Yj, aaQ, hW, V, aOb, gb, aC, p, Jt, cs, yO, J, cz, xf, P, eX, bh, nP, et, bq, ey, aM, Yz, jQ, at, aY, aq, vO, Ng, dY, B, ajf, ag, cqq, I, Bm, cqo, dc, di, aA, apU, fD, Dg, ap); #c1(PGBD1) c2(NP_001171672) c3(8376) c4(34490, 47547, 60604, 21433, 73661) c5(m, o); #c1(PGBD5) c2(NP_001245240) c3(8377) c4(34491, 47548, 60605, 21434, 73662) c5(alF, bq, dA); #c1(PGC) c2(NP_001159896) c3(8378) c4(34492, 47549, 60606, 21435, 73663) c5(by, ak, b, fr, cqt, dB, gN, aN, A, di, bf, U, ey, y, qH, qs, bQ, aX, eA, cqs, f, q, bu, mR, B, cg, bv, kN, JY, u, aE, o, cc, mz, SA, si, V, I, v, ft, Rk, jo, zU, T, eX, bt, vM, cK, hR, dL, aM, wV, aJJ, bm, nc, MP, wP, fN, aA, wy); #c1(PGD) c2(NP_001291380) c3(8379) c4(34493, 47550, 60607, 21436, 73664) c5(ae, cgu, KK, cy, UI, b, NG, kn, bm, aTZ, el, g, Ck, fC, wn, EM, NH, Xz, aq, jZ); #c1(PGF) c2(NP_001193941) c3(8380) c4(34494, 47551, 60608, 21437, 73665) c5(dx, gK, B, dN, w, cO, bf, azO, dv, aC, sH, du, yO, bp, nV, od, pq, qt, tO, yE, bk, fD, bq, bP, id, vD, wy, iG, IW, U, ed, co, f, e, gX, cs, fy, bm, V, gv, jd, pv, ck, b, zH, dk, d, aiT, Bc, hV, AK, ar, dh, VD, G, rw, ao, PL, Eu, ch, eQ, gd, QP, di, A, azm, pR, aBV, xf, iL, gE, wf, RX, aX, I, h, rR, aq, fU, ap, be, bit, aM, bh, at, eG); #c1(PGGT1B) c2(NP_005014) c3(8381) c4(34495, 47552, 60609, 21438, 73666) c5(zK, ag, Dq, fl, j); #c1(PGK1) c2(NP_000282) c3(8382) c4(34496, 47553, 60610, 21439, 73667) c5(A, b, fd, bRZ, dB, yn, y, yt, aX, Qm, nU, q, bu, aVn, B, cs, bSa, fy, u, n, bm, cV, ad, dt, aNx, T, BW, x, by, pq, bjF, kJ, bSc); #c1(PGK2) c2(NP_620061) c3(8383) c4(34497, 47554, 60611, 21440, 73668) c5(a0); #c1(PGLS) c2(NP_036220) c3(8384) c4(34498, 47555, 60612, 21441, 73669) c5(b, cp); #c1(PGLYRP1) c2(NP_005082) c3(8385) c4(34499, 47556, 60613, 21442, 73670) c5(da, sE, aX, dB, aFp); #c1(PGLYRP2) c2(NP_443122) c3(8386) c4(34500, 47557, 60614, 21443, 73671) c5(d, fh, bb, kC, ik, ku, bq, at, pi, e, ap); #c1(PGLYRP3) c2(XP_011507421) c3(8387) c4(34501, 47558, 60615, 21444, 73672) c5(da, fq, Ny, Xx); #c1(PGLYRP4) c2(NP_065126) c3(8388) c4(34502, 47559, 60616, 21445, 73673) c5(da, Xx); #c1(PGM3) c2(NP_001186848) c3(8389) c4(34503, 47560, 60617, 21446, 73674) c5(KC); #c1(PGPEP1) c2(NP_060182) c3(8390) c4(34504, 47561, 60618, 21447, 73675) c5(is, JP, aV, hW, eF, b, h, ie, IJ, dY, M, gd, P, fP, he, asW, at, u, anW); #c1(PGP) c2(NP_001035830) c3(8391) c4(34505, 47562, 60619, 21448, 73676) c5(is, M, xc, h, ak, ie, ns, fP); #c1(PGR) c2(NP_000917) c3(8392) c4(34506, 47563, 60620, 21449, 73677) c5(ml, aw, Tw, w, PM, wX, e, cp, yg, bQ, dl, g, fe, aC, sH, gm, vc, od, wh, ag, qP, i, aA, aRK, cG, X, fE, afY, iP, mk, kY, U, y, V, tp, co, f, bu, B, avh, av, fy, avg, is, aal, NW, afn, cd, Qj, iA, auK, iY, af, nc, in, jd, qO, asO, An, b, jj, sO, tG, d, Ag, gf, Bc, ar, ff, tg, Yr, u, NT, kF, wp, gL, be, dT, gL, by, nd, aHG, Ca, apG, wV, py, agb, wP, aEj, I, afG, Xm, A, k, tR, NA, jc, vg, Ji, jw, Xv, adR, MT, aX, sG, h, nc, cU, oJ, apb, PT, OR, ajt, avo, Be, J, W, T, Me, jl, qp, hg, Af, avx, aiL, eG); #c1(PGRMC1) c2(NP_001269550) c3(8393) c4(34507, 47564, 60621, 21450, 73678) c5(A, tG, b, X, mk, fl, vg, jw, y, co, re, f, ar, as, av, u, iT, ae, an, gL, vc, Ap, Rs); #c1(PGRMC2) c2(NP_006311) c3(8394) c4(34508, 47565, 60622, 21451, 73679) c5(ny, vg, gL, ip, mk, vc, di, tG, BX); #c1 (PHACTR1) c2(NP_001229577) c3(8395) c4(34509, 47566, 60623, 21452, 73680) c5(cqv, ql, vW, fz, bq, at, u, y); #c1(PHACTR2) c2(NP_001093634) c3(8396) c4(34510, 47567, 60624, 21453, 73681) c5(qf, bb, bq, aV, bj, o); #c1(PHACTR3) c2(NP_001186434) c3(8397) c4(34511, 47568, 60625, 21454, 73682) c5(oy, V, aC, T, bq, U); #c1(PHB2) c2(NP_001138303) c3(8398) c4(34512, 47569, 60626, 21455, 73683) c5(wy, rQ, aw, b, bdX, u, cqw, q, aN, by, cz, aNI, od, cl, Pv, nP, DY, aK, bu, y, Xo); #c1(PHB) c2(NP_001268426) c3(8399) c4(34513, 47570, 60627, 21456, 73684) c5(Dr, aDX, b, X, jf, A, ak, bf, y, Ag, Bi, B, q, bu, ra, ik, hV, av, u, jh, v, by, aDY, T, ar, jU, aM, to, nV, f, bm, fP, Af, i, I, gz, aA); #c1(PHC1) c2(NP_004417) c3(8400) c4(34514, 47571, 60628, 21457, 73685) c5(cr, t, cqx, J, G, O, Lr, aD, bA, Mw, ait); #c1(PHC2) c2(XP_011539177) c3(8401) c4(34515, 47572, 60629, 21458, 73686) c5(sl, A, bkY); #c1(PHC3) c2(NP_079223) c3(8402) c4(34516, 47573, 60630, 21459, 73687) c5(fr, T, b, ft); #c1(PHEX) c2(NP_000435) c3(8403) c4(34517, 47574, 60631, 21460, 73688) c5(bgA, mi, bE, fr, nf, aki, hS, vR, AQ, U, bgr, AO, bfO, amK, O, zQ, Ry, o, awC, aCb, I, nW, azo, Sw, iD, bB, mY, ft, AP, TW, jU, qt, Mh, AR, cqy, ajH, arA, di, bfN, amL); #c1(PHF10) c2(NP_060758) c3(8404) c4(34518, 47575, 60632, 21461, 73689) c5(by, aew, bu); #c1(PHF11) c2(NP_001035533) c3(8405) c4(34519, 47576, 60633, 21462, 73690) c5(oy, nk, cy, t, DM, bGG, dW, buZ, ti, fq, aD, alV, Dl); #c1(PHFI2) c2(NP_001028733) c3(8406) c4(34520, 47577, 60634, 21463, 73691) c5(arL, o); #c1(PHFI9) c2(NP_001009936) c3(8407) c4(34521, 47578, 60635, 21464, 73692) c5(aC, aX); #c1(PHF1) c2(NP_002627) c3(8408) c4(34522, 47579, 60636, 21465, 73693) c5(m, b, Tw, aEt, aaZ, y, cqz, u, bmv, o); #c1(PHF20) c2(NP_057520) c3(8409) c4(34523, 47580, 60637, 21466, 73694) c5(co, b, k, X, hV, F, W, w, Iv, av, fy, O); #c1 (PHF2IA) c2(NP_001095272) c3(8410) c4(34524, 47581, 60638, 21467, 73695) c5(bb, nU, AP, o); #c1(PHF23) C2(NP_001271447) c3(8411) c4(34525, 47582, 60639, 21468, 73696) c5(bq, h); #c1(PHF2) c2(NP_005383) c3(8412) c4(34526, 47583, 60640, 21469, 73697) c5(u, y); #c1(PHF3) c2(NP_001277189) c3(8413) c4(34527, 47584, 60641, 21470, 73698) c5(w); #c1(PHF5A) c2(NP_116147) c3(8414) c4(34528, 47585, 60642, 21471, 73699) c5(g, OG, P, apz); #c1(PHFG) c2(NP_115711) c3(8415) c4(34529, 47586, 60643, 21472, 73700) c5(US, agv, b, nz, nU, jL, g, fO, h, bsG, oO, oU); #c1(PHF8) c2(NP_001171825)

c3(8416) c4(34530, 47587, 60644, 21473, 73701) c5(jh, A, S, b, bgR, nz, nU, jV, cz, Ns, amS, B, hW); #c1(PHGDH) c2(XP_011539533) c3(8417) c4(34531, 47588, 60645, 21474, 73702) c5(cqu, A, cgA, b, X, EM, mW, wn, NH, fw, ct, y, m, aX, UI, kn, cqB, f, fr, O, av, u, gl, g, aij, fC, el, ft, KK, II, Qt, QZ, cy, jG, JY, WZ, qW, ao, rQ, NG, aq, aTZ, Ck, dY, pH, fl); #c1(PHIP) c2(NP_060404) c3(8418) c4(34532, 47589, 60646, 21475, 73703) c5(aX, gn, yD, OT, bHI, O); #c1(PHKA1) c2(NP_001116142) c3(8419) c4(34533, 47590, 60647, 21476, 73704) c5(oH, BM, ado, eh, cgC, hM, adj); #c1(PHKA2) c2(NP_000283) c3(8420) c4(34534, 47591, 60648, 21477, 73705) c5(fk, BM, cgD, ado, oH, cqE, adj); #c1(PHKB) c2(NP_000284) c3(8421) c4(34535, 47592, 60649, 21478, 73706) c5(BM, cqF, adj); #c1(PHKG1) c2(NP_001245388) c3(8422) c4(34536, 47593, 60650, 21479, 73707) c5(BM); #c1(PHKG2) c2(NP_000285) c3(8423) c4(34537, 47594, 60651, 21480, 73708) c5(bh, BM, cqG, adj, gv); #c1(PHLDA1) c2(NP_031376) c3(8424) c4(34538, 47595, 60652, 21481, 73709) c5(fe, aX, b, cY, ad, hS, fl, cs, gj, u, y); #c1(PHLDA2) c2(NP_003302) c3(8425) c4(34539, 47596, 60653, 21482, 73710) c5(g, fe, b, cV, fr, cz, w, fy, ft); #c1(PHLDA3) c2(NP_036528) c3(8426) c4(34540, 47597, 60654, 21483, 73711) c5(u); #c1(PHLDB1) c2(NP_001138231) c3(8427) c4(34541, 47598, 60655, 21484, 73712) c5(g, m, nk, cy, aJB, w, O); #c1(PHLPP1) c2(NP_919431) c3(8428) c4(34542, 47599, 60656, 21485, 73713) c5(A, b, k, w, U, y, co, aX, B, q, do, ar, cs, fy, bm, fh, V, I, ad, W, rw, x, bb, jT, u, cT, aA); #c1(PHLPP2) c2(NP_001275932) c3(8429) c4(34543, 47600, 60657, 21486, 73714) c5(V, b, aum, O, U, fy, u, y); #c1(PHOX2A) c2(NP_005160) c3(8430) c4(34544, 47601, 60658, 21487, 73715) c5(Am, amn, I, cV, ag, nz, hS, bxA, di, cgH); #c1(PHOX2B) c2(NP_003915) c3(8431) c4(34545, 47602, 60659, 21488, 73716) c5(g, aw, Jy, b, ahP, ahS, hS, dV, Ir, bj, Fp, or, aua, dZ, Tv, aE, yd, aLt, cgJ, cV, cgK, ahO, amn, cqL, bdu, jH, cgl, xr, fP, gR, cqM, fW); #c1(PHPT1) c2(NP_001129333) c3(8432) c4(34546, 47603, 60660, 21489, 73717) c5(P, co); #c1(PHRF1) c2(NP_001273510) c3(8433) c4(34547, 47604, 60661, 21490, 73718) c5(m, b, aC, Dg, mW, qO, u, gl, y); #c1(PHTF1) c2(XP_011538833) c3(8434) c4(34548, 47605, 60662, 21491, 73719) c5(aE); #c1(PHTF2) c2(NP_001120830) c3(8435) c4(34549, 47606, 60663, 21492, 73720) c5(qf, ix, dA); #c1(PHYH) c2(NP_001032626) c3(8436) c4(34550, 47607, 60664, 21493, 73721) c5(cqN, aBu); #c1(PHYHIP) c2(NP_001092805) c3(8437) c4(34551, 47608, 60665, 21494, 73722) c5(ag); #c1(PHYKPL) c2(NP_699204) c3(8438) c4(34552, 47609, 60666, 21495, 73723) c5(bMV, bMO); #c1(PII5) c2(NP_056970) c3(8439) c4(34553, 47610, 60667, 21496, 73724) c5(cg0); #c1(PII6) c2(NP_001186088) c3(8440) c4(34554, 47611, 60668, 21497, 73725) c5(A, B); #c1(PI3) c2(NP_002629) c3(8441) c4(34555, 47612, 60669, 21498, 73726) c5(da, jH, fl, f, aZ, sE, XF, gL, aFd, P, w, bk, tl, bq, I, bh, xd, gf, ye, aen); #c1(PI4K2A) c2(NP_060895) c3(8442) c4(34556, 47613, 60670, 21499, 73727) c5(g, IZ); #c1(PI4K2B) c2(NP_060793) c3(8443) c4(34557, 47614, 60671, 21500, 73728) c5(ak, hW); #c1(PI4KA) c2(NP_477352) c3(8444) c4(34558, 47615, 60672, 21501, 73729) c5(hW, cqP, ak, q, K, xq, vQ, afb); #c1(PI4KB) c2(NP_001185703) c3(8445) c4(34559, 47616, 60673, 21502, 73730) c5(o); #c1(PIAS1) c2(NP_057250) c3(8446) c4(34560, 47617, 60674, 21503, 73731) c5(A, Pz, b, wd, f, J, nJ, mk, jV, B, fy, aA, aV, u, y, bk); #c1(PIAS2) c2(NP_004662) c3(8447) c4(34561, 47618, 60675, 21504, 73732) c5(aX, b, cV, X, byr, f, gm, rJ, av, jT, rH); #c1(PIAS4) c2(NP_056981) c3(8448) c4(34562, 47619, 60676, 21505, 73733) c5(da, by, A, b, X, B, J, bu, ag, jx, n, cs, VP, av, ad, jG, cq); #c1(PIBF1) c2(NP_006337) c3(8449) c4(34563, 47620, 60677, 21506, 73734) c5(aC, cqQ, u, y, cp); #c1(PICALM) C2(NP_001008660) c3(8450) c4(34564, 47621, 60678, 21507, 73735) c5(jK, gk, jU, b, hX, aq, dD, eu, h, M, cT, sf, aA, bj, iv, J, u, hx, o, pv); #c1(PICK1) c2(NP_001034673) c3(8451) c4(34565, 47622, 60679, 21508, 73736) c5(to, aMC, cqR, am, v, he, KL, xg, ey); #c1(PID1) c2(NP_001094288) c3(8452) c4(34566, 47623, 60680, 21509, 73737) c5(g, bb, b, k, jR, w, aZ, aA, O); #c1(PIDD1) C2(XP_011518511) c3(8453) c4(34567, 47624, 60681, 21510, 73738) c5(d, iw, aX, dB, hN, e); #c1(PIEZO1) c2(NP_001136336) c3(8454) c4(34568, 47625, 60682, 21511, 73739) c5(fU, aC, q, bp, aN, rQ, Ft, bm); #c1(PIEZO2) c2(NP_071351) c3(8455) c4(34569, 47626, 60683, 21512, 73740) c5(cgS, cgT, zT, bq, fy, o, aAp); #c1(PIF1) c2(NP_001273426) c3(8456) c4(34570, 47627, 60684, 21513, 73741) c5(pb, sz, A, b, f, B, u, y); #c1(PIFO) c2(NP_001287760) c3(8457) c4(34571, 47628, 60685, 21514, 73742) c5(ckK); #c1(PIGA) c2(NP_002632) c3(8458) c4(34572, 47629, 60686, 21515, 73743) c5(nU, b, WW, Id, hS, ku, eM, fR, ps, aHr, aov, oB, f, aHu, cgV, n, cqU, aXd, J, fO, dt, pr, P, pD, px, bEn, amJ, kC, xW, bM, h); #c1(PIGF) c2(NP_002634) c3(8459) c4(34573, 47630, 60687, 21516, 73744) c5(m, hq, I, aF, sH, f, tO, T, VG, av, wy, fR); #c1(PIGG) c2(NP_001120650) c3(8460) c4(34574, 47631, 60688, 21517, 73745) c5(bb, et); #c1(PIGL) c2(NP_004269) c3(8461) c4(34575, 47632, 60689, 21518, 73746) c5(oB, cgW, pD, dA); #c1(PIGM) c2(NP_660150) c3(8462) c4(34576, 47633, 60690, 21519, 73747) c5(bEn, hS, aHu); #c1(PIGN) c2(NP_789744) c3(8463) c4(34577, 47634, 60691, 21520, 73748) c5(cgX, U, cO, V, hS); #c1(PIGP) c2(NP_001188413) c3(8464) c4(34578, 47635, 60692, 21521, 73749) c5(IC, WW, cqY, cqo); #c1(PIGP) c2(NP_710148) c3(8465) c4(34579, 47636, 60693, 21522, 73750) c5(aq, ans); #c1(PIGQ) c2(NP_004195) c3(8466) c4(34580, 47637, 60694, 21523, 73751) c5(dZ, bb, dV); #c1(PIGR) c2(XP_011507931) c3(8467) c4(34581, 47638, 60695, 21524, 73752) c5(fl, aw, b, Fc, C, iL, e, cM, d, co, pi, q, cU, ar, cs, fy, gm, ad, T, x, iA, et, cqZ, jU, jM, aY, ag, dc); #c1(PIGT) c2(NP_001171657) c3(8468) c4(34582, 47639, 60696, 21525, 73753) c5(atn, era, hT, TX, erb, fR); #c1(PIGU) c2(NP_536724) c3(8469) c4(34583, 47640, 60697, 21526, 73754) c5(biX, co, aX, b, ze, F, Ic, DO, q, fO, cT, w, T, ic, i, kF, fx, u, y); #c1(PIGW) c2(NP_848612) c3(8470) c4(34584, 47641, 60698, 21527, 73755) c5(BO, ig, X, t, aY, G, dc, av, cM); #c1(PIGY) c2(NP_001036081) c3(8471) c4(34585, 47642, 60699, 21528, 73756) c5(oB, td, pD); #c1(PIHID1) c2(NP_060386) c3(8472) c4(34586, 47643, 60700, 21529, 73757) c5(u, y); #c1(PIK3AP1) c2(NP_689522) c3(8473) c4(34587, 47644, 60701, 21530, 73758) c5(A); #c1(PIK3C2A) c2(NP_002636) c3(8474) c4(34588, 47645, 60702, 21531, 73759) c5(d, id, I, nl, M, A, auG, iA, e); #c1(PIK3C2B) c2(NP_002637) c3(8475) c4(34589, 47646, 60703, 21532, 73760) c5(fU, b, cV, j, A, di, O); #c1(PIK3C2G) C2(NP_001275701) c3(8476) c4(34590, 47647, 60704, 21533, 73761) c5(eH, bq, I); #c1(PIK3C3) c2(NP_002638) c3(8477) c4(34591, 47648, 60705, 21534, 73762) c5(oy, nX, b, dA, ak, mW, e, m, ik, o, KM, bq, bf, av, u, gl, y, d); #c1(PIK3CA) c2(NP_006209) c3(8478) c4(34592, 47649, 60706, 21535, 73763) c5(dx, by, ml, aw, Ob, aHH, Zy, cs, avk, HG, Ip, auJ, w, hC, cO, bf, bu, jg, ra, O, mR, BO, dv, cy, erd, OO, t, aHw, e, axd, aJP, FN, Xi, cl, bud, QB, ati, jC, jM, amF, aHK, rR, g, mz, fe, aC, qf, Dt, fO, gm, bp, gY, Ce, od, x, oQ, fx, hR, gg, ja, apc, QJ, lu, crg, DO, jh, ag, xr, gP, i, agQ, bq, aA, auN, ib, dB, Dr, QD, fl, QF, jE, arB, cY, Qg, iP, jz, fy, Ak, mk, fU, W, GM, kY, bo, bw, U, Oh, cM, jb, Tr, QO, co, Ml, pp, yE, pz, cK, f, N, cT, aJS, ere, gX, B, iv, av, KK, bm, iT, yJ, iF, jB, Bd, ca, V, Ov, yg, ze, jR, v, afn, gv, brv, eX, ny, Qt, VP, Hh, iA, fv, fJ, aec, JY, en, gW, du, aYM, anG, iY, af, QG, kJ, pF, P, in, Qa, tl, cf, ji, iu, ci, gG, OG, Tp, erf, b, aF, Xj, Dm, m, A, oR, ic, z, auO, ey, jQ, gF, Ne, d, Ag, biX, bb, Dx, QE, jd, re, hV, q, es, ND, X, ar, ff, hb, n, Yr, aKF, jG, u, aiV, o, QL, Qb, EM, fs, Xp, I, qL, Mi, avo, aza, gL, ad, jx, auG, G, QK, boB, Ca, jT, fH, oi, qY, aeC, M, Lt, nV, kB, iR, py, Bg, dh, aof, agf, Ou, fl, QP, Mp, rQ, cS, aJo, zD, GK, Qv, ID, iG, k, fr, jU, pR, gw, pD, EE, VM, BY, og, btZ, Iv, iL, gE, erh, ft, fw, aW, iy, Zh, MT, aX, il, h, F, jA, cU, apP, ik, y, cB, crc, fM, LI, auG, dj, LR, crk, qO, cV, Be, Fs, J, dt, jo, QI, T, II, Oi, pw, nP, cz, aJn, aM, TY, ct, qp, iK, YQ, Jh, Qn, crj, bkB, j, aKM, Yv, bh, Fp, eG, cri, rb, as); #c1(PIK3CB) c2(NP_006210) c3(8479) c4(34593, 47650, 60707, 21536, 73764) c5(dx, by, en, aw, Ob, aHH, EM, gG, dB, HG, Ip, w, cO, bf, KK, pz, ra, O, BO, dv, ey, gX, t, e, FN, mR, cl, jg, ati, jC, jM, aHK, rR, g, mz, fe, aC, Of, du, fO, gm, bp, gY, rO, od, x, oQ, fx, hR, gg, apc, M, lu, crg, ag, cT, gP, i, bg, aA, fl, arB, cY, Qg, iP, jz, mk, VM, kY, bo, bw, U, cM, co, Ml, pp, yE, f, N, es, bu, aKF, B, iv, av, fy, bm, iT, QD, iF, jB, ca, V, Ov, yg, ze, jR, v, gv, brv, eX, Qt, VP, Hh, iA, fJ, aec, gW, anG, iY, QG, kJ, pF, P, in, tl, cf, ji, iu, ci, OG, Tp, erf, b, aF, Dm, m, A, oR, z, ey, Ne, d, jh, biX, bb, Dx, QE, jd, re, hV, q, es, X, ar, ff, hb, n, Yr, fv, jG, u, aiV, o, QL, Qb, fs, jE, I, Mi, LR, j, ad, Tr, G, Ca, fH, oi, gY, Lt, nV, kB, iR, py, Bg, dh, agf, Ou, fl, OP, Mp, zD, Qv, ID, iG, k, fr, pR, gw, pD, FE, og, Iv, gE, erh, ft, fw, aW, iy, Zh, MT, aX, il, h, F, jO, cO, apP, ik, y, cB, LI, jx, dj, fU, crk, cV, J, dt, jo, QI, T, II, pw, nP, cz, fM, aM, TY, jT, qp, iK, Jh, Qn, bkB, aKM, Yv, bh, eG, cri, jU); #c1(PIK3CD) c2(XP_011539885) c3(8480) c4(34594, 47651, 60708, 21537, 73765) c5(dx, by, en, aw, Ob, Ot, aHH, EM, gG, dB, HG, Ip, w, cO, bf, KK, pz, ra, O, BO, dv, ey, gX, t, e, eE, FN, mR, cl, jq, ati, jC, jM, aHK, rR, g, mz, fe, aC, Qf, du, fO, gm, bp, gY, rO, od, x, oQ, fx, hR, gg, apc, M, lu, crg, ag, cT, gP, i, bq, aA, fl, zr, arB, cY, Qg, iP, jz, eu, mk, VM, kY, bo, bw, U, y, co, Ml, pp, yE, f, N, es, bu, aKF, B, iv, av, fy, bm, iT, QD, iF, jB, ca, V, Ov, yg, ze, jR, v, gv, QP, brv, eX, Qt, VP, Hh, iA, fJ, aec, gW, dP, iY, QG, kJ, pF, P, in, tl, cf, ji, iu, ci, OG, Tp, erf, b, aF, Dm, m, A, oR, z, ey, Ne, d, jh, biX, bb, Dx, QE, jd, re, hV, q, es, X, ar, ff, hb, n, Yr, fv, jG, u, aiV, o, QL, Qb, fs, jE, I, Mi, LR, j, ad, Tr, G, Ca, fH, oi, gY, Lt, nV, anG, kB, iR, Bg, dh, agf, cgt, Ou, fl, I, zD, da, Qv, ID, iG, k, fr, pR, gw, pD, FE, og, Iv, gE, erh, ft, fw, aW, iy, Zh, MT, aX, il, h, F, jQ, cU, apP, ik, iK, cB, LI, jx, dj, fU, crk, cV, J, dt, jo, QI, T, II, pw, nP, cz, fM, aM, TY, jT, qp, Jh, Qn, bkB, aKM, Yv, bh, eG, cri, jU); #c1(PIK3CG) c2(NP_001269355) c3(8481) c4(34595, 47652, 60709, 21538, 73766) c5(dx, by, en, aw, Ob, aHH, EM, gG, dB, HG, Ip, w, cO, bf, KK, pz, ra, O, BO, dv, ey, gX, t, gB, e, eE, FN, mR, cl, jg, ati, jC, jM, aHK, rR, g, mz, fe, aC, Of, du, fO, gm, bp, gY, rQ, od, x, oQ, fx, hR, gg, apc, M, lu, crg, ag, cT, qP, dh, i, mD, aA, fl, Kt, arB, cY, Qg, iP, jz, rd, mk, VM, kY, bo, bw, U, y, co, Ml, pp, yE, f, N, es, bu, aKF, B, iv, av, fy, bm, iT, QD, iF, jB, aKg, V, Ov, yg, ze, fl, jR, v, gv, brv, eX, Qt, VP, Hh, iA, pi, fJ, aec, gW, anG, iY, QG, kJ, pF, P, iu, ajM, tl, cf, ji, iu, ci, ap, OG, Tp, erf, b, aF, Dm, m, A, oR, z, ey, Ne, d, jh, biX, bb, Dx, QE, jd, re, hV, g, es, X, ar, ff, hb, n, Yr, fv, jG, u, aiV, o, QL, Ob, fs, jE, I, Mi, LR, aeO, gL, ad, Tr, G, Ca, ca, fH, oi, qY, Lt, nV, kB, iR, Bg, xU, gd, agf, Ou, bq, OP, zD, da, Qv, ID, iG, k, fr, pR, gw, pD, FE, og, di, Iv, gE, erh, ft, fw, aW, iy, Zh, MT, aX, il, h, F, jQ, cU, apP, ik, iK, cB, fM, LI, jx, dj, fU, crk, cV, be, J, dt, jo, QI, T, II, pw, nP, cz, ac, aM, TY, jT, qp, Jh, Qn, bkB, j, aKM, Yv, bh, at, eG, cri, jU); #c1(PIK31P1) c2(NP_001129383) c3(8482) c4(34596, 47653, 60710, 21539, 73767) c5(fU); #c1(PIK3R1) c2(NP_001229395) c3(8483) c4(34597, 47654, 60711, 21540, 73768) c5(bm, A, Gt, b, X, pD, w, di, bw, bf, vl, iR, ey, y, Ag, co, bb, vr, anl, B, g, cU, pn, fx, O, es, Yr, ati, JY, u, dh, o, dj, ma, kF, anJ, I, dA, J, fO, ad, P, bQ, T, eX, fH, x, Hh, iA, fJ, jU, aM, cri, fy, eh, kJ, asM, Af, i, aA, fD, Mb); #c1(PIK3R2) c2(NP_005018) c3(8484) c4(34598, 47655, 60712, 21541, 73769) c5(cU, Ob, bQ, b, X, bm, eX, q, fO, dj, pn, O, es, av, fy, u, iA, y); #c1(PIK3R3) c2(NP_001290356) c3(8485) c4(34599, 47656, 60713, 21542, 73770) c5(P, co, ae, b, aC, h, J, fw, xU, sJ, A, dh, cB, aE, al, aN, aK, anf, O); #c1(PIK3R4) c2(NP_055417) c3(8486) c4(34600, 47657, 60714, 21543, 73771) c5(pE, pL, LG, XP, ajg, av); #c1 (PIK3R5) c2(NP_055123) c3(8487) c4(34601, 47658, 60715, 21544, 73772) c5(crm, b, P, T, KQ, KV); #c1 (PIKFYVE) c2(NP_001171471) c3(8488) c4(34602, 47659, 60716, 21545, 73773) c5(btU, iR, aW, b); #c1(PILRA) c2(NP_038467) c3(8489) c4(34603, 47660, 60717, 21546, 73774) c5(aW, gL); #c1(PIM1) c2(NP_001230115) c3(8490) c4(34604, 47661, 60718, 21547, 73775) c5(vq, A, aw, yn, b, ag, gw, sv, z, w, Iv, bRc, cO, bf, pz, e, y, d, jh, co, hi, kJ, t, h, B, F, bu, ar, cs, CL, I, u, dh, aP, Mi, gm, bp, J, IR, IX, P, T, fO, fH, cK, by, fJ, aM, jT, fy, cac, G, hX, cT, IS, i, gj, crn); #c1(PIM2) c2(NP_006866) c3(8491) c4(34605, 47662, 60719, 21548, 73776) c5(jT, A, aw, b, lb, h, B, gm, fO, g, cT, jV, iv, bh, J, gv); #c1(PIM3) c2(NP_001001852) c3(8492) c4(34606, 47663, 60720, 21549, 73777) c5(mZ, b, kJ, h, g, J, W, ag, cT, w, ar, fv, cs, I, bw, ad, bm); #c1(PIN1) c2(NP_006212) c3(8493) c4(34607, 47664, 60721, 21550, 73778) c5(A, aw, bS, b, pR, Nh, dB, cpM, O, w, akL, iL, cO, ai, bj, DK, y, d, jh, co, cy, pp, h, f, F, q, jV, e, tF, B, gg, fy, u, o, ff, mz, vR, qO, cV, aC, v, J, jo, T, aj, jT, dL, OA, Bi, ao, nV, ip, Y, fN, HN, P, nJ, gd, iT, i, I, aA, re, rb); #c1(PIN4) c2(NP_001164218) c3(8494) c4(34608, 47665, 60722, 21551, 73779) c5(mz); #c1 (PINX1) c2(NP_001271285) c3(8495) c4(34609, 47666, 60723, 21552, 73780) c5(d, by, bm, E, b, fr, iR, jT, g, jR, bu, T, iL, jB, ft, u, e, y); #c1(PIP4K2A) C2(NP_005019) c3(8496) c4(34610, 47667, 60724, 21553, 73781) c5(to, A, aX, t, bb, ak, ns, G, nm, nt, ng, nr, nn, hW, no, np, jN); ID #c1(PIP4K2B) c2(NP_003550) c3(8497) c4(34611, 47668, 60725, 21554, 73782) c5(u, o); #c1(PIP4K2C) c2(NP_001139731) c3(8498) c4(34612, 47669, 60726, 21555, 73783) c5(aC, aE); #c1(PIP5K1A) c2(NP_001129108) c3(8499) c4(34613, 47670, 60727, 21556, 73784) c5(u, y); #c1(PIP5K1B) c2(XP_006717364) c3(8500) c4(34614, 47671, 60728, 21557, 73785) c5(cy, et, fD, ag); #c1(PIP5K1C) c2(NP_001182662) c3(8501) c4(34615, 47672, 60729, 21558, 73786) c5(cro); #c1 (PIP5KL1) c2(NP_001128691) c3(8502) c4(34616, 47673, 60730, 21559, 73787) c5(b); #c1(PIP) c2(NP_002643) c3(8503) c4(34617, 47674, 60731, 21560, 73788) c5(aEg, B, b, dB, A, y, atU, Ec, f, PA, cs, zV, Lm, ar, atV, Us, zR, u, g, be, crp, avo, ad, T, Fr, PH, zT, so, nU); #c1(PIPOX) c2(NP_057602) c3(8504) c4(34618, 47675, 60732, 21561, 73789) c5(da, A, bB, mY, u, y); #c1(PIR) c2(NP_003653) c3(8505) c4(34619, 47676, 60733, 21562, 73790) c5(lb, h, LR, jV, aC, fP, u, jU); #c1(PISD) c2(XP_005261512) c3(8506) c4(34620, 47677, 60734, 21563, 73791) c5(jH, rQ, hW, cz, cA, KE, jD); #c1(PITPNA) c2(NP_006215) c3(8507) c4(34621, 47678, 60735, 21564, 73792) c5(fS); #c1(PITPNM1) c2(NP_001124320) c3(8508) c4(34622, 47679, 60736, 21565, 73793) c5(nQ); #c1(PITPNM3) c2(NP_001159438) c3(8509) c4(34623, 47680, 60737, 21566, 73794) c5(nQ, ml, bGh, bfX, nR, u, nW, y); #c1 (PITRM1) c2(NP_001229236) c3(8510) c4(34624, 47681, 60738, 21567, 73795) c5(bb, dA, aos, alF, et, hue); #c1

(PITX1) c2(NP_002644) c3(8511) c4(34625, 47682, 60739, 21568, 73796) c5(aDX, b, k, dB, en, gE, A, jD, y, atj, iy, B, g, bu, ar, O, u, jH, cc, Yj, iF, cV, aKi, cz, W, err, co, crq, rO, Lt, Yz, aDY, py, yE, Yv, Xt, brO); #c1(PITX2) c2(NP_000316) c3(8512) c4(34626, 47683, 60740, 21569, 73797) c5(crs, hV, aw, b, X, bkJ, ql, crt, A, hM, Vy, cO, ct, U, bj, xl, anJ, bkn, bbO, bb, aLv, pp, anl, f, g, dl, mL, y, iv, av, fy, u, ff, BS, LK, anH, V, jh, sX, BT, J, fO, dt, jo, rQ, Jj, amR, aSS, cr, fx, jf, AP, aes, atn, W, nV, bm, Qk, er, OV, nJ, B, yE, i, bq, di, ap); #c1(PITX3) c2(NP_005020) c3(8513) c4(34627, 47684, 60741, 21570, 73798) c5(dx, id, b, sE, bo, cru, ajf, bj, O, dv, f, baz, atg, bLI, o, aBs, du, aC, aQw, aSS, gV, rQ, lc, yE, bk, I, aA, kD); #c1(PIWIL1) c2(NP_001177900) c3(8514) c4(34628, 47685, 60742, 21571, 73799) c5(b, X, dB, wn, iL, U, y, co, am, g, bu, fv, ff, IV, u, NT, V, by, T, ny, av, wV, wP); #c1(PIWIL2) c2(NP_001129193) c3(8515) c4(34629, 47686, 60743, 21572, 73800) c5(ck, am, b, iT, cU, wn, NT, T, iE, i, iA, u, fx, y); #c1(PIWIL3) c2(NP_001008496) c3(8516) c4(34630, 47687, 60744, 21573, 73801) c5(wn, NT); #c1 (PIWIL4) c2(NP_689644) c3(8517) c4(34631, 47688, 60745, 21574, 73802) c5(wV, NT, b, wP, re, q, wn, iT); #c1(PJA1) c2(NP_071763) c3(8518) c4(34632, 47689, 60746, 21575, 73803) c5(nz, bjE, eO); #c1(PJA2) c2(NP_055634) c3(8519) c4(34633, 47690, 60747, 21576, 73804) c5(og, hV, nV, b); #c1(PKD1) c2(NP_000287) c3(8520) c4(34634, 47691, 60748, 21577, 73805) c5(bP, bL, en, axx, mi, b, aEg, fr, Dr, gw, xc, oH, erz, w, di, sF, cO, Eh, crw, A, y, iy, LI, ja, f, bu, VN, B, qw, asa, u, dr, em, asd, erv, I, aC, aDM, wo, gJ, ft, dt, vc, T, eX, Cl, cr, by, et, aM, Ip, dy, Xu, Nz, bf, crx, ag, so, fD, bq, aA, cry); #c1(PKD1L1) c2(NP_612152) c3(8521) c4(34635, 47692, 60749, 21578, 73806) c5(oH, Bm); #c1(PKD1L2) c2(NP_001070248) c3(8522) c4(34636, 47693, 60750, 21579, 73807) c5(alF, AA, xc, cc); #c1(PKD1L3) c2(NP_853514) c3(8523) c4(34637, 47694, 60751, 21580, 73808) c5(alF, xc, ahW); #c1(PKD2) c2(NP_000288) c3(8524) c4(34638, 47695, 60752, 21581, 73809) c5(bP, bL, A, vh, xc, w, di, sF, cO, crz, adT, hP, e, O, d, adx, cr, AP, ml, f, M, mR, B, bSs, asa, jG, Hs, fY, asd, nQ, Ls, cs, v, ad, dt, Nz, Cl, et, aH, qp, ag, so, fD, brZ); #c1(PKD2L1) c2(NP_001240766) c3(8525) c4(34639, 47696, 60753, 21582, 73810) c5(MW, by, aX, xc, aoy, vv, aoA, fO, bu, EN, vS, T, so, y, cs, ad, u, ahW, C); #c1(PKDCC) c2(NP_612379) c3(8526) c4(34640, 47697, 60754, 21583, 73811) c5(H1, bj); #c1(PKDREJ) c2(NP_006062) c3(8527) c4(34641, 47698, 60755, 21584, 73812) c5(xc); #c1(PKHD1) c2(NP_733842) c3(8528) c4(34642, 47699, 60756, 21585, 73813) c5(bP, an, A, xc, V, z, asd, bln, di, crA, cO, U, et, Fg); #c1(PK1A) c2(NP_006814) c3(8529) c4(34643, 47700, 60757, 21586, 73814) c5(bq, ak); #c1(PK1B) c2(NP_001257323) c3(8530) c4(34644, 47701, 60758, 21587, 73815) c5(A, u, B, y); #c1(PKLR) c2(NP_000289) c3(8531) c4(34645, 47702, 60759, 21588, 73816) c5(bm, sa, en, jT, b, crB, mW, RL, EN, w, byH, gE, bf, al, A, ey, sb, d, m, wZ, co, aX, ae, t, pq, f, e, q, VS, fr, dQ, y, iv, qj, aM, u, gl, o, aaQ, xc, ma, si, I, cV, bK, ft, v, bp, J, P, pt, ll, aU, fy, aN, qT, CY, eJ, ao, aV, ch, ie, G, B, ag, cT, fl, oM, DM, Dg); #c1(PKM) c2(NP_001193725) c3(8532) c4(34646, 47703, 60760, 21589, 73817) c5(b, X, w, byH, O, U, e, y, cp, d, Ag, co, f, q, bu, ar, zb, cs, av, fy, u, yJ, mz, fU, V, bp, ad, T, Ca, x, by, qW, bm, fP, Af, aU, fj); #c1(PKMYT1) c2(NP_001245379) c3(8533) c4(34647, 47704, 60761, 21590, 73818) c5(hW, pR, aX, atK); #c1(PKN1) c2(NP_002732) c3(8534) c4(34648, 47705, 60762, 21591, 73819) c5(bL, hV, aw, b, X, EM, iP, dB, w, iL, U, A, e, xl, d, BO, aX, f, q, cU, ar, y, cs, Dd, av, ZU, u, dh, cl, mz, V, nQ, aC, v, ad, W, jo, T, iD, fy, iA, jT, aol, ao, nV, eF, dP, bm, lc, P, B, bnq, agk, Ol, agQ, od); #c1(PKN2) c2(XP_011540071) c3(8535) c4(34649, 47706, 60763, 21592, 73820) c5(PJ, aV, I, X, aol, f, bu, qL, P, Dd, av, ZU, u, y); #c1(PKN3) c2(NP_037487) c3(8536) c4(34650, 47707, 60764, 21593, 73821) c5(b); #c1 (PKNOX1) c2(NP_001273187) c3(8537) c4(34651, 47708, 60765, 21594, 73822) c5(G, cV, t, f, J, P, aal, HE, bf, gF, jT, aq, aM); #c1(PKNOX2) c2(XP_005271700) c3(8538) c4(34652, 47709, 60766, 21595, 73823) c5(eJ, Gj, IV, beu); #c1(PKP1) c2(NP_000290) c3(8539) c4(34653, 47710, 60767, 21596, 73824) c5(d, cy, biB, b, aFQ, bjF, dA, q, py, mk, cK, wX, hR, e); #c1(PKP2) c2(NP_001005242) c3(8540) c4(34654, 47711, 60768, 21537, 73825) c5(QV, dR, crC, xj, ajW, T, cK, rw, ar, hR, biA); #c1(PKP3) c2(NP_009114) c3(8541) c4(34655, 47712, 60769, 21598, 73826) c5(A, b, co, T, ji, fy, hP); #c1(PKP4) c2(NP_001005476) c3(8542) c4(34656, 47713, 60770, 21599, 73827) c5(d, KK, ik, e, afb); #c1(PLA1A) c2(NP_001193889) c3(8543) c4(34657, 47714, 60771, 21600, 73828) c5(f, b, zF, nU, AA, bq, Cp); #c1(PLA2G10) c2(NP_003552) c3(8544) c4(34658, 47715, 60772, 21601, 73829) c5(bP, dx, ak, Al, b, k, A, U, y, boh, co, cy, dN, f, q, M, ar, B, hb, fy, u, da, fi, V, I, Eg, aC, bK, du, bp, ad, W, dv, bt, bUs, et, Yp, bm, kh, fD, dc, I, at, ap); #c1(PLA2G12A) c2(NP_110448) c3(8545) c4(34659, 47716, 60773, 21602, 73830) c5(aW); #c1(PLA2G12B) c2(NP_115951) c3(8546) c4(34660, 47717, 60774, 21603, 73831) c5(g); #c1 (PLA2G15) c2(NP_036452) c3(8547) c4(34661, 47718, 60775, 21604, 73832) c5(id, b, sj, dB, P, at); #c1(PLA2G16) c2(NP_009000) c3(8548) c4(34662, 47719, 60776, 21605, 73833) c5(X, av, T); #c1(PLA2G1B) c2(NP_000919) c3(8549) c4(34663, 47720, 60777, 21606, 73834) c5(dx, f, aw, sE, eC, hC, bLr, et, bf, aAt, dv, cy, gB, bTl, kX, mz, og, aC, bK, du, cV, x, hR, Yp, aaz, vK, fz, bq, aA, id, arQ, hS, YD, U, xw, kV, y, co, RD, ak, B, av, bm, fi, ali, Gl, V, cJ, NZ, v, gv, aR, JY, dO, dP, iu, ap, ach, b, aF, ey, fD, bb, q, hb, u, dh, o, PJ, VD, be, aD, Fo, aZ, ZF, axi, kS, bZn, jU, jH, aCq, eO, gd, I, bL, A, ka, di, PE, hP, auC, m, I, aV, dj, Eg, be, aAA, T, HK, Pk, aM, lc, bqh, fP, bh, at, gf, bUs); #c1 (PLA2G3) c2(NP_056530) c3(8550) c4(34664, 47721, 60778, 21607, 73835) c5(dx, bb, V, du, ad, P, ar, cs, U); #c1(PLA2G4A) c2(NP_077734) c3(8551) c4(34665, 47722, 60779, 21608, 73836) c5(dx, gK, ak, gG, vg, b, k, aF, iP, jL, lp, mk, A, e, tG, O, cy, U, ey, y, ez, d, fh, co, aX, dv, ni, h, f, yh, q, ap, eE, ar, B, cs, oO, hj, aV, u, dh, o, aXH, em, xc, ma, V, I, dA, aC, bK, du, qH, gL, ad, bm, aD, vc, ti, eX, Jh, x, axi, cz, pi, gg, be, j, ao, fy, aY, iR, DR, P, fw, xe, gd, xK, auC, bq, aA, at, gf, bUs); #c1(PLA2G4B) c2(NP_001108105) c3(8552) c4(34666, 47723, 60780, 21609, 73837) c5(P); #c1(PLA2G4C) c2(NP_001152794) c3(8553) c4(34667, 47724, 60781, 21610, 73838) c5(X, aD, P, O); #c1(PLA2G4D) c2(NP_828848) c3(8554) c4(34668, 47725, 60782, 21611, 73839) c5(fq, bb, yh); #c1(PLA2G5) c2(XP_011539888) c3(8555) c4(34669, 47726, 60783, 21612, 73840) c5(crD, aA, v, gL, z); #c1(PLA2G6) c2(NP_001186491) c3(8556) c4(34670, 47727, 60784, 21613, 73841) c5(dx, eX, sE, eC, bLr, et, bf, dv, cy, gB, bTl, kX, og, bK, du, bp, bN, x, hR, crF, aaz, vK, i, mD, eQ, id, crH, crE, X, arQ, bo, PE, U, kV, ciG, cM, co, ml, f, B, av, Gl, V, cJ, v, gv, aR, bq, dO, dP, iu, ap, ach, b, aF, Hr, lc, ey, bb, hb, u, dh, o, PJ, I, bc, fz, Fo, aZ, axi, aCq, Yg, aE, I, bL, A, ka, HJ, bj, auC, m, aX, y, nl, aV, crG, cV, be, T, bM, Pk, aM, st, lc, bqh, bh, at); #c1(PLA2G7) c2(NP_005075) c3(8557) c4(34671, 47728, 60785, 21614, 73842) c5(dx, bL, A, bW, b, Yq, dD, bGG, eR, dv, fl, di, IW, bf, aO, aoa, ed, bQ, bb, ni, cK, f, sP, mR, B, hj, aE, o, kF, ob, qb, sX, du, cx, cd, bd, ti, eX, lo, x, cy, mQ, jT, crl, sK, aLj, jH, dO, gs, dS, eO, fw, et, bH, fD, bq, gD, at, gf, ap); #c1(PLA2R1) c2(NP_001007268) c3(8558) c4(34672, 47729, 60786, 21615, 73843) c5(bb, b, h, J, dB, eC, jo, ff, iv, IV, n); #c1(PLAA) c2(NP_001026859) c3(8559) c4(34673, 47730, 60787, 21616, 73844) c5(wV, aX, b, DO, ad, wP, P, od, ic, cs, fP, QJ); #c1(PLAC1) c2(NP_068568) c3(8560) c4(34674, 47731, 60788, 21617, 73845) c5(ck, b, sH, bp, gA, u, eQ, y, ap); #c1(PLAC8) c2(NP_001124187) c3(8561) c4(34675, 47732, 60789, 21618, 73846) c5(A, b, cO, B, ad, cs); #c1(PLAG1) c2(NP_001108106) c3(8562) c4(34676, 47733, 60790, 21619, 73847) c5(A, aw, b, X, Hk, eu, aiR, JH, y, bkK, QV, h, B, WO, ar, Up, hb, av, u, da, jB, pN, Mi, J, agh, W, T, Fr, aeC, jU, aHE, iK, sh, ih, cT, fl, ib); #c1(PLAGL1) c2(NP_001275966) c3(8563) c4(34677, 47734, 60791, 21620, 73848) c5(b, X, aNH, mq, eH, kB, di, bf, ey, e, y, d, RX, aeM, F, bu, Me, ar, ff, Km, Dd, av, ZU, u, if, I, BC, W, T, mF, crJ, mB, yE, tl, ahl, iE); #c1(PLAGL2) c2(NP_002648) c3(8564) c4(34678, 47735, 60792, 21621, 73849) c5(co, h, J, bp, P, crK, ji); #c1(PLAT) c2(NP_000921) c3(8565) c4(34679, 47736, 60793, 21622, 73850) c5(dx, gK, B, sA, lp, cO, bW, e, O, gO, cU, dv, qc, t, AX, cI, crN, fu, azZ, Ib, bK, sH, du, fO, MO, vc, cV, je, Oz, eg, ie, mE, tO, cT, vK, fD, crO, bq, id, X, crL, vD, atK, mk, ws, yn, bw, vl, y, fm, bpF, f, N, bu, cs, av, RR, bm, wY, wK, V, li, iA, QG, crO, gA, bwi, ap, b, aF, jL, dk, ic, tG, cK, zL, pi, aO, d, bb, eA, vj, crM, q, jV, ar, sR, u, dh, o, fh, kF, I, gL, ad, chr, G, xq, et, hS, gd, fg, crP, yA, fj, bL, A, MZ, k, fw, di, HS, vg, fs, m, qs, aX, Ec, HY, aC, aV, ma, acu, J, P, T, ll, jl, by, HL, jT, bnn, atJ, ajv, fP, gj, at); #c1(PLAU) c2(NP_001138503) c3(8566) c4(34680, 47737, 60794, 21623, 73851) c5(dx, gK, by, B, aw, dB, w, vp, fR, eD, e, xl, cp, M, dv, LL, Vx, LN, kJ, fp, dl, cl, acy, kX, q, aC, sH, du, jE, bp, MO, x, Vv, gg, aml, aei, mE, tO, ag, qP, bk, i, bq, bP, yJ, gk, axq, cY, oa, eu, kB, bCB, bW, bw, U, y, tp, co, pp, bpF, f, bu, O, cs, av, fy, bm, wY, wP, arM, fi, V, jh, bqw, bt, VP, cy, iA, xd, iY, P, crQ, bX, ap, ny, b, zH, Xv, dk, id, fD, d, eE, bb, lz, ZR, eA, jd, vj, q, X, DC, ar, sR, fv, u, dh, o, fh, tw, kF, wl, aiU, LR, gL, ad, BZ, oi, Jl, wV, nV, iR, sW, aE, gd, aFk, I, bRg, anE, bL, A, iL, k, fr, gE, vZ, fw, crR, eO, fs, jR, sx, yw, aX, fg, h, cU, gL, ik, aV, Yb, ma, sj, fl, W, dU, jo, T, j, LS, ft, HL, eN, bnn, Jh, HM, Af, aGo, bh, at, eG, gf, rb); #c1(PLAUR) c2(NP_001005376) c3(8567) c4(34681, 47738, 60795, 21624, 73852) c5(dx, bL, by, ml, aw, pF, b, ag, X, dB, dk, w, bw, U, ft, A, jD, y, cy, d, co, aX, kJ, bn, fq, h, B, e, q, bu, eE, fr, ar, O, cs, av, jh, u, yJ, fU, kF, V, sH, du, gL, ad, P, ti, T, j, x, bb, cz, et, gg, ac, nV, iR, Jh, tO, jd, gA, i, I, bg, rQ, bp); #c1(PLB1) c2(NP_001164056) c3(8568) c4(34682, 47739, 60796, 21625, 73853) c5(dx, bL, A, b, fi, ka, aE, iP, aw, eC, x, ali, hC, O, bf, U, xw, ey, y, ez, aAt, co, cy, RD, auC, h, f, q, bZn, M, aC, B, PE, av, aV, u, dh, o, mz, dj, du, YD, V, ap, Eg, cJ, bK, NZ, v, JY, gv, aD, Fo, dv, HK, cV, bq, ZF, axi, J, kS, Yp, be, aM, Dp, jH, dP, aaz, bm, DR, P, fn, ajf, et, I, cZ, I, bh, aA, at, fD, gf, jU, bUs); #c1(PLBD1) c2(NP_079105) c3(8569) c4(34683, 47740, 60797, 21626, 73854) c5(fy); #c1(PLCB1) c2(NP_056007) c3(8570) c4(34684, 47741, 60798, 21627, 73855) c5(ak, hS, cA, crT, e, dl, d, bb, crS, h, eX, ik, y, u, o, n, dj, el, P, x, IC, bq, eG); #c1(PLCB2) c2(NP_00127122G) c3(8571) c4(34685, 47742, 60799, 21628, 73856) c5(yQ, b, do, P, kY, u, y); #c1(PLCB3) c2(NP_001171812) c3(8572) c4(34686, 47743, 60800, 21629, 73857) c5(ahT, qp, ch, qq, azo, eE, P, T, fq, bq); #c1(PLCB4) c2(NP_000924) c3(8573) c4(34687, 47744, 60801, 21630, 73858) c5(bgj, dj, aX, dA, eG, h, eX, crO, P, n, bj, cA, hW, u, y); #c1(PLCD1) c2(NP_001124436) c3(8574) c4(34688, 47745, 60802, 21631, 73859) c5(d, jh, by, hW, LL, crV, Bs, e, bu, P, T, fD, cO, IK, di, at, u, mQ, y, alz); #c1(PLCD3) c2(NP_588614) c3(8575) c4(34689, 47746, 60803, 21632, 73860) c5(oy, P, eG); #c1(PLCD4) c2(NP_116115) c3(8576) c4(34690, 47747, 60804, 21633, 73861) c5(P, u, y); #c1(PLCE1) c2(NP_001159451) c3(8577) c4(34691, 47748, 60805, 21634, 73862) c5(e, d, alz, b, cE, jc, di, Ir, U, hP, atX, oy, jh, bb, AX, aDx, F, bbG, bu, do, ik, atT, ar, kN, o, te, is, PJ, V, il, bx, Xc, bd, by, acU, P, T, wd, JY, py, fD, I, hc); #c1(PLCG1) c2(NP_002651) c3(8578) c4(34692, 47749, 60806, 21635, 73863) c5(A, b, sJ, U, e, O, d, h, ak, B, VM, cs, aV, u, n, xc, V, I, J, ad, P, T, eX, ch, y); #c1(PLCG2) c2(NP_002652) c3(8579) c4(34693, 47750, 60807, 21636, 73864) c5(fe, bb, crW, zv, ak, P, bu, cT, yU, y, et, crY, bq, jT, u, crX); #c1(PLCH1) c2(NP_001124432) c3(8580) c4(34694, 47751, 60808, 21637, 73865) c5(d, co, dA, ar, fy, e); #c1(PLCL1) c2(NP_006217) c3(8581) c4(34695, 47752, 60809, 21638, 73866) c5(ali, fx, co, V, il, ayJ, bd, A, ik, sF, i, U, kK, fD, aA, o, cp); #c1(PLCL2) c2(NP_001137854) c3(8582) c4(34696, 47753, 60810, 21639, 73867) c5(aC, xe, bT, cO); #c1(PLCXD2) c2(NP_001172035) c3(8583) c4(34697, 47754, 60811, 21640, 73868) c5(Eo, qf, do); #c1(PLCXD3) c2(NP_001005473) c3(8584) c4(34698, 47755, 60812, 21641, 73869) c5(qf); #c1(PLCZ1) c2(NP_149114) c3(8585) c4(34699, 47756, 60813, 21642, 73870) c5(bk, am); #c1(PLD1) c2(NP_001123553) c3(8586) c4(34700, 47757, 60814, 21643, 73871) c5(l, aX, V, b, dA, be, PB, bu, by, iZ, T, O, bt, sR, O, k, u, y); #c1(PLD2) c2(NP_001230037) c3(8587) c4(34701, 47758, 60815, 21644, 73872) c5(beO, b, k, eu, og, di, cO, U, O, ml, es, iZ, y, u, o, ma, V, Bs, jT, beQ, ie, w, fD); #c1(PLD3) c2(NP_001026866) c3(8588) c4(34702, 47759, 60816, 21645, 73873) c5(csa, u, crZ); #c1(PLD4) c2(NP_620145) c3(8589) c4(34703, 47760, 60817, 21646, 73874) c5(aC, j); #c1(PLD5) c2(NP_001182740) c3(8590) c4(34704, 47761, 60818, 21647, 73875) c5(aV, cz); #c1(PLEC) c2(NP_000436) c3(8591) c4(34705, 47762, 60819, 21648, 73876) c5(csc, aw, b, k, aHH, xQ, mk, Vl, XW, arW, xl, asN, XZ, biK, f, F, q, arU, Gs, aMO, ar, Yb, xC, gL, biv, W, P, xS, fO, XT, csb, aOo, dt, csd, jR, xP); #c1(PLEK2) c2(NP_057529) c3(8592) c4(34706, 47763, 60820, 21649, 73877) c5(A, aX); #c1(PLEKHA1) c2(NP_001001974) c3(8593) c4(34707, 47764, 60821, 21650, 73878) c5(dx, ZP, du, UA, aW); #c1(PLEKHA2) c2(NP_067636) c3(8594) c4(34708, 47765, 60822, 21651, 73879) c5(jT); #c1 (PLEKHA5) c2(NP_001137293) c3(8595) c4(34709, 47766, 60823, 21652, 73880) c5(dA); #c1(PLEKHA6) c2(NP_055750) c3(8596) c4(34710, 47767, 60824, 21653, 73881) c5(di); #c1(PLEKHA7) c2(NP_778228) c3(8597) c4(34711, 47768, 60825, 21654, 73882) c5(oy, A, sr, Be, er, md, di, jb); #c1(PLEKHB1) c2(NP_001123505) c3(8598) c4(34712, 47769, 60826, 21655, 73883) c5(w, f, u, y, aW); #c1(PLEKHD1) c2(NP_001154970) c3(8599) c4(34713, 47770, 60827, 21656, 73884) c5(bg); #c1(PLEKHF1) c2(NP_077286) c3(8600) c4(34714, 47771, 60828, 21657, 73885) c5(csf, b, X, csg, ll, i, cse); #c1(PLEKHF2) c2(NP_078889) c3(8601) c4(34715, 47772, 60829, 21658, 73886) c5(fl); #c1(PLEKHG1) c2(NP_001025055) c3(8602) c4(34716, 47773, 60830, 21659, 73887) c5(wX, at, cp); #c1(PLEKHG2) c2(NP_073746) c3(8603) c4(34717, 47774, 60831, 21660, 73888) c5(M, kS, bp); #c1(PLEKHG3) c2(XP_011534927) c3(8604) c4(34718, 47775, 60832, 21661, 73889) c5(cz); #c1(PLEKHG4) c2(NP_001123201) c3(8605) c4(34719, 47776, 60833, 21662, 73890) c5(KR, kS, KL, zp, rw, aqW, Nw, kV, ac); #c1(PLEKHG6) c2(NP_001138328) c3(8606) c4(34720, 47777, 60834, 21663, 73891) c5(u, y); #c1(PLEKHH2) c2(NP_742066) c3(8607) c4(34721, 47778, 60835, 21664, 73892) c5(wd); #c1(PLEKHM1) c2(NP_055613) c3(8608) c4(34722, 47779, 60836, 21665, 73893) c5(csh, zl, csi, av, bj, HP); #c1(PLEKH01) c2(NP_001291653) c3(8609) c4(34723, 47780, 60837, 21666, 73894) c5(fr, ft); #c1 (PLEKH02) c2(NP_079477) c3(8610) c4(34724, 47781, 60838, 21667, 73895) c5(at); #c1(PLEK) c2(NP_002655) c3(8611) c4(34725, 47782, 60839, 21668, 73896) c5(fl, b, cG, X, OA, ahS, ig, w, Iv, et, cp, aX, aeT, cN, rr, VI, cO, av, aV, arS, I, aC, J, asM, ahO, cy, jH, amy, azp, xP, xb, fP, aA); #c1(PLG) c2(NP_000292) c3(8612) c4(34726, 47783, 60840, 21669, 73897) c5(dx, gK, by, en, axx, sE, aZm, dB, csn, csk, eC, w, bzL, cO, Eh, aw, yi, ra, O, M, dv, cy, kc, iR, e, eQ, iT, sZ, om, mR, vT, Pv, ik, Hs, g, aBs, bJ, aUM, du, bp, ft, sW, x, qt, fx, gg, eN, aL, gs, tl, dS, fc, bpA, DO, nG, ag, xb, fY, i, dc, bg, aA, hx, blE, id, cY, EB, eu, aiM, aer, mA, bf, bw, U, Co, zL, cM, ed, co, fm, wP, amo, f, bu, csl, B, eH, cs, av, fy, bm, wY, pW, bk, d, V, jh, aDM, cd, IR, eX, bt, ar, tj, Yu, iA, pi, xd, qW, aY, fw, aUZ, vH, gA, IP, tl, zS, bwi, ap, hV, bW, uS, zH, aF, Xv, rT, m, A, ciw, ey, azn, aO, esm, eE, b, bb, Dx, fv, jd, re, gz, q, jV, X, mL, dQ, DZ, u, dh, o, cl, aAf, kF, I, LR, aza, ad, RY, IX, Fk, Nh, et, et, Jl, aHg, wV, rQ, hU, aUN, aFa, he, gd, IS, Ol, Yb, I, bRg, aLQ, bL, Ic, k, fr, ok, og, di, iL, eO, wf, fs, be, sx, vl, aW, iy, aXO, YT, qs, aX, il, bj, oE, cU, aC, Gs, y, Jk, aCH, aV, bcV, fU, Eg, be, cbf, bd, da, dt, cso, T, Oi, jl, Pk, blC, aM, wU, csj, ql, bl, bV, fP, aGo, bh, at, eG); #c1(PLGLB2) c2(NP_002656) c3(8613) c4(34727, 47784, 60841, 21670, 73898) c5(at); #c1(PLIN1) c2(XP_005254991) c3(8614) c4(34728, 47785, 60842, 21671, 73899) c5(mz, bQ, bb, I, wU, fN, eX, fh, QX, axl, di, QY, kF, aA, csp, gF, aO, Mb); #c1(PLIN2) c2(NP_001113) c3(8615) c4(34729, 47786, 60843, 21672, 73900) c5(ml, b, pR, anb, dB, od, yn, aW, hh, oc, bu, zN, jG, nW, axl, T, dO, fN, jo, boM, avL, aA, afG); #c1(PLIN3) c2(NP_001157666) c3(8616) c4(34730, 47787, 60844, 21673, 73901) c5(aA, f, vQ); #c1(PLIN4) c2(NP_001073869) c3(8617) c4(34731, 47788, 60845, 21674, 73902) c5(aA, oG, cp); #c1(PLIN5) c2(NP_001013728) c3(8618) c4(34732, 47789, 60846, 21675, 73903) c5(aA); #c1(PLK1) c2(NP_005021) c3(8619) c4(34733, 47790, 60847, 21676, 73904) c5(B, aw, aMr, x, w, adr, e, O, M, t, cl, fH, jM, g, asQ, nl, gm, fO, ft, QZ, fx, jT, jE, BX, ag, i, Dr, iF, X, iG, bo, bw, U, y, co, pp, f, zh, bu, cs, av, fy, bm, fi, jB, V, ny, f J, JY, py, jR, Le, OG, b, oi, Ne, d, jh, re, hV, q, fv, ff, ar, jG, u, il, ad, G, nV, iR, I, A, kY, fr, pD, bj, aX, h, cO, ik, cB, fO, cV, dB, J, jo, T, by, ip, Oi, eG); #c1(PLK2) c2(NP_001239155) c3(8620) c4(34734, 47791, 60848, 21677, 73905) c5(b, X, pD, bg, BY, w, e, d, Ag, h, f, q, fr, ar, gP, av, bm, o, E, bp, ft, T, fO, fx, jT, jE, u, ag, Af, i); #c1(PLK4) c2(NP_001177728) c3(8621) c4(34735, 47792, 60849, 21678, 73906) c5(A, V, b, f, q, yy, Nz, B, QZ, aTd, U, u, kP); #c1(PLK5) c2(NP_001230008) c3(8622) c4(34736, 47793, 60850, 21679, 73907) c5(g, w, k); #c1(PLLP) c2(NP_057077) c3(8623) c4(34737, 47794, 60851, 21680, 73908) c5(ahe, o, TO); #c1(PLN) c2(NP_002658) c3(8624) c4(34738, 47795, 60852, 21681, 73909) c5(fn, ml, b, sv, di, cO, MY, aoa, akP, akK, cr, h, M, csg, mL, mR, csr, I, Bs, me, J, xj, JT, P, cK, hR, mO, sK, acw, fc, cZ, bq, ap); #c1(PL0D2) c2(NP_000926) c3(8625) c4(34739, 47796, 60853, 21682, 73910) c5(fl, css, bm, buE, zF, Jh, q, aSc, X, vc, vu, hM, j, Ex, jG, u, yw, y); #c1(PLP1) c2(NP_000524) c3(8626) c4(34740, 47797, 60854, 21683, 73911) c5(mZ, cst, IK, k, xf, eD, pi, cb, aHd, oB, f, v, ky, tE, esu, alb, ahe, GS, cJ, bK, KU, LG, QC, bN, dt, bel, cpH, cz, aHX, ac, aV, Y, acs, asM, Jz, TX, fO, Dg); #c1(PLP2) c2(NP_002659) c3(8627) c4(34741, 47798, 60855, 21684, 73912) c5(nz, f, g); #c1 (PLRG1) c2(NP_001188493) c3(8628)

60856, 21685, 73913) c5(BO, co, b, jh); #c1(PLS1) c2(NP_001138791) c3(8629) c4(34743, 47800, 60857, 21686, 73914) c5(en, I, zE, ji, aye, DA, bm); #c1(PLS3) c2(NP_001269266) c3(8630) c4(34744, 47801, 60858, 21687, 73915) c5(aw, V, zF, ad, fG, kz, cs, O, cp); #c1 (PLSCR1) c2(NP_066928) c3(8631) c4(34745, 47802, 60859, 21688, 73916) c5(m, buh, en, lb, h, be, J, fw, M, X, T, jV, av); #c1(PLSCR3) c2(NP_065093) c3(8632) c4(34746, 47803, 60860, 21689, 73917) c5(aA, cV); #c1 (PLSCR4) c2(NP_001121778) c3(8633) c4(34747, 47804, 60861, 21690, 73918) c5(fU, BY, sf, cO, jT, fp, cM); #c1(PLSCR5) c2(NP_001078889) c3(8634) c4(34748, 47805, 60862, 21691, 73919) c5(c0); #c1(PLTP) c2(NP_001229849) c3(8635) c4(34749, 47806, 60863, 21692, 73920) c5(dx, sO, ZG, eH, eO, bf, dv, or, f, aM, u, o, I, du, su, ZO, rf, dS, mA, aA, at, ap); #c1(PLVAP) c2(NP_112600) c3(8636) c4(34750, 47807, 60864, 21693, 73921) c5(g, Xh, jz, jQ); #c1(PLXDC1) c2(NP_065138) c3(8637) c4(34751, 47808, 60865, 21694, 73922) c5(we, wf, fr, b); #c1(PLXDC2) c2(NP_001269665) c3(8638) c4(34752, 47809, 60866, 21695, 73923) c5(bL, at, dA, qr, cO, wf, bf, hR, ac, aM); #c1(PLXNA1) c2(NP_115618) c3(8639) c4(34753, 47810, 60867, 21696, 73924) c5(fx, A, iP, iG, b, B, Le, ag, fe, T, O, i, oi, bOO, u, av, y); #c1(PLXNA2) c2(NP_079455) c3(8640) c4(34754, 47811, 60868, 21697, 73925) c5(A, w, csv, bj, aW, TC, oy, bQ, jl, ahc, nU, vQ, B, cou, nR, Uy, hW, I, cV, gH, aQE, KU, gm, J, ceb, T, cp, JJ, bnU, jT, aQB, ih, bGj, dX, aCQ, bq, bxm, ap); #c1(PLXNA3) c2(NP_059984) c3(8641) c4(34755, 47812, 60869, 21698, 73926) c5(FD, m, dj, ajF, aeB, ih, di, cA, iA, yi); #c1(PLXNA4) c2(NP_001099013) c3(8642) c4(34756, 47813, 60870, 21699, 73927) c5(oy, m, cy, v, eO, aX); #c1(PLXNB1) c2(NP_001123554) c3(8643) c4(34757, 47814, 60871, 21700, 73928) c5(tp, aw, b, X, re, ahd, ar, dB, cT, T, iT, bf, aX, av, u, y, aM); #c1(PLXNB3) c2(NP_001156729) c3(8644) c4(34758, 47815, 60872, 21701, 73929) c5(O, b); #c1(PLXNC1) c2(NP_005752) c3(8645) c4(34759, 47816, 60873, 21702, 73930) c5(cY, eG, bj, aX, b); #c1(PLXND1) c2(NP_055918) c3(8646) c4(34760, 47817, 60874, 21703, 73931) c5(g, aX, b, K, bu, dU, anK); #c1(PM20D1) c2(NP_689704) c3(8647) c4(34761, 47818, 60875, 21704, 73932) c5(jE, bj, q, xa, aeA, ajf, bm); #c1(PMA1P1) c2(NP_066950) c3(8648) c4(34762, 47819, 60876, 21705, 73933) c5(0G, A, aw, b, X, aeD, bw, y, co, aX, kJ, B, F, q, jV, es, av, aV, bm, fO, lb, gL, GQ, fO, IV, fy, aeq, u, aoD, ag, cT); #c1(PMCH) c2(NP_002665) c3(8649) c4(34763, 47820, 60877, 21706, 73934) c5(fr, gn, CP, z, Eh, bf, cM, TC, baV, Hq, cy, Re, f, gU, bGO, Tv, pP, Fg, qw, cV, cx, ft, aDA, pq, aY, Ck, yM, dc, aA, byB); #c1(PMEL) c2(NP_001186982) c3(8650) c4(34764, 47821, 60878, 21707, 73935) c5(A, pV, kE, b, cY, ahM, jz, w, lv, 1W, e, jQ, d, bPc, jT, aX, zu, 1Z, t, re, B, aoQ, qB, ar, iT, Xu, J, fO, Ej, P, T, aYz, ad, xO, ale, iu, G, dY, WJ, cT, gR, kD); #c1(PMEPA1) c2(NP_001242905) c3(8651) c4(34765, 47822, 60879, 21708, 73936) c5(A, b, X, dB, bj, y, co, bb, Qm, f, ar, B, cs, av, u, J, bp, ad, W, T, ji, x, cy, jT, Oi); #c1(PMF1-BGLAP) c2(NP_001186590) c3(8652) c4(34766, 47823, 60880, 21709, 73937) c5(fx, aw, i); #c1 (PMF1) c2(NP_001186582) c3(8653) c4(34767, 47824, 60881, 21710, 73938) c5(fx, aw, i); #c1(PML) c2(NP_002666) c3(8654) c4(34768, 47825, 60882, 21711, 73939) c5(jK, B, aw, w, oU, t, all, e, dl, bdT, acy, fH, Zv, lb, nl, iv, ft, jT, csw, cq, jE, BX, we, cT, bT, mZ, aPm, X, jj, wy, oH, ig, si, bo, y, co, f, N, bu, cs, av, fy, bm, iT, fi, NZ, f J, gt, gR, b, ic, bah, d, bb, re, q, jV, ar, pB, jG, DY, u, o, Kx, gL, ad, G, Ut, wV, hX, DR, wP, fl, A, fr, pR, avn, C, iL, bZ, h, aXR, gT, M, aC, ag, cV, Be, J, P, T, ll, by, csx, eN);

c1(PMM1) c2(NP_002667) c3(8655) c4(34769, 47826, 60883, 21712, 73940) c5(No, LE, vQ); #c1(PMM2) c2(NP_000294) c3(8656) c4(34770, 47827, 60884, 21713, 73941) c5(KC, gw, eq, I, bhD, LE, nW, nU, Dp, akV, ea, xX, No, em, cfH, SZ, Te, jw, ez); #c1(PMP22) c2(NP_000295) c3(8657) c4(34771, 47828, 60885, 21714, 73942) c5(aLt, aeK, aFY, aw, b, LX, bid, acs, asf, apR, eu, HG, O, cc, tN, s, Em, bf, O, bUr, iU, xl, pp, gZ, jU, LI, cN, mZ, cfS, AX, cG, el, aDx, csC, ky, y, bK, bbu, yA, csA, u, ov, te, bhn, csE, csz, V, wp, jH, nl, aiU, PL, ahe, yH, j, MO, dt, ebr, bel, mX, T, ar, ft, Y, bzk, ac, bgD, xV, fr, amy, csF, csy, hX, UR, hie, csB, blb, ex, na, csD, bCK, nd, UT, df); #c1(PMPCA) c2(NP_001269873) c3(8658) c4(34772, 47829, 60886, 21715, 73943) c5(bSi, TD); #c1(PMPCB) c2(NP_004270) c3(8659) c4(34773, 47830, 60887, 21716, 73944) c5(d, jG, e, b); #c1(PMS1) c2(NP_000525) c3(8660) c4(34774, 47831, 60888, 21717, 73945) c5(A, b, X, jz, dB, di, Iv, eM, bw, U, fR, O, jQ, co, aX, kJ, B, bu, ar, av, u, V, gm, by, Ce, BL, jT, ag, i, I); #c1(PMS2) c2(NP_000526) c3(8661) c4(34775, 47832, 60889, 21718, 73946) c5(fA, pm, A, aw, b, X, i, wn, YO, w, U, re, hP, y, fe, co, aX, am, oB, B, LI, cO, YP, cI, cs, as, av, u, g, NT, V, an, dB, ad, W, I, Ce, T, alM, Kv, x, et, iA, jT, Fz, jR, tl, aJR, af, csG); #c1(PMVK) c2(NP_006547) c3(8662) c4(34776, 47833, 60890, 21719, 73947) c5(bzm); #c1(PNCK) c2(NP_001034671) c3(8663) c4(34777, 47834, 60891, 21720, 73948) c5(pR); #c1(PNKD) c2(NP_001070867) c3(8664) c4(34778, 47835, 60892, 21721, 73949) c5(f, b, X, dB, aN, di, y, bsl, bQ, kJ, hV, av, u, ae, bK, aib, an, xM, HN, bM, dR, bT); #c1(PNKP) c2(NP_009185) c3(8665) c4(34779, 47836, 60893, 21722, 73950) c5(aw, csH, bK, f, v, W, QZ, ny, x, aV, csl, ov, ait); #c1(PNLDC1) c2(NP_001258791) c3(8666) c4(34780, 47837, 60894, 21723, 73951) c5(bb, et); #c1(PNLIP) c2(NP_000927) c3(8667) c4(34781, 47838, 60895, 21724, 73952) c5(bn, I, asx, csJ, cV, ciR, aA); #c1(PNLIPRP2) c2(NP_005387) c3(8668) c4(34782, 47839, 60896, 21725, 73953) c5(ag, bn); #c1(PNMA1) c2(NP_006020) c3(8669) c4(34783, 47840, 60897, 21726, 73954) c5(csK, ky); #c1(PNMA2) c2(NP_009188) c3(8670) c4(34784, 47841, 60898, 21727, 73955) c5(oa, fO, b); #c1(PNMT) c2(NP_002677) c3(8671) c4(34785, 47842, 60899, 21728, 73956) c5(sz, qs, cf, bb, uJ, bxC, ch, f, di, o, cV, VP, bq, aA, aV, u, y); #c1(PNN) c2(NP_002678) c3(8672) c4(34786, 47843, 60900, 21729, 73957) c5(b, aY, t, h, ih, G, dc, cM); #c1(PNO1) c2(NP_064528) c3(8673) c4(34787, 47844, 60901, 21730, 73958) c5(by, en, iL, b, dB, wy, AA, hS, w, brZ, kY, O, jy, bw, ai, bu, A, e, y, cy, d, ed, co, aX, bj, aEz, f, el, q, es, Vr, kz, mR, B, iv, Tk, QJ, u, nz, o, sz, fO, si, jE, ae, m, bK, Ua, cs, v, j, J, P, T, aj, fy, rO, are, ad, xx, fM, ao, KK, bm, Jh, ag, cz, jT, fl, QP, nU); #c1(PN0C) c2(NP_006219) c3(8674) c4(34788, 47845, 60902, 21731, 73959) c5(IV, Vb, b, cV, aF, csL, hn, xJ, Wf, fK, Lw, Gj, bQF, oN); #c1(PNP) c2(NP_000261) c3(8675) c4(34789, 47846, 60903, 21732, 73960) c5(dx, A, b, cY, eu, y, cp, dv, aX, pp, bxG, t, B, q, X, fv, O, cs, u, o, em, Pz, ae, beW, Dg, du, v, dt, dU, P, cV, fx, jT, aiN, dO, G, ag, CL, i, fl); #c1(PNPLA1) c2(NP_001139188) c3(8676) c4(34790, 47847, 60904, 21733, 73961) c5(mk, aA, dw, csM); #c1(PNPLA2) c2(NP_065109) c3(8677) c4(34791, 47848, 60905, 21734, 73962) c5(dx, wa, arn, b, X, zF, UA, A, bNs, cO, wf, bf, O, auV, y, dv, aX, I, ml, f, q, bSk, Zl, Kb, dZ, B, oD, av, oA, u, dh, dV, jB, kF, nQ, du, ft, dt, Fy, eX, gF, hR, dL, aM, Eu, fr, bm, Bu, MP, ep, ag, fN, bM, ao, oF, ap); #c1(PNPLA3) c2(NP_079501) c3(8678) c4(34792, 47849, 60906, 21735, 73963) c5(dx, b, gE, rd, au, iL, z, bf, ey, al, dv, avt, lz, rh, eX, q, az, aE, aM, bm, jZ, em, I, du, gv, P, ll, gF, dL, Ha, jE, fN, ex, bh, aA); #c1(PNPLA4) c2(NP_001166143) c3(8679) c4(34793, 47850, 60907, 21736, 73964) c5(aA); #c1(PNPLA5) c2(NP_001171146) c3(8680) c4(34794, 47851, 60908, 21737, 73965) c5(bq, aA); #c1(PNPLA6) c2(NP_001159583) c3(8681) c4(34795, 47852, 60909, 21738, 73966) c5(ao, Y, ac, bK, aFg, vD, v, bN, cc, csN, cV, OA, csO, eD, ov, bEr, II); #c1(PNPLA8) c2(NP_001242937) c3(8682) c4(34796, 47853, 60910, 21739, 73967) c5(U, ar, V); #c1(PNP0) c2(NP_060599) c3(8683) c4(34797, 47854, 60911, 21740, 73968) c5(b, dk, IC, q, hS, di, dl, bm, CG, csP); #c1(PNPT1) c2(NP_149100) c3(8684) c4(34798, 47855, 60912, 21741, 73969) c5(oy, fi, ao, aX, b, csQ, cE, cO, csR, q, ag, cV, Bx, I, Fr, aV, oT); #c1(PNRC1) c2(NP_006804) c3(8685) c4(34799, 47856, 60913, 21742, 73970) c5(g, vQ); #c1(P0C1A) c2(NP_001155052) c3(8686) c4(34800, 47857, 60914, 21743, 73971) c5(csU, Dv, csV, csT, csS, u, y); #c1(P0C1B) c2(NP_001186706) c3(8687) c4(34801, 47858, 60915, 21744, 73972) c5(bw, nW); #c1(P0C5) c2(NP_001092741) c3(8688) c4(34802, 47859, 60916, 21745, 73973) c5(dA); #c1(P0DXL) c2(NP_001018121) c3(8689) c4(34803, 47860, 60917, 21746, 73974) c5(bP, A, aw, b, X, gG, dB, w, eO, vp, U, e, y, d, B, q, ar, cs, u, V, x, fp, ck); #c1(P0F1B) c2(NP_079197) c3(8690) c4(34804, 47861, 60918, 21747, 73975) c5(ao, csW, mk, qi, age, jw, Ap); #c1(P0FUT1) c2(NP_056167) c3(8691) c4(34805, 47862, 60919, 21748, 73976) c5(rW, csX, O); #c1(P0FUT2) c2(NP_056042) c3(8692) c4(34806, 47863, 60920, 21749, 73977) c5(aC, at, di, aE, I); #c1(P0GK) c2(NP_060012) c3(8693) c4(34807, 47864, 60921, 21750, 73978) c5(di, cp); #c1(P0GLUT1) c2(NP_689518) c3(8694) c4(34808, 47865, 60922, 21751, 73979) c5(ig, csY, ci, n, h); #c1(P0LA1) c2(NP_058633) c3(8695) c4(34809, 47866, 60923, 21752, 73980) c5(fr, WE, nU, ft); #c1(P0LA2) c2(NP_002680) c3(8696) c4(34810, 47867, 60924, 21753, 73981) c5(i); #c1(P0LB) c2(NP_002681) c3(8697) c4(34811, 47868, 60925, 21754, 73982) c5(GK, B, b, X, m, A, O, bw, O, y, jh, co, ip, jd, f, bu, ik, ff, cs, av, aV, u, o, q, ma, V, wU, Qz, ad, GB, P, T, x, et, fx, by, ac, dt, wV, aq, GM, wP, cT, i, I); #c1(P0LD1) c2(NP_001243778) c3(8698) c4(34812, 47869, 60926, 21755, 73983) c5(f, b, X, aN, O, w, jR, bb, et, O, A, fx, y, V, co, aX, zJ, h, aua, F, q, jV, cU, mg, B, cB, cs, av, aV, u, o, iF, eta, csZ, lb, aSw, J, fO, ad, P, T, pt, x, Hh, iA, jT, gk, eq, US, fy, eF, bm, fw, auy, i, I, oM, at, eG); #c1(P0LD2) c2(NP_001243808) c3(8699) c4(34813, 47870, 60927, 21756, 73984) c5(av, T, i); #c1(P0LD3) c2(NP_006582) c3(8700) c4(34814, 47871, 60928, 21757, 73985) c5(bm, en, V, b, Pv, aLQ, f, F, q, ad, O, jk, P, A, B, i, cs, U, u, y); #c1(P0LD4) c2(NP_001243799) c3(8701) c4(34815, 47872, 60929, 21758, 73986) c5(ae, fO, zE, b, fr, fj, ml, jz, J, ft, co, bk, O, u, h, ac, jQ); #c1(P0LD1P3) c2(NP_001265586) c3(8702) c4(34816, 47873, 60930, 21759, 73987) c5(ao, vQ); #c1(P0LE2) c2(NP_001184259) c3(8703) c4(34817, 47874, 60931, 21760, 73988) c5(i); #c1(P0LE3) c2(NP_059139) c3(8704) c4(34818, 47875, 60932, 21761, 73989) c5(fl, Oa, bu, P, aoQ, Ku, gg); #c1(P0LE4) c2(NP_063949) c3(8705) c4(34819, 47876, 60933, 21762, 73990) c5(ae, co, zE, b, fr, ml, jz, J, ft, bk, O, u, h, ac, jQ); #c1(P0LE) c2(NP_006222) c3(8706) c4(34820, 47877, 60934, 21763, 73991) c5(jh, by, aw, V, b, ctb, Bc, etc, do, bp, bu, cO, cT, T, i, QZ, U, aV, u, iA); #c1(P0LG2) c2(NP_009146) c3(8707) c4(34821, 47878, 60935, 21764, 73992) c5(ae, Am, co, cdv, kW, aC, bK, ctd, awT, aE, xU, sJ, mg, fx, i, h, x, oD, al, P, anf); #c1(P0LG) c2(NP_002684) c3(8708) c4(34822, 47879, 60936, 21765, 73993) c5(f, aw, aoJ, b, Bl, sL, mR, awS, FJ, bK, ctl, KX, cth, i, eh, aA, cG, jf, hS, Lr, ho, y, ak, B, cti, bgW, oD, av, EX, Am, GS, v, ctf, ctg, cK, ctj, IC, ake, am, dk, EH, Hh, jy, ala, bb, kW, aPm, EW, aE, aNN, cte, NT, kF, be, yH, cz, awT, Nh, awV, PL, u, hT, AB, ov, na, ex, cIN, A, SS, di, jw, bj, bht, bda, aV, dj, awP, hZ, ctk, P, ac, Lc, Y, eh, cH, agc, at); #c1(P0LH) c2(NP_001278899) c3(8709) c4(34823, 47880, 60937, 21766, 73994) c5(aX, BX, b, adr, i, Dj, ip, dt, ctm, ny, fl, yA, u); #c1(P0L1) c2(NP_009126) c3(8710) c4(34824, 47881, 60938, 21767, 73995) c5(d, cW, A, cy, il, b, jh, re, pD, e, tF, cT, vu, T, iT, i, aA, Zv, u, fx, y); #c1(P0LK) c2(NP_057302) c3(8711) c4(34825, 47882, 60939, 21768, 73996) c5(co, V, f, i, U, u, y); #c1(P0LL) c2(NP_001167555) c3(8712) c4(34826, 47883, 60940, 21769, 73997) c5(Pu, am, b, i, f, q, bp, MW, cT, co, B, A, U, u, y, V); #c1(P0LM) c2(NP_001271259) c3(8713) c4(34827, 47884, 60941, 21770, 73998) c5(jh, co, auU, bp, T, pD, i, jT, O); #c1(P0LN) c2(NP_861524) c3(8714) c4(34828, 47885, 60942, 21771, 73999) c5(aX, o); #c1(P0LQ) c2(NP_955452) c3(8715) c4(34829, 47886, 60943, 21772, 74000) c5(b, adr, Dj, ctm, i, fl, yA, u, y); #c1(P0LR1A) c2(NP_056240) c3(8716) c4(34830, 47887, 60944, 21773, 74001) c5(at, Kx); #c1(P0LR1B) c2(NP_001131076) c3(8717) c4(34831, 47888, 60945, 21774, 74002) c5(U, f, V); #c1(P0LR1C) c2(NP_976035) c3(8718) c4(34832, 47889, 60946, 21775, 74003) c5(Xt, ctn); #c1(P0LR1D) c2(NP_057056) c3(8719) c4(34833, 47890, 60947, 21776, 74004) c5(bb, cte, et, IV, Xt); #c1(P0LR2A) c2(NP_000928) c3(8720) c4(34834, 47891, 60948, 21777, 74005) c5(b, pR, dB, by, i, bu); #c1(P0LR2B) c2(NP_000929) c3(8721) c4(34835, 47892, 60949, 21778, 74006) c5(ln, i, aW); #c1(P0LR2C) c2(NP_116558) c3(8722) c4(34836, 47893, 60950, 21779, 74007) c5(JH, i); #c1(P0LR2D) c2(NP_004796) c3(8723) c4(34837, 47894, 60951, 21780, 74008) c5(mz, gk, I, aPA, B, ahS, MP, mA, aE, ctp, P, A, eX, i, bh, bf, al, nR, aA, aM); #c1(P0LR2E) c2(NP_002686) c3(8724) c4(34838, 47895, 60952, 21781, 74009) c5(i, cV); #c1(P0LR2F) c2(NP_001288058) c3(8725) c4(34839, 47896, 60953, 21782, 74010) c5(T, i); #c1(P0LR2G) c2(NP_002687) c3(8726) c4(34840, 47897, 60954, 21783, 74011) c5(da, kM, ff, R); #c1(P0LR2H) c2(NP_001265643) c3(8727) c4(34841, 47898, 60955, 21784, 74012) c5(i); #c1(P0LR2J) c2(NP_006225) c3(8728) c4(34842, 47899, 60956, 21785, 74013) c5(i); #c1(P0LR2K) c2(NP_005025) c3(8729) c4(34843, 47900, 60957, 21786, 74014) c5(X, i); #c1(P0LR2M) c2(NP_001018112) c3(8730) c4(34844, 47901, 60958, 21787, 74015) c5(f, A, B); #c1(P0LR3A) c2(NP_008986) c3(8731) c4(34845, 47902, 60959, 21788, 74016) c5(ctq, b, cJ, Jh, j, vc, DT); #c1(P0LR3B) c2(NP_001154180) c3(8732) c4(34846, 47903, 60960, 21789, 74017) c5(Fp, cJ, ctr, nU, agl, amR, UT); #c1(P0LR3E) c2(NP_001244962) c3(8733) c4(34847, 47904, 60961, 21790, 74018) c5(aX, b, Dg, bkk, P, fR); #c1(P0LR3K) c2(NP_057394) c3(8734) c4(34848, 47905, 60962, 21791, 74019) c5(bu); #c1(P0LRMT) c2(NP_005026) c3(8735) c4(34849, 47906, 60963, 21792, 74020) c5(awT, i); #c1(P0M121) c2(NP_001244119) c3(8736) c4(34850, 47907, 60964, 21793, 74021) c5(jG, rv); #c1(P0MC) c2(NP_001306134) c3(8737) c4(34851, 47908, 60965, 21794, 74022) c5(gK, ak, pV, aeB, dB, aqt, dd, cO, aw, bD, Uq, e, O, cp, aVT, zo, rh, afj, zH, afH, dl, ctx, tU, avP, zn, vO, Nd, ctv, vN, p, afh, ao, bp, vc, sK, bbr, x, RY, ca, jT, xx, Fw, mO, iz, cX, Vb, bbk, fN, TW, aoq, hn, HR, ag, cT, oi, ctB, yH, dc, aC, aUn, jl, tW, rn, sU, nX, Al, Jy, iF, cY, DO, iP, bY, rd, cty, vR, bz, bf, cA, aFa, cM, gB, co, bBS, bbs, rr, f, pi, aMN, ctt, ky, yE, mm, OT, ctA, d, Gr, fD, dA, qq, IM, cx, gF, bQ, eX, cK, aA, pk, Fz, dP, OW, aY, Fu, cf, hd, tl, UT, jP, apT, RB, bbj, avX, Tp, rD, b, ctu, aF, aVU, jJ, eR, Hq, A, ic, tG, kF, ceX, ey, azn, ctw, bbQ, wZ, bHp, hV, Jq, ND, X, DZ, Gj, aM, u, dh, aVS, da, bLI, jj, ctz, I, im, Ir, el, aNc, gL, cz, CM, Fo, rw, iN, ce, bbl, IV, Ha, axG, hU, mk, DR, OV, Jj, ex, ih, gd, bO, rv, yA, OS, biS, QU, bbf, iL, gO, gE, EE, di, kD, vg, bZQ, nc, jw, bj, adR, dl, bbg, gs, abe, aeM, jk, bbR, hB, oE, avT, nY, aE, qB, hS, aV, Ry, clb, fU, hW, aeh, hZ, be, gV, vF, W, gj, P, mX, T, Bg, alM, aX, nP, vv, qT, qp, et, Fp, cts, acK, bbe, eB, Yv, iB, at, ctC, MQ, Gl); #c1(P0MGNT1) c2(NP_001277059) c3(8738) c4(34852, 47909, 60966, 21795, 74023) c5(ctF, WE, bdg, kG, ctE, nU, Iv, ctD, vt, xl); #c1(P0MGNT2) c2(NP_116195) c3(8739) c4(34853, 47910, 60967, 21796, 74024) c5(ctG, hW, ctH, xl); #c1 (P0MK) c2(NP_115613) c3(8740) c4(34854, 47911, 60968, 21797, 74025) c5(ctl); #c1(POMP) c2(NP_057016) c3(8741) c4(34855, 47912, 60969, 21798, 74026) c5(l, Zy, f, mk, ctJ, u, oG, y, aHB); #c1(P0MT1) c2(NP_001070834) c3(8742) c4(34856, 47913, 60970, 21799, 74027) c5(g, AA, hT, ctL, VQ, nU, Iv, amS, O, ctK, cK, QZ, kG, xl); #c1(P0MT2) c2(NP_037514) c3(8743) c4(34857, 47914, 60971, 21800, 74028) c5(ctO, WE, hT, kG, VQ, ctN, nU, Iv, ctM, QZ, xl, FR); #c1(P0MZP3) c2(NP_036362) c3(8744) c4(34858, 47915, 60972, 21801, 74029) c5(rv); #c1(P0N1) c2(NP_000437) c3(8745) c4(34859, 47916, 60973, 21802, 74030) c5(dx, IJ, dM, dN, dD, ud, aE, eH, sJ, xb, ak, bf, eP, e, Up, gO, bQ, avt, am, rh, wd, gU, bbJ, tE, ju, fH, IV, q, mz, aC, nl, sH, du, gJ, gm, bp, vc, eR, Eu, ctP, jT, hj, pg, gE, BX, ctO, dS, bm, xG, bbH, tO, bk, i, dc, bq, aA, GJ, id, td, Jy, fO, X, eu, mk, fO, bbC, cA, vl, cM, aCC, ip, ml, f, vQ, B, iv, av, pP, d, Gr, xE, V, v, xF, gv, Fy, dv, eX, ny, cy, fJ, dO, aaa, aum, fw, vH, ap, uh, bn, b, ia, aw, vY, fl, nv, tG, z, ey, gZ, fD, aO, yK, dl, bb, jd, wQ, je, q, mL, Nf, HL, u, xp, o, fh, da, Tl, Pz, ahF, I, UG, hv, gL, cz, tm, rB, ctR, EE, et, jU, jH, ao, rQ, hU, ig, vT, dh, ih, aY, Ns, ah, I, xf, wR, bL, oG, A, k, iC, aCD, di, jR, vg, eO, wf, kF, al, Bz, bj, aW, ny, m, jl, ob, sG, h, gr, cd, Vr, Gs, y, Ek, aV, te, dj, ctS, si, sj, J, vF, P, ll, mQ, fz, aM, aLj, ii, Y, LQ, Ic, Ng, fP, OA, bh, at, eG, bmF); #c1(P0N2) c2(NP_000296) c3(8746) c4(34860, 47917, 60974, 21803, 74031) c5(dx, dM, vg, dD, eO, eR, mk, id, di, tG, z, wf, bf, eP, eh, dv, bb, ml, f, dl, Vr, aO, hj, dh, o, fh, le, Pz, I, xf, du, gL, vc, cd, cy, hR, et, ac, aM, aCC, ao, ig, Ic, fw, aE, vH, xb, fP, bk, fD, bq, aA, at, ap); #c1(P0N3) c2(NP_000931) c3(8747) c4(34861, 47918, 60975, 21804, 74032) c5(dx, m, ao, du, bb, b, ig, f, fP, Vr, P, dv, eO, z, bq, aA, at, o); #c1(P0P1) c2(NP_001139332) c3(8748) c4(34862, 47919, 60976, 21805, 74033) c5(vc, awJ, adK, eo); #c1(P0P4) c2(NP_006618) c3(8749) c4(34863, 47920, 60977, 21806, 74034) c5(X, fP); #c1 (P0PDC3) c2(NP_071756) c3(8750) c4(34864, 47921, 60978, 21807, 74035) c5(by, aV, adK, bu); #c1(P0RCN) c2(NP_001269096) c3(8751) c4(34865, 47922, 60979, 21808, 74036) c5(ce, Al, b, aeF, avN, arF, bp, P, bf, aM, u, bH1, y, gT); #c1(P0R) c2(NP_000932) c3(8752) c4(34866, 47923, 60980, 21809, 74037) c5(P, ctT, azn, Al, age, b, avN, f, xJ, bp, cz, W, DC, co, zM, i, bf, aM, u, y, gT); #c1(P0STN) c2(NP_001129406) c3(8753) c4(34867, 47924, 60981, 21810, 74038) c5(dx, id, b, bw, y, gM, c, dv, aX, bu, ff, u, o, ax, TK, du, jo, co, T, bkj, x, fx, dH, nV, P, i, ctU, bq); #c1(P0T1) c2(XP_006715980) c3(8754) c4(34868, 47925, 60982, 21811, 74039) c5(aw, b, jz, i, ic, aun, e, y, jQ, d, co, bb, q, bu, jF, u, V, Fs, by, aX, iA, jT, st, ie, cT, tl, I, yA, ap, Iv); #c1(P0TED) c2(NP_778146) c3(8755) c4(34869, 47926, 60983, 21812, 74040) c5(A, b, X, B, ck, av, u, y); #c1(P0TEF) c2(NP_001093241) c3(8756) c4(34870, 47927, 60984, 21813, 74041) c5(en, Ir, hM, Bj, Bf, e, jT, cy, t, AX, Bk, kz, mR, n, yL, gm, fx, hR, eg, wh, AW, ag, i, aA, fl, eu, Bd, ur, U, y, co, cX, AZ, ak, vQ, bu, B, cs, fy, jB, AU, V, gv, eX, W, py, jd, nU, b, gz, Bh, ha, d, Ba, AT, Be, AV, q, jF, fv, ar, jG, u, kF, by, G, et, jU, wV, Bg, wP, fl, A, k, AQ, C, AO, aX, h, oJ, cB, aq, AS, fU, tP, Be, dt, P, T, ll, bM, Bb, ad, ii, AR, fP, Am, bh, at, eG, Bi); #c1(P0TEG) c2(NP_001005356) c3(8757) c4(34871, 47928, 60985, 21814, 74042) c5(b); #c1(P0TEH) c2(NP_001129685) c3(8758) c4(34872, 47929, 60986, 21815, 74043) c5(O, b); #c1(POTEM) c2(NP_001138914) c3(8759) c4(34873, 47930, 60987, 21816, 74044) c5(b, jj, jw, bj, eV, O, cy, I, tF, BI, ak, gX, y, qY, u, aE, o, ae, wp, Bm, dc, I, bq); #c1(POU1F1) c2(NP_000297) c3(8760) c4(34874, 47931, 60988, 21817, 74045) c5(A, iq, iF, iP, VY, hM, OV, avX, y, gO, bBS, aQF, ja, nU, ayi, Dc, mm, u, ctV, bBN, Be, W, T, Jj, sP, pq, wU, LO, acK, yE, biS, bBW); #c1(POU2AF1) c2(NP_006226) c3(8761) c4(34875, 47932, 60989, 21818, 74046) c5(WH, b, cO, Ou, m, Zq, h, px, iv, fH, Ah, aV, V, Ov, gm, fO, P, jT, fJ, wV, wP, cT, bT); #c1(POU2F1) c2(NP_001185712) c3(8762) c4(34876, 47933, 60990, 21819, 74047) c5(dx, gB, HI, gG, eW, w, di, Ou, al, cp, bkC, dv, il, f, q, bu, ik, fP, jG, aMi, u, o, iF, ae, aC, du, gm, by, Ov, T, qH, fp, DE, jT, fy, I, iT, aA, bT); #c1(POU2F2) c2(NP_001193954) c3(8763) c4(34877, 47934, 60991, 21820, 74048) c5(b, pD, Iv, Ou, U, y, RR, jT, aX, h, q, bu, cl, fH, Ah, u, iT, is, fe, Ov, gm, fO, J, od, by, et, fJ, ac, ag, re); #c1(POU2F3) c2(NP_001231611) c3(8764) c4(34878, 47935, 60992, 21821, 74049) c5(dx, bL, ach, arQ, sA, ix, bLr, y, dv, bb, re, bu, bTI, u, iT, PJ, I, du, by, aR, cbe, Ic, bq, at, ap); #c1(POU3F2) c2(NP_005595) c3(8765) c4(34879, 47936, 60993, 21822, 74050) c5(fU, aX, b, ak, eu, bp, rQ, kD); #c1(POU3F3) c2(NP_006227) c3(8766) c4(34880, 47937, 60994, 21823, 74051) c5(jh, nw); #c1(POU3F4) c2(NP_000298) c3(8767) c4(34881, 47938, 60995, 21824, 74052) c5(nx, nU, dB, na, Bx, ctW, aNa, ckQ, Bj); #c1(POU4F1) c2(NP_006228) c3(8768) c4(34882, 47939, 60996, 21825, 74053) c5(B, b, Ip, A, dV, m, aX, h, f, q, dZ, cl, iT, ale, J, cV, pb, qp, OW, ctX, jR, yq, re, ib); #c1(POU4F2) c2(NP_004566) c3(8769) c4(34883, 47940, 60997, 21826, 74054) c5(m, aw, b, ctX, cV, Ip, ahV, dZ, dV, u, y); #c1(POU4F3) c2(NP_002691) c3(8770) c4(34884, 47941, 60998, 21827, 74055) c5(ctY, aOO, f, na, Bx, Fg); #c1(POU5F1B) c2(NP_001153014) c3(8771) c4(34885, 47942, 60999, 21828, 74056) c5(A, b, X, B, T, i); #c1(POU5F1) c2(NP_001272915) c3(8772) c4(34886, 47943, 61000, 21829, 74057) c5(jp, f, aw, bx, boP, gG, w, yi, e, O, yg, UZ, gB, sL, afM, ft, od, fx, jT, fp, mO, fy, aV, ag, Lo, iT, i, bq, X, wy, ix, aAM, IW, Lr, U, Co, y, co, Dq, hg, IN, bu, B, av, PX, ctZ, V, IR, Lx, ji, ck, b, aiR, Ne, d, jh, aol, re, q, ar, HE, u, da, wp, by, IX, xq, Lt, wV, Eu, Bg, wP, IS, A, IO, fr, Lv, cua, BY, aWp, jw, yw, m, QV, aX, F, nM, Dd, ZU, cV, J, T, Ap, TY, Rd, sf, eG); #c1(POU6F1) c2(NP_002693) c3(8773) c4(34887, 47944, 61001, 21830, 74058) c5(nU, hW, aqB, aY, bK, f, Ey, aqx, ak, dc, cub, gZ, xx, cM); #c1(POU6F2) c2(NP_001159490) c3(8774) c4(34888, 47945, 61002, 21831, 74059) c5(bj, fe, cuc, cz); #c1(PPA1) c2(NP_066952) c3(8775) c4(34889, 47946, 61003, 21832, 74060) c5(ai, cO, ar, b, aj); #c1(PPA2) c2(NP_008834) c3(8776) c4(34890, 47947, 61004, 21833, 74061) c5(aoJ); #c1(PPAP2A) c2(NP_003702) c3(8777) c4(34891, 47948, 61005, 21834, 74062) c5(X, Fr, bu); #c1(PPAP2C) c2(NP_003703) c3(8778) c4(34892, 47949, 61006, 21835, 74063) c5(T, b); #c1(PPAPDC1B) c2(NP_001096029) c3(8779) c4(34893, 47950, 61007, 21836, 74064) c5(fU, aw, q, bp, co, fv, u, y); #c1(PPAPDC2) c2(NP_982278) c3(8780) c4(34894, 47951, 61008, 21837, 74065) c5(J, b); #c1(PPAPDC3) c2(NP_116117) c3(8781) c4(34895, 47952, 61009, 21838, 74066) c5(cO); #c1(PPARA) c2(XP_011528545) c3(8782) c4(34896, 47953, 61010, 21839, 74067) c5(dx, dM, dD, DT, eH, w, tH, cO, bf, e, cgR, bQ, cy, iR, rh, gB, eE, nm, jm, mR, gP, mz, aqQ, sH, du, bp, dB, vM, hR, dL, aL, jE, fy, oQ, dS, fN, ie, hn, tD, cT, dh, i, bq, aA, yC, rd, mk, Bg, kY, vl, y, co, cK, f, B, cs, vE, oD, cp, bm, iT, bk, em, jB, V, Bs, Fy, dv, eX, Hh, xd, cuf, cf, gL, T, ap, b, MU, sU, Fr, ey, fD, aD, d, Ag, bb, jd, re, q, Mr, ff, u, nj, o, fh, da, kF, I, fz, dK, cue, et, jU, Ha, jH, hU, ch, aFa, kM, mA, ex, th, I, A, xj, sv, di, iL, gE, U, oy, aX, cud, fq, cl, aV, ma, cV, J, jo, bTj, II, gF, ad, aM, vt, Af, gj, bh, at, eG, oT); #c1(PPARD) c2(NP_001165290) c3(8783) c4(34897, 47954, 61011, 21840, 74068) c5(dx, ml ak, b, mz, afY, z, eH, mk, A, di, ic, cO, bf, U, Oh, adr, fD, aO, d, co, dv, fy, Bc, cK, f, e, q, bu, ar, y, cB, cs, av, JY, u, o, da, em, gG, kF, V, I, cV, agb, Bs, du, cx, bp, ad, W, P, nV, T, eX, bt, x, et, by, dL, yA, ac, aM, Vs, ch, os, B, xr, i, fN, Oi, aA, at, ap); #c1(PPARGC1A) c2(NP_037393) c3(8784) c4(34898, 47955, 61012, 21841, 74069) c5(dx, eX, sJ, hM, cO, bf, cgR, bQ, nv, sL, fH, Hs, cc, mz, Ib, bK, du, gJ, MD, hR, pq, tS, OR, fN, fD, dc, bq, aA, bT, id, rd, Co, cM, ml, f, B, cs, av, bm, em, V, cx, v, IR, dv, cK, fJ, buB, pk, dO, aY, vH, yM, ap, b, aF, au, ey, bb, kW, q, ar, ff, pB, wC, u, o, kF, I, dK, ad, IX, bgs, jU, ao, ch, mA, IS, brU, A, iL, ka, di, vg, gE, wf, bj, aW, oy, aX, az, y, aV, si, afx, bd, do, T, ac, aM, Y, MP, sp, at, eG); #c1(PPARGC1B) c2(NP_001166169) c3(8785) c4(34899, 47956, 61013, 21842, 74070) c5(A, b, ka, aF, eH, au, di, vg, cO, bf, ey, y, aX, cK, f, az, do, ar, B, cs, u, o, cc, I, nl, ad, eX, cy, aM, aA, brU); #c1(PPARG) c2(NP_005028) c3(8786) c4(34900, 47957, 61014, 21843, 74071) c5(dx, gK, by, en, aw, dN, Gm, dD, gG, aY, dB, aE, aN, eH, sJ, w, cO, bf, if, aK, ra, O, gO, cU, wo, bQ, cy, aMF, et, aeB, e, fP, iT, dl, Zl, FN, jm, mR, ia, aD, fH, aay, cc, g, mz, acJ, og, mm, lb, VA, sH, du, fO, aow, bp, gY, Kh, od, Jj, vM, x, fx, hR, dL, gg, tS, mC, wh, fy, gs, akn, Ip, fN, aTZ, Kf, os, tO, ag, xr, Oh, bk, i, bq, aA, Ah, hx, ib, Mb, Dr, mZ, id, td, em, X, vD, eu, pB, rd, mk, Bd, Ku, kY, IW, bw, U, Hf, y, aNH, ed, co, eK, pp, gd, DM, f, cs, bu, Kb, ky, B, Mp, il, bv, oD, av, cp, bm, uO, Hb, le, V, ae, Zh, bx, jR, cx, cd, v, IR, WM, dv, AF, bt, ar, Hh, iA, cuh, aol, fJ, aAE, JY, xe, aH, dO, py, aum, kJ, Fy, in, acR, ep, gA, yM, ji, iu, aG, fn, gB, uy, b, aF, QY, bXG, KN, m, au, yU, z, jk, ey, bT, BQ, aO, d, bb, Iz, om, re, hV, q, jV, ap, ND, fr, Kz, dQ, ff, hb, n, Km, vX, fi, sK, u, nj, o, fh, da, Tl, cpG, iP, kF, jE, I, bc, bPr, fz, dK, ad, BZ, IX, wL, acS, aZ, et, sN, GW, jG, jU, jH, ao, nV, hU, VQ, xL, kB, hX, ch, yC, OW, kh, mA, dh, yr, oo, IS, OI, I, vZ, ph, OS, fl, QN, fw, bL, A, fD, bW, Nf, vF, pR, eO, xj, gN, EE, aMP, di, HS, iL, eM, wf, jw, ft, hP, vl, eh, NS, oy, vH, qs, Hi, aX, or, bn, bj, h, yE, az, aC, ik, oJ, cB, bK, kD, PT, aV, jZ, cug, ma, si, bo, nQ, cV, hZ, be, J, gV, gm, W, P, T, gL, bXB, Oi, jl, gF, Ap, aM, wU, jT, Lc, ii, bSB, vu, Xu, Ic, MP, xd, eX, gu, j, fq, gj, bh, at, eG, Bi, oT); #c1(PPAT) c2(NP_002694) c3(8787) c4(34901, 47958, 61015, 21844, 74072) c5(ch, at, q, ff, gt); #c1(PPBP) c2(NP_002695) c3(8788) c4(34902, 47959, 61016, 21845, 74073) c5(en, fe, nh, axx, aDM, DM, f, dB, J, cy, DI, di, iT, pR, qt, jG, at, u, re, y, ap); #c1(PPCDC) c2(NP_001288034) c3(8789) c4(34903, 47960, 61017, 21846, 74074) c5(cz); #c1(PPEF1) c2(NP_689412) c3(8790) c4(34904, 47961, 61018, 21847, 74075) c5(bj, aJc); #c1(PPEF2) c2(XP_011530341) c3(8791) c4(34905, 47962, 61019, 21848, 74076) c5(qf); #c1(PPFIA1) c2(NP_003617) c3(8792) c4(34906, 47963, 61020, 21849, 74077) c5(d, b, F, MS, T, u, e, y); #c1(PPFIA2) c2(NP_001207402) c3(8793) c4(34907, 47964, 61021, 21850, 74078) c5(bf, A, Bu, cy); #c1(PPFIA4) c2(NP_001291260) c3(8794) c4(34908, 47965, 61022, 21851, 74079) c5(di, dB); #c1(PPFIBP1) c2(NP_001185844) c3(8795) c4(34909, 47966, 61023, 21852, 74080) c5(jh, iy, aFQ, Ts, Pv, dA, alf, kB, T, aV); #c1(PPFIBP2) c2(NP_001243497) c3(8796) c4(34910, 47967, 61024, 21853, 74081) c5(gG, u); #c1(PPIA)

c2(NP_001287910) c3(8797) c4(34911, 47968, 61025, 21854, 74082) c5(dx, bL, en, bW, b, qd, gE, hS, A, IW, bf, jD, y, d, co, cy, kJ, f, e, q, bu, cU, fv, B, fy, u, fU, sQ, I, gG, aC, du, J, gL, P, dv, II, iA, ac, aM, ao, aeq, mb, ag, w, bp, cd); #c1(PPIB) c2(NP_000933) c3(8798) c4(34912, 47969, 61026, 21855, 74083) c5(bm, gE, b, zF, f, q, J, P, cs, cut ad, u, y); #c1(PPIC) c2(NP_000934) c3(8799) c4(34913, 47970, 61027, 21856, 74084) c5(by, bu); #c1(PPID) c2(NP_005029) c3(8800) c4(34914, 47971, 61028, 21857, 74085) c5(o, A, ez, b, f, v, B, ag, jT, y, Au, ex, u, xl, ap); #c1(PPIF) c2(NP_005720) c3(8801) c4(34915, 47972, 61029, 21858, 74086) c5(aoa, o, f, ez, b, gz, v, ex, ag, y, Au, oD, u, xl, ap); #c1(PPIG) c2(NP_004783) c3(8802) c4(34916, 47973, 61030, 21859, 74087) c5(dx, B, dN, hM, cO, e, O, dv, cy, fH, oJ, Yj, aOb, du, fO, bp, fx, wh, bY, i, dc, jj, hS, U, cM, ed, co, f, cs, bu, NK, iv, fy, bm, is, V, ae, gv, rV, fJ, aY, fw, ne, ap, ck, b, aF, z, d, bb, re, q, bcs, jG, u, dh, o, il, cl, j, by, qu, aAB, ao, HV, Ib, A, Lv, jc, di, m, I, ni, h, ik, y, Jk, jZ, hW, auU, J, P, ti, T, II, ad, Jh, bh, at, eG); #c1(PPIL1) c2(NP_057143) c3(8803) c4(34917, 47974, 61031, 21860, 74088) c5(b, cs, by, gE, ad, bu); #c1(PPIL2) c2(NP_680480) c3(8804) c4(34918, 47975, 61032, 21861, 74089) c5(o); #c1(PPIL3) c2(NP_115861) c3(8805) c4(34919, 47976, 61033, 21862, 74090) c5(0); #c1(PPIP5K1) c2(NP_001124330) c3(8806) c4(34920, 47977, 61034, 21863, 74091) c5(aX, pF, dQ, II, gE, ajd); #c1(PPL) c2(NP_002696) c3(8807) c4(34921, 47978, 61035, 21864, 74092) c5(d, xJ, bs, il, b, hV, yr, rQ, ik, e); #c1(PPM1A) c2(NP_066283) c3(8808) c4(34922, 47979, 61036, 21865, 74093) c5(A, b, B, q, P, II); #c1(PPM1B) c2(NP_001028729) c3(8809) c4(34923, 47980, 61037, 21866, 74094) c5(azI, azJ, at); #c1(PPM1D) c2(NP_003611) c3(8810) c4(34924, 47981, 61038, 21867, 74095) c5(IO, b, k, X, fE, cuj, U, D, pp, f, q, bu, y, av, fy, u, V, cV, dT, T, x, jR, yA); #c1(PPM1E) c2(NP_055721) c3(8811) c4(34925, 47982, 61039, 21868, 74096) c5(u, y); #c1(PPM1F) c2(NP_055449) c3(8812) c4(34926, 47983, 61040, 21869, 74097) c5(f, b); #c1(PPM1G) c2(NP_817092) c3(8813) c4(34927, 47984, 61041, 21870, 74098) c5(di); #c1(PPM1H) c2(NP_065751) c3(8814) c4(34928, 47985, 61042, 21871, 74099) c5(fi, m, dA, ad, ar, cs); #c1(PPM1K) c2(NP_689755) c3(8815) c4(34929, 47986, 61043, 21872, 74100) c5(ao, f, bb, cuk, q, GF, cB, agx); #c1(PPM1L) c2(NP_640338) c3(8816) c4(34930, 47987, 61044, 21873, 74101) c5(ct, aA, In); #c1(PPM1M) c2(NP_001116342) c3(8817) c4(34931, 47988, 61045, 21874, 74102) c5(ak, u, Lt, y); #c1(PPME1) c2(NP_001258522) c3(8818) c4(34932, 47989, 61046, 21875, 74103) c5(co, b, k, Bc, bu, cU, iA, by, O); #c1(PPOX) c2(NP_001116236) c3(8819) c4(34933, 47990, 61047, 21876, 74104) c5(cum, bKd, bHT, I, em, nF, Rl, Rk, nB, aVm, Hh, OL, cul, OR, hc); #c1(PPP1CA) c2(NP_001008709) c3(8820) c4(34934, 47991, 61048, 21877, 74105) c5(d, sQ, b, q, bxG, w, u, e, y); #c1(PPP1CC) c2(NP_001231903) c3(8821) c4(34935, 47992, 61049, 21878, 74106) c5(X, wn, NT, b, am); #c1(PPP1R10) c2(NP_002705) c3(8822) c4(34936, 47993, 61050, 21879, 74107) c5(is, m, b, k, aeD, jc, ix, o); #c1(PPP1R11) c2(NP_068778) c3(8823) c4(34937, 47994, 61051, 21880, 74108) c5(m, b, cV, os, ag, xY, aV, aW); #c1(PPP1R12A) c2(NP_001137357) c3(8824) c4(34938, 47995, 61052, 21881, 74109) c5(cy, b, iP, fO, ag, aeP, cO, bW, av, akK, iK); #c1(PPP1R12B) c2(NP_001161329) c3(8825) c4(34939, 47996, 61053, 21882, 74110) c5(bb); #c1(PPP1R12C) c2(NP_060077) c3(8826) c4(34940, 47997, 61054, 21883, 74111) c5(dj, bQ, b, bm, eX, g, fO, pn, O, cs, fy, u, y); #c1(PPP1R13B) c2(NP_056131) c3(8827) c4(34941, 47998, 61055, 21884, 74112) c5(b, ic, iL, O, bQ, aX, t, eX, q, pn, Dd, y, cs, fy, bm, dj, fO, G, od, aol, ZU, u); #c1(PPP1R13L) c2(NP_001135974) c3(8828) c4(34942, 47999, 61056, 21885, 74113) c5(A, aw, b, X, Lv, i, w, bno, iL, IO, y, co, aX, t, h, hV, q, B, iv, av, fy, u, V, J, fO, W, G, T, nV, ck, cT, tl, Oi, zD); #c1(PPP1R14A) c2(NP_001230876) c3(8829) c4(34943, 48000, 61057, 21886, 74114) c5(bzW, bIZ, cun, iP, q, lh); #c1(PPP1R14B) c2(NP_619634) c3(8830) c4(34944, 48001, 61058, 21887, 74115) c5(aaQ, P, aX, kt); #c1(PPP1R14C) c2(NP_112211) c3(8831) c4(34945, 48002, 61059, 21888, 74116) c5(GS, u, Io, y); #c1(PPP1R15A) c2(NP_055145) c3(8832) c4(34946, 48003, 61060, 21889, 74117) c5(aX, b, f, fO, nM, oi, T, fO, fl, rw, iy, at, dh, O); #c1(PPP1R15B) c2(NP_116222) c3(8833) c4(34947, 48004, 61061, 21890, 74118) c5(u, y); #c1(PPP1R17) c2(NP_001138595) c3(8834) c4(34948, 48005, 61062, 21891, 74119) c5(dD, dE); #c1(PPP1R18) c2(NP_001128342) c3(8835) c4(34949, 48006, 61063, 21892, 74120) c5(m); #c1(PPP1R1A) c2(NP_006732) c3(8836) c4(34950, 48007, 61064, 21893, 74121) c5(bL, id, b, X, aF, w, cO, y, aX, cK, yh, q, M, aKE, fH, av, u, jB, be, fO, et, fJ, aKB, fG, bg); #c1(PPP1R1B) c2(NP_115568) c3(8837) c4(34951, 48008, 61065, 21894, 74122) c5(ux, b, GL, oE, e, y, d, ak, bu, ar, cM, Gj, u, dj, si, Be, GS, KL, by, T, JY, to, aY, xH, jN, dc); #c1(PPP1R2) c2(NP_006232) c3(8838) c4(34952, 48009, 61066, 21895, 74123) c5(f, fl, I, b); #c1(PPP1R3A) c2(NP_002702) c3(8839) c4(34953, 48010, 61067, 21896, 74124) c5(tS, mz, jT, A, kF, V, b, eX, QY, bKt, MG, bQ, I, fD, bf, at, M, o, aM); #c1(PPP1R3B) c2(NP_078883) c3(8840) c4(34954, 48011, 61068, 21897, 74125) c5(ak, fN, be, eH, zj, eX, bf, aA, at, dL, aM); #c1(PPP1R3C) c2(NP_005389) c3(8841) c4(34955, 48012, 61069, 21898, 74126) c5(azw, zj, I, be, eH, cO, bf, aM); #c1(PPP1R42) c2(NP_001013648) c3(8842) c4(34956, 48013, 61070, 21899, 74127) c5(bq, ar); #c1(PPP1R7) c2(NP_001269338) c3(8843) c4(34957, 48014, 61071, 21900, 74128) c5(re, T, b); #c1(PPP1R9A) c2(NP_001159632) c3(8844) c4(34958, 48015, 61072, 21901, 74129) c5(aC); #c1(PPP2CA) c2(NP_002706) c3(8845) c4(34959, 48016, 61073, 21902, 74130) c5(bm, uk, cy, gt, b, m, zv, aq, q, do, I, hb, al, hR, u, y, at); #c1(PPP2CB) c2(NP_001009552) c3(8846) c4(34960, 48017, 61074, 21903, 74131) c5(A, ar); #c1(PPP2R1A) c2(NP_055040) c3(8847) c4(34961, 48018, 61075, 21904, 74132) c5(IO, b, X, QB, gw, cD, y, yg, co, aX, pp, q, bu, cU, av, avg, alq, fe, T, iA, u, in, af); #c1(PPP2R1B) c2(NP_001171033) c3(8848) c4(34962, 48019, 61076, 21905, 74133) c5(co, V, b, X, re, q, bp, ad, cT, iT, cs, U, u, av, y); #c1(PPP2R2A) c2(NP_001171062) c3(8849) c4(34963, 48020, 61077, 21906, 74134) c5(A, V, kJ, aNj, wy, tv, ag, di, U, fy, u, aA, y); #c1(PPP2R2B) c2(NP_001258828) c3(8850) c4(34964, 48021, 61078, 21907, 74135) c5(aw, akB, cO, kV, y, cp, co, f, sL, RA, u, o, amd, cup, hW, cV, GS, v, QI, rw, kS, at, zp, Fg, GJ, cuo); #c1(PPP2R2C) c2(NP_001193924) c3(8851) c4(34965, 48022, 61079, 21908, 74136) c5(g, co, I, b, dA, Dt, tv, A, B, at, O); #c1(PPP2R3A) c2(NP_001177376) c3(8852) c4(34966, 48023, 61080, 21909, 74137) c5(kJ); #c1(PPP2R3B) c2(NP_037371) c3(8853) c4(34967, 48024, 61081, 21910, 74138) c5(vQ); #c1(PPP2R4) c2(NP_001180326) c3(8854) c4(34968, 48025, 61082, 21911, 74139) c5(by, ak, aw, pF, b, cY, ey, m, A, cO, U, al, y, V, yg, co, aX, h, f, F, q, jV, bu, X, jT, B, hb, cs, av, aV, u, o, n, fe, kF, Kx, I, cV, lb, zv, LR, v, bp, J, P, T, cy, ad, jG, ao, aeq, HN, ag, cT, amu, cB, I, cun); #c1(PPP2R5A) c2(NP_001186685) c3(8855) c4(34969, 48026, 61083, 21912, 74140) c5(tv, cuq, kJ); #c1(PPP2R5B)

c2(NP_006235) c3(8856) c4(34970, 48027, 61084, 21913, 74141) c5(RA, u, cuo, cur); #c1(PPP2R5C) c2(NP_001155197) c3(8857) c4(34971, 48028, 61085, 21914, 74142) c5(b, h, J, cz, M, cT, jG); #c1(PPP2R5D) c2(NP_006236) c3(8858) c4(34972, 48029, 61086, 21915, 74143) c5(X); #c1(PPP2R5E) c2(NP_001269109) c3(8859) c4(34973, 48030, 61087, 21916, 74144) c5(oy, co, V, b, bu, cT, y, U, by, u, Fg); #c1(PPP3CA) c2(NP_000935) c3(8860) c4(34974, 48031, 61088, 21917, 74145) c5(dx, wa, A, b, cY, aF, jL, i, jd, fU, cO, aEc, U, ha, bj, brA, y, hh, zM, fe, co, sS, bn, ml, f, e, q, bu, M, X, ar, B, hb, av, fy, u, dh, o, d, ma, V, cV, aC, by, me, dB, fO, ft, IJ, dv, T, cK, nP, hR, ac, du, fr, Ic, bVC, nJ, we, aEb, tl, rw, eG); #c1(PPP3CB) c2(NP_001135825) c3(8861) c4(34975, 48032, 61089, 21918, 74146) c5(bVC, su, sO); #c1(PPP3CC) c2(NP_001230903) c3(8862) c4(34976, 48033, 61090, 21919, 74147) c5(to, xq, hW, A); #c1(PPP3R1) c2(NP_000936) c3(8863) c4(34977, 48034, 61091, 21920, 74148) c5(cV, bVC, di, uw, at, o); #c1(PPP3R2) c2(NP_671709) c3(8864) c4(34978, 48035, 61092, 21921, 74149) c5(bq, at, hb, dA); #c1(PPP4C) c2(NP_002711) c3(8865) c4(34979, 48036, 61093, 21922, 74150) c5(Tw, kJ, f, aw, cz); #c1(PPP4R1) c2(NP_001035847) c3(8866) c4(34980, 48037, 61094, 21923, 74151) c5(ac); #c1(PPP5C) c2(NP_001191213) c3(8867) c4(34981, 48038, 61095, 21924, 74152) c5(ak, xO, gw, sp, A, B, HE, Fr, u, buB); #c1(PPP6C) c2(NP_001116827) c3(8868) c4(34982, 48039, 61096, 21925, 74153) c5(aX, b, cY, q, ig, aw); #c1(PPP6R2) c2(NP_001229828) c3(8869) c4(34983, 48040, 61097, 21926, 74154) c5(aF, ap); #c1(PPP6R3) c2(NP_001157632) c3(8870) c4(34984, 48041, 61098, 21927, 74155) c5(PA, u); #c1(PPRC1) c2(NP_001275656) c3(8871) c4(34985, 48042, 61099, 21928, 74156) c5(A, aX, I, b, cE, bx, iP, f, bu, W, ra, P, B, cV, Uq, by, dh); #c1(PPT2) c2(NP_001191032) c3(8872) c4(34986, 48043, 61100, 21929, 74157) c5(P, m, cV, aC, LG, v, sp, aZ, I, DF, aE); #c1(PPY) c2(NP_002713) c3(8873) c4(34987, 48044, 61101, 21930, 74158) c5(A, b, X, eu, rd, bn, D, bFe, btB, pp, B, tF, cs, o, mz, I, Dg, qq, jT, ahT, qp, cf, aA); #c1(PQBP1) c2(NP_001161464) c3(8874) c4(34988, 48045, 61102, 21931, 74159) c5(f, Kx, asx, bK, nz, nU, v, bN, ih, xr, rQ, kD, fN, QZ, OA, dL, cus); #c1(PQLC3) c2(NP_001269639) c3(8875) c4(34989, 48046, 61103, 21932, 74160) c5(bm); #c1(PRAC1) c2(NP_115767) c3(8876) c4(34990, 48047, 61104, 21933, 74161) c5(W, A, B); #c1(PRAC2) c2(XP_011523050) c3(8877) c4(34991, 48048, 61105, 21934, 74162) c5(A, B); #c1(PRADC1) c2(NP_115695) c3(8878) c4(34992, 48049, 61106, 21935, 74163) c5(vg); #c1(PRAF2) c2(NP_009144) c3(8879) c4(34993, 48050, 61107, 21936, 74164) c5(O, b, cV); #c1(PRAM1) c2(NP_115528) c3(8880) c4(34994, 48051, 61108, 21937, 74165) c5(aw, b, lb, h, J, fO, M, aC, jV, iv, pB, pv); #c1(PRAME) c2(NP_996837) c3(8881) c4(34995, 48052, 61109, 21938, 74166) c5(azR, jK, ck, pK, b, fr, iP, jz, dB, Iv, iG, bo, y, jQ, yg, aX, ip, t, h, F, jV, ar, n, iv, fH, jG, fy, u, aHK, J, fO, ft, G, T, jT, fJ, hX, jR, cT, fg, gR, zD); #c1(PRAP1) c2(NP_001138673) c3(8882) c4(34996, 48053, 61110, 21939, 74167) c5(dx, id, b, zH, X, w, A, y, dv, LS, jd, sx, h, B, q, cU, ar, O, cs, u, aC, du, ad, dU, iA, wV, wP, bRq); #c1(PRB1) c2(NP_005030) c3(8883) c4(34997, 48054, 61111, 21940, 74168) c5(jK, jT, aw, Qm, an, f, P, ad, cU, as, Ce, qa, cB, cs, cA, pF, pz); #c1(PRB2) c2(NP_006239) c3(8884) c4(34998, 48055, 61112, 21941, 74169) c5(DW, aw, b, X, iP, bEH, xK, bw, e, y, d, jh, co, aX, cut, f, cU, fr, Em, kk, cB, kX, av, u, cV, qC, ft, L, iA, eN, aal, bqF, cuu, at, iE); #c1(PRB3) c2(NP_006240) c3(8885) c4(34999, 48056, 61113, 21942, 74170) c5(cuv); #c1(PRB4) c2(NP_001248328) c3(8886) c4(35000, 48057, 61114, 21943, 74171) c5(cG); #c1(PRC1) c2(NP_001254509) c3(8887) c4(35001, 48058, 61115, 21944, 74172) c5(co, I, b, i, LR, gm, po, J, be, fl, di, tl, cs, av, ad, u, fx, y); #c1(PRCC) c2(NP_005964) c3(8888) c4(35002, 48059, 61116, 21945, 74173) c5(hh, sg, T, dB, b); #c1(PRCD) c2(NP_001071088) c3(8889) c4(35003, 48060, 61117, 21946, 74174) c5(nQ, nW, ea, sp, cuw, ml); #c1(PRCP) c2(NP_005031) c3(8890) c4(35004, 48061, 61118, 21947, 74175) c5(JP, at, eF, b, aC, sH, IJ, dY, add, gd, P, di, he, asW, aA, aV, u, anW, aeo); #c1(PRDM10) c2(NP_064613) c3(8891) c4(35005, 48062, 61119, 21948, 74176) c5(at, u, aE); #c1(PRDM11) c2(NP_001243625) c3(8892) c4(35006, 48063, 61120, 21949, 74177) c5(b); #c1(PRDM13) c2(NP_067633) c3(8893) c4(35007, 48064, 61121, 21950, 74178) c5(bj); #c1(PRDM14) c2(NP_078780) c3(8894) c4(35008, 48065, 61122, 21951, 74179) c5(b, t, T, Lt, u, y); #c1(PRDM1) c2(NP_001189) c3(8895) c4(35009, 48066, 61123, 21952, 74180) c5(b, iX, gn, mW, BY, rp, y, m, co, px, cB, fH, bm, gl, aC, gm, fD, J, P, II, jT, fJ, jU, jH, wV, BX, u, wP, cT, fP, ji); #c1(PRDM4) c2(NP_036538) c3(8896) c4(35010, 48067, 61124, 21953, 74181) c5(by, aw, bu); #c1(PRDM5) c2(NP_001287752) c3(8897) c4(35011, 48068, 61125, 21954, 74182) c5(QJ, by, co, b, cux, re, f, q, Le, W, ad, T, cs, aOs, bu, hP, iT); #c1(PRDM6) c2(NP_001129711) c3(8898) c4(35012, 48069, 61126, 21955, 74183) c5(sF); #c1(PRDM7) c2(NP_001091643) c3(8899) c4(35013, 48070, 61127, 21956, 74184) c5(c0); #c1(PRDM8) c2(NP_064611) c3(8900) c4(35014, 48071, 61128, 21957, 74185) c5(oy, zj, cO); #c1(PRDM9) c2(NP_064612) c3(8901) c4(35015, 48072, 61129, 21958, 74186) c5(am, gw, Ff, wn, vY, alM, afb); #c1(PRDX2) c2(NP_005800) c3(8902) c4(35016, 48073, 61130, 21959, 74187) c5(sa, en, kE, b, X, aDD, Of, pz, add, kB, A, ku, iL, O, U, re, VX, y, bS, Ag, co, aX, Vx, t, h, f, F, q, jV, iT, M, fr, kr, ik, kk, VM, kO, av, fy, u, o, n, if, wF, bm, V, B, aC, bj, kp, ft, W, G, T, cV, aq, fx, eJ, jE, yC, ks, pP, Yw, hT, PY, eo, ag, kC, Af, i, aU, Xt, mb, kK); #c1(PRDX3) c2(NP_006784) c3(8903) c4(35017, 48074, 61131, 21960, 74188) c5(A, bS, b, JS, pR, fl, iG, cO, aoK, bj, y, cp, co, re, f, q, jV, B, OA, aq, o, aC, cq, u, Rd, jR, iT, aA); #c1(PRDX4) c2(NP_006397) c3(8904) c4(35018, 48075, 61132, 21961, 74189) c5(mz, A, kF, b, h, f, jV, M, ar, B, gj, bf, ey, fy, aE, aM); #c1(PRDX5) c2(NP_036226) c3(8905) c4(35019, 48076, 61133, 21962, 74190) c5(mZ, A, pV, b, k, cY, cs, HG, xf, Pl, hP, y, co, IZ, eD, Dq, f, q, jV, bu, M, X, ky, tE, qB, Yr, mR, av, u, fi, GS, VD, lb, bK, bj, KU, IT, bp, ad, dt, bel, aif, cpH, Zt, cJ, aWN, er, P, asM, B, TX, fD, aC, at, iu); #c1(PRDX6) c2(NP_004896) c3(8906) c4(35020, 48077, 61134, 21963, 74191) c5(dx, A, bS, b, cG, X, brk, z, U, y, co, f, q, B, Yr, av, u, o, V, du, Fs, bp, Fo, aZ, pt, qt, Zt, cft, aWN, Eu, aq, cuy, er, PY, bq, oM, aA, at); #c1(PREB) c2(NP_037520) c3(8907) c4(35021, 48078, 61135, 21964, 74192) c5(cuz, Em); #c1(PRELP) c2(NP_958505) c3(8908) c4(35022, 48079, 61136, 21965, 74193) c5(jd, aC, cT, w, di); #c1(PREP) c2(NP_002717) c3(8909) c4(35023, 48080, 61137, 21966, 74194) c5(aN, ig, xw, aK, O, cuA, bb, cuB, f, bu, eE, cM, aos, aE, I, cV, nl, hue, aY, eB, cT, dc, at); #c1(PREPL) c2(NP_001035844) c3(8910) c4(35024, 48081, 61138, 21967, 74195) c5(azl, xC, azJ, bev, xQ, T, xS, aCT, Ry); #c1(PREX1) c2(NP_065871) c3(8911) c4(35025, 48082, 61139, 21968, 74196) c5(oy, A, aX, b, I, B, QI, u, y); #c1(PREX2) c2(NP_079146) c3(8912) c4(35026, 48083, 61140, 21969, 74197) c5(aX, by, bw, bu, u, y); #c1(PRF1) c2(NP_001076585) c3(8913) c4(35027, 48084, 61141, 21970, 74198) c5(dx, en, ER, Zy, sE, dB, aE, Em, bf, bu, e, O, jR, dv, cy, kc, kJ, t, cuF, aEY, CK, dZ, mR, Dc, gl, brw, JP, IO, Ib, du, gm, ft, x, RY, fx, jT, zQ, yj, dH, gE, sS, pS, cT, bk, i, aC, aA, GJ, GD, gk, il, bS, cY, iP, aFy, ig, ax, dV, bW, ai, y, anJ, yt, bNL, co, BL, Oi, pp, anl, DM, f, apy, vQ, cuC, aaZ, bdl, B, Us, av, fy, bm, ye, iT, d, jB, nl, V, qb, NZ, cd, gv, pr, alM, BV, pi, aAo, pk, dO, PY, dY, ne, iu, fn, cuE, nU, b, aE, bOc, fl, z, yK, jh, bb, jd, bQf, re, hV, q, jV, es, X, aDP, ajJ, ac, as, ar, atr, aM, u, nj, o, da, Zz, aIX, el, ht, aJX, gL, cz, aDv, G, agm, Io, px, yi, jH, ao, nV, hU, aJA, Y, bGp, zO, fl, I, cuD, alg, bL, A, fr, Ik, xc, mW, fe, iV, iL, eM, bJv, al, U, m, Ez, aX, I, h, M, Vr, ik, rR, Ek, aV, aq, jZ, Ac, fU, cV, hZ, J, gj, P, T, ll, aj, jl, ya, by, iv, qe, qT, oL, eG, DI, XH, OA, iB, bh, at, Nu, gf, iE); #c1(PRG2) c2(NP_001230174) c3(8914) c4(35028, 48085, 61142, 21971, 74199) c5(A, b, Ik, iU, pz, w, iL, IS, y, m, cy, Kp, B, q, pC, xl, aV, bm, jZ, Jo, Fs, bks, CM, P, bdS, jl, fc, u, apt, NU, fq, aBF); #c1(PRG4) c2(NP_001121180) c3(8915) c4(35029, 48086, 61143, 21972, 74200) c5(csx, aBt, ahc, cuG, bjy, be, J, caq, bjx); #c1(PRH1) c2(NP_001278243) c3(8916) c4(35030, 48087, 61144, 21973, 74201) c5(dx, en, aw, cuH, dN, aMr, ku, cO, O, dv, t, AX, aDx, aZB, cuK, aix, tE, Pv, bgK, uL, gl, RM, aUM, du, Ej, YT, fx, hR, qt, tl, wi, bqi, ag, i, pt, aA, Yx, bV, id, X, Dv, Yu, dE, aiM, ix, cuJ, fm, amo, cK, f, N, bpL, cs, oD, av, Rb, NZ, aR, eX, bq, tj, cl, aZD, cul, Eh, Ea, jg, aBY, fw, aUZ, bqg, aqn, oM, ap, aSG, aF, qz, eR, cuM, z, bqE, aO, sZ, xi, bb, vf, q, akP, It, DZ, mR, jG, u, dh, wY, Ik, Dg, cuN, bc, ad, G, cuL, rm, aUN, gd, kC, bqj, xf, bpp, bL, acm, gw, gn, mW, di, iL, al, m, aXc, LS, wG, Gs, n, fP, bpM, pE, qC, Eg, IF, dt, ti, ll, Bb, Pk, sK, eN, atJ, hq, Vp, bh, at, Nn); #c1(PRH2) c2(NP_001103683) c3(8917) c4(35031, 48088, 61145, 21974, 74202) c5(dx, en, aw, cuH, dN, aMr, ku, cO, O, dv, t, AX, aDx, aZB, cuK, aix, tE, Pv, bgK, uL, gl, RM, aUM, du, Ej, YT, fx, hR, qt, tl, wi, bqi, ag, i, pt, aA, Yx, bV, id, X, Dv, Yu, dE, aiM, ix, cuJ, fm, amo, cK, f, N, bpL, cs, oD, av, Rb, NZ, aR, eX, bq, tj, cl, aZD, cul, Eh, Ea, jg, aBY, fw, aUZ, bqg, aqn, oM, ap, aSG, aF, qz, eR, cuM, z, bqE, aO, sZ, xi, bb, vf, q, akP, It, DZ, mR, jG, u, dh, wY, Dg, cuN, be, ad, G, cuL, rm, aUN, gd, kC, bqj, xf, bpp, bL, acm, Ik, gn, mW, di, iL, al, m, aXc, LS, wG, Gs, n, fP, bpM, pE, qC, Eg, IF, dt, ti, II, Bb, Pk, sK, eN, atJ, hq, Vp, bh, at, Nn); #c1(PRICKLE1) c2(NP_001138354) c3(8918) c4(35032, 48089, 61146, 21975, 74203) c5(jE, I, aBa, q, ahd, hS, iZ, afb, zk, bm, bVu, zp); #c1(PRICKLE2) c2(NP_942559) c3(8919) c4(35033, 48090, 61147, 21976, 74204) c5(qf, auz, cz, cuO, fP, bm, o); #c1(PRICKLE4) c2(NP_037529) c3(8920) c4(35034, 48091, 61148, 21977, 74205) c5(u, y); #c1(PRIM1) c2(NP_000937) c3(8921) c4(35035, 48092, 61149, 21978, 74206) c5(ho); #c1 (PRIMA1) c2(XP_011544946) c3(8922) c4(35036, 48093, 61150, 21979, 74207) c5(fU, aX, nV, b, ak, hV, fO, es, co, y, O, cA, U, u, h, xl); #c1(PRIMP0L) c2(NP_689896) c3(8923) c4(35037, 48094, 61151, 21980, 74208) c5(cuP); #c1(PRKAA1) c2(NP_006242) c3(8924) c4(35038, 48095, 61152, 21981, 74209) c5(dx, by, A, b, mz, X, dB, ads, iL, cK, bf, Oh, oU, y, d, co, aX, t, h, f, e, bu, fv, B, iv, av, sK, u, dh, o, apz, em, I, du, J, ad, G, T, eX, x, iy, gF, hR, dL, jG, jU, aM, fN, ajf, ag, cT, iT, aA, at, re); #c1(PRKAB1) c2(XP_005253966) c3(8925) c4(35039, 48096, 61153, 21982, 74210) c5(dx, by, A, b, X, dB, ads, cK, bf, ajf, e, y, d, co, aX, t, h, f, bu, fv, B, av, sK, u, dh, o, apz, em, I, du, J, fO, ad, G, T, eX, x, iy, gF, hR, dL, jG, jU, aM, fN, ag, aA, at); #c1(PRKACA) c2(NP_002721) c3(8926) c4(35040, 48097, 61154, 21983, 74211) c5(iF, A, vO, X, t, Ev, B, W, vN, Bd, Ze, tU, u, Hq, o, fh); #c1(PRKACB) c2(NP_001287844) c3(8927) c4(35041, 48098, 61155, 21984, 74212) c5(A, b, Ev, bu, o, fh); #c1(PRKACG) c2(NP_002723) c3(8928) c4(35042, 48099, 61156, 21985, 74213) c5(aX, b, f, MS, xK, fl, kV, alQ); #c1(PRKAG1) c2(NP_001193638) c3(8929) c4(35043, 48100, 61157, 21986, 74214) c5(dx, bf, du, I); #c1(PRKAG2) c2(NP_001035723) c3(8930) c4(35044, 48101, 61158, 21987, 74215) c5(dx, adm, sE, x, cO, bf, cF, Ld, cuQ, oy, qf, BM, aX, uj, cK, ak, q, mL, mR, y, oD, sK, u, dh, adj, em, cuR, I, sX, ui, du, dt, cuS, aes, aYf, cr, et, fM, aM, bQA, cuT, ads, aq, AG, Oh, fD, adw, adl, ap); #c1(PRKAG3) c2(NP_059127) c3(8931) c4(35045, 48102, 61159, 21988, 74216) c5(dx, bQ, kF, cuU, I, oo, du, aW, bf, o); #c1 (PRKAR1A) c2(NP_001263218) c3(8932) c4(35046, 48103, 61160, 21989, 74217) c5(EM, gG, Ip, hM, O, Hq, mR, tU, avP, og, vO, vN, nl, fO, fx, jT, HR, pb, qt, yE, cT, i, aA, X, afY, jj, eu, OV, bw, U, y, pp, B, bu, av, yB, bm, ctA, iF, Bd, YV, V, cuV, qq, aif, cuX, WH, ck, b, MS, jV, coW, jF, Qe, hV, q, Jq, ra, u, o, il, by, iD, et, iw, nV, agb, bDZ, fl, OU, OS, A, MZ, aOv, cuW, Pm, aX, LI, jk, h, brm, hN, ik, atV, aV, cV, an, J, W, T, II, wU, lc); #c1(PRKAR1B) c2(NP_002726) c3(8933) c4(35047, 48104, 61161, 21990, 74218) c5(HR, v, bS); #c1(PRKAR2A) c2(NP_004148) c3(8934) c4(35048, 48105, 61162, 21991, 74219) c5(yD); #c1(PRKAR2B) c2(NP_002727) c3(8935) c4(35049, 48106, 61163, 21992, 74220) c5(m, aA, gG, kF); #c1 (PRKCA) c2(NP_002728) c3(8936) c4(35050, 48107, 61164, 21993, 74221) c5(bm, IJ, A, b, fi, X, aF, aFy, eC, Hq, w, di, kY, cO, bf, ey, xw, fx, y, d, BO, fe, co, aX, si, yE, h, f, e, q, bu, vO, ji, B, cs, oD, av, aV, u, dh, ff, iF, ma, hW, aeM, cV, vN, by, dB, gL, ad, W, P, cU, T, bp, Ze, Qt, fy, cy, iA, O, tU, fU, aM, nV, ch, yC, xd, ajf, ag, apy, i, yA, bh, aA, fh, cK); #c1(PRKCB) c2(NP_002729) c3(8937) c4(35051, 48108, 61165, 21994, 74222) c5(bP, dx, IJ, b, cY, mW, eC, dk, di, bV, cO, cA, bf, ey, bu, y, ed, co, aX, or, bw, h, f, q, es, cbR, jT, oJ, cs, IL, fy, u, gl, NO, da, fU, I, m, aC, Bs, du, gm, ad, dv, T, bq, x, cz, et, xd, wh, ch, ie, aE, ag, cT, fD, bh, aA); #c1(PRKCDBP) c2(NP_659477) c3(8938) c4(35052, 48109, 61166, 21995, 74223) c5(jH, co, bh, V, b, cV, X, t, G, bp, bu, vY, fP, av, by, u, U, y); #c1(PRKCD) c2(NP_997704) c3(8939) c4(35053, 48110, 61167, 21996, 74224) c5(aGP, A, b, vD, mW, O, w, di, dV, aYv, wf, bw, ey, bj, gF, y, d, m, bh, Ov, kW, jd, h, f, je, jV, e, qL, dZ, dQ, B, cs, qu, oD, gg, u, dh, iT, fh, fU, I, Be, Bs, bgW, J, j, by, P, nV, T, bp, aZ, Qt, x, rV, aAP, apG, cW, qp, iP, ch, Jh, pC, gl, ag, cT, Ou, aA, at, cuY, re, ic); #c1(PRKCE) c2(XP_005264485) c3(8940) c4(35054, 48111, 61168, 21997, 74225) c5(id, b, A, di, dV, Fr, y, qf, co, aX, cK, B, do, dZ, O, IV, fy, u, g, bm, cV, gL, T, bp, bq, cy, ac, nV, ch, DO, ih, og, bk, fz, ji, at); #c1(PRKCG) c2(NP_002730) c3(8941) c4(35055, 48112, 61169, 21998, 74226) c5(KO, Kx, kV, nW, nU, v, akB, zT, rw, apy, bh, bM, zR, kS, cuZ, xd); #c1(PRKCH) c2(NP_006246) c3(8942) c4(35056, 48113, 61170, 21999, 74227) c5(dx, dB, gN, w, di, aO, bh, q, bu, do, oD, kN, fh, wK, du, aC, be, by, IV, uf, aY, fw, aA); #c1(PRKC1) c2(NP_002731) c3(8943) c4(35057, 48114, 61171, 22000, 74228) c5(A, b, X, gG, w, e, O, d, jh, co, aX, B, ik, cl, av, fy, u, il, cV, bp, T, jU, QJ, ack, ch, XH); #c1(PRKCQ) c2(NP_001229342) c3(8944) c4(35058, 48115, 61172, 22001, 74229) c5(A, b, aF, mW, ig, di, y, m, bh, aiz, do, u, gl, o, ax, I, aC, aSw, gL, gF, fM, dH, aE, Bm, bq, at); #c1(PRKCSH) c2(XP_011526433) c3(8945) c4(35059, 48116, 61173, 22002, 74230) c5(xc, V, b, z, blN, Iq, aE, bu, iZ, O, Xf, Cl, U, by, adT, y); #c1(PRKCZ) c2(XP_011540075) c3(8946) c4(35060, 48117, 61174, 22003, 74231) c5(A, b, X, nn, dB, ns, w, nt, nq, nr, z, bw, no, np, ey, y, d, co, ag, ak, e, ar, B, cs, oD, av, u, ff, da, mz, dj, I, aC, J, bp, ad, jo, Qt, x, gd, nm, ji, aA); #c1(PRKD1) c2(NP_002733) c3(8947) c4(35061, 48118, 61175, 22004, 74232) c5(bP, aEg, cr, ml, aw, mi, b, bL, fr, Dr, crv, xc, Ip, crz, w, ayY, sF, cO, Fh, crw, U, A, y, oy, cy, LI, kJ, GD, ja, f, bu, Xu, do, cva, ar, B, qw, asa, jG, u, dr, rR, em, asd, gw, V, dA, bK, wo, gj, ft, dt, vc, T, wt, Cl, iy, by, et, aCg, fv, dy, xM, cvb, Nz, Qx, crx, ag, so, fD, fl, di, cry); #c1(PRKD3) c2(XP_005264294) c3(8948) c4(35062, 48119, 61176, 22005, 74233) c5(A, aX, ak, fl, B, kY, ac); #c1(PRKDC) c2(NP_001075109) c3(8949) c4(35063, 48120, 61177, 22006, 74234) c5(Dr, A, b, aPm, eu, w, cvd, D, U, fx, y, co, aX, all, f, F, q, bu, k, cM, cs, zQ, aV, u, iT, g, cvc, V, fl, J, gL, ad, P, T, bp, aZ, fy, jl, cq, by, et, jG, pq, jT, nV, aY, Dj, B, cT, i, dc, re, rb); #c1(PRKG1) c2(NP_001091982) c3(8950) c4(35064, 48121, 61178, 22007, 74235) c5(zr, b, bUa, bRZ, OV, Ip, di, bV, IW, y, ey, Ba, bh, f, q, bu, jF, kz, jT, Bj, n, u, o, fh, bm, hW, Bs, Gd, fl, nu, J, aHh, W, pF, xq, T, BW, aU, cy, by, cve, wl, US, ch, fw, agf, kA, bq, bSc, aA, at, ci, ap); #c1(PRKG2) c2(NP_001269410) c3(8951) c4(35065, 48122, 61179, 22008, 74236) c5(nX, zh, N, ob, HI); #c1(PRKRA) c2(NP_001132989) c3(8952) c4(35066, 48123, 61180, 22009, 74237) c5(nU, cvf, bYF, X, akD, bf, wk, e, d, js, f, ar, cvg, aV, II, AP, aM, Wy, aeq, ch, bcK, fl, bM, kD); #c1(PRKR1R) c2(NP_004696) c3(8953) c4(35067, 48124, 61181, 22010, 74238) c5(X, cO); #c1(PRKX) c2(NP_005035) c3(8954) c4(35068, 48125, 61182, 22011, 74239) c5(jo, aX, dB); #c1(PRLH) c2(NP_056977) c3(8955) c4(35069, 48126, 61183, 22012, 74240) c5(yE, aA, f); #c1(PRL) c2(NP_000939) c3(8956) c4(35070, 48127, 61184, 22013, 74241) c5(dx, B, aw, apS, dd, bMG, cO, coz, cp, vr, bQ, hH, vw, bdT, aVF, bZb, pq, gl, oP, aXy, og, aqQ, aC, du, zU, Jj, jT, HR, dH, wh, yE, dc, hM, aA, wa, avX, X, rd, pX, bZ, kY, OV, VG, U, cM, bBS, pp, f, aoe, DP, av, bm, OT, iF, vR, V, Et, qq, bBW, mD, cK, iA, aAE, cvk, W, pk, aY, iz, cf, HZ, bcK, jd, b, cvh, Ag, bh, Dx, aga, PA, q, ar, aJ, Km, u, o, da, cvi, tg, qL, oJ, cz, pD, US, rQ, cvj, DR, ON, ih, vZ, QU, A, aZk, gn, mW, di, gE, nT, bbz, jw, m, jl, h, avV, avW, blh, yx, Ug, cU, y, kO, PT, aV, dj, cV, Be, J, dt, P, T, nP, Ap, vt, acK, tA, coA, Af, agc, at, eG, ja); #c1(PRLHR) c2(NP_004239) c3(8957) c4(35071, 48128, 61185, 22014, 74242) c5(oy, aA); #c1(PRLR) c2(NP_001191243) c3(8958) c4(35072, 48129, 61186, 22015, 74243) c5(A, b, X, kg, HC, jw, y, oy, Ag, jT, jl, jF, jd, B, avW, q, age, ar, DP, tg, av, aV, u, gl, so, YV, m, avo, cz, ti, T, Jj, Ap, rQ, bm, F, cvl, alB, Af, bh, eG); #c1(PRM1) c2(NP_002752) c3(8959) c4(35073, 48130, 61187, 22016, 74244) c5(ig, NT, aV, am, wn); #c1(PRM2) c2(NP_001273285) c3(8960) c4(35074, 48131, 61188, 22017, 74245) c5(pM, wn, NT, am, pF); #c1(PRM3) c2(NP_067070) c3(8961) c4(35075, 48132, 61189, 22018, 74246) c5(em, agx, il, am, aq, eu, T, ik, jG, u, aE, y); #c1(PRMT1) c2(NP_001527) c3(8962) c4(35076, 48133, 61190, 22019, 74247) c5(ao, co, cy, I, b, IJ, h, J, ad, cU, bk, yM, cs, x, bM, iA, fy, u, y); #c1(PRMT2) c2(NP_001229793) c3(8963) c4(35077, 48134, 61191, 22020, 74248) c5(IJ, cy, yQ, aq, bM, xw, u, y); #c1(PRMT3) c2(NP_001138638) c3(8964) c4(35078, 48135, 61192, 22021, 74249) c5(t, cy); #c1(PRMT5) c2(NP_001034708) c3(8965) c4(35079, 48136, 61193, 22022, 74250) c5(jl, wV, co, cy, b, k, ck, jT, J, bu, wP, cT, w, ar, cB, cO, ji, sf, by, zY, O); #c1(PRMT8) c2(NP_001243465) c3(8966) c4(35080, 48137, 61194, 22023, 74251) c5(ai, at, ao, aj); #c1(PRND) c2(NP_036541) c3(8967) c4(35081, 48138, 61195, 22024, 74252) c5(eJ, k, fr, hT, kp, eo, ft, o); #c1(PRNP) c2(NP_001073592) c3(8968) c4(35082, 48139, 61196, 22025, 74253) c5(dx, en, aN, w, ku, fR, aK, O, dv, cy, kJ, cvp, oP, FJ, bK, nW, du, cva, ft, aax, bLi, cV, oD, aL, ag, xb, bk, zk, aA, aqT, fl, bS, HN, hS, si, U, kV, y, DG, SK, f, bu, aaZ, cc, AQq, cbZ, EX, GS, V, v, kp, wt, Jt, iV, yM, abD, fK, bML, MK, kE, b, abo, ak, Dm, bg, FH, ey, zp, Fp, bb, cvt, NJ, kr, aya, kk, bor, u, dh, o, fh, aaQ, cvs, KL, gL, by, QI, cvm, kS, bdu, ao, kB, hT, aJy, cvo, he, eo, kC, amk, ahe, rv, I, kK, A, MZ, fr, LF, cvu, abr, iL, bj, qZ, aX, sG, el, iZ, kD, aV, aq, aiU, AS, cvn, si, nQ, afx, acX, dt, P, T, II, cvr, alX, ac, eJ, alt, Y, ks, bCb, adb, agw, aT, cvv); #c1(PROC) c2(NP_000303) c3(8969) c4(35083, 48140, 61197, 22026, 74254) c5(dx, YZ, by, B, aw, cuH, dN, gG, dB, eW, YB, bf, VX, fx, xl, BO, cvy, iy, Zc, e, Zj, dl, bgK, R, g, fe, aC, nl, sH, du, EC, bp, gY, Ce, x, YT, Yn, YY, Yp, MS, mF, YV, Yw, DO, tO, ag, cT, i, YA, Yx, YH, X, jj, wy, ig, Yo, iG, IW, bw, U, Oh, y, co, yE, amo, f, LI, bu, cs, av, fy, bm, iT, d, jB, YD, V, jh, Zg, cd, gv, MW, aR, Qt, tj, Yu, YE, YU, W, Fz, py, jR, iA, qh, ap, cvw, bn, Ze, b, aF, jg, Qy, Bh, Og, jC, jy, vn, YN, Mr, yK, cvx, bb, Bc, re, hV, q, jF, ar, Yr, fv, u, aE, wR, Ly, il, qL, Mi, bc, ad, aGn, sZ, YC, et, Yy, Ut, jU, jH, YE, nV, rm, ih, cvz, fl, di, Mp, af, A, fr, aaP, gw, gn, pz, og, hl, C, iL, hP, eb, jx, Zh, MT, aXc, aX, jk, cU, ik, n, cB, Xc, fU, hW, IN, Be, YR, xf, Fs, QV, Ej, dt, T, II, Kv, Oi, Zd, ft, fM, aM, jT, qp, YQ, Zb, YX, zU, fP, YJ, Yv, bh, at); #c1(PROCR) c2(NP_006395) c3(8970) c4(35084, 48141, 61198, 22027, 74255) c5(b, X, aE, qz, iU, mW, eW, oi, bpE, Iv, tG, vp, U, pl, y, m, co, bb, ae, wG, aHW, q, pP, av, u, gl, iP, V, I, be, dt, P, aHX, gA, Vp, rv, bq, aA, at, ap); #c1(PRODH) c2(XP_011528580) c3(8971) c4(35085, 48142, 61199, 22028, 74256) c5(ak, b, dB, hS, aNU, m, ahi, f, ff, cs, fy, hW, hZ, aQw, ad, jo, cvA, afb, jv, to, cz, jN, sc, nU); #c1(PROK2) c2(NP_001119600) c3(8972) c4(35086, 48143, 61200, 22029, 74257) c5(bL, avX, aqu, yD, cO, cA, bf, Jr, rr, ak, bUi, dj, og, UT, cvC, US, aRU, aMW, acK, uH, fP, cvB); #c1(PROKR1) c2(NP_620414) c3(8973) c4(35087, 48144, 61201, 22030, 74258) c5(hq, b, tg); #c1(PROKR2) c2(NP_658986) c3(8974) c4(35088, 48145, 61202, 22031, 74259) c5(avX, b, aqu, aVX, yD, cvE, cA, VG, ak, dQ, tg, bUi, dj, cvD, xq, UT, US, acK, hq, uH, yy, aRU, age); #c1(PROL1) c2(NP_067048) c3(8975) c4(35089, 48146, 61203, 22032, 74260) c5(BO, co, b, jh, bf, aM); #c1(PROM1) c2(NP_001139319) c3(8976) c4(35090, 48147, 61204, 22033, 74261) c5(ml, aw, gG, dB, eW, w, bf, O, e, xl, BO, b, kJ, nv, azu, cl, jg, Fg, n, g, asd, fe, asQ, bK, nW, cvF, wV, fO, ft, x, jE, fy, dS, cvG, DO, ag, cT, bq, cvl, cY, eu, kY, cA, U, y, tp, co, pp, yE, ml, f, cs, bu, gX, B, cvJ, iv, av, nR, bm, is, fi, V, ae, Sa, IR, VP, iA, JY, dP, QG, in, Eo, bkU, T, OG, An, uS, QB, m, oi, gZ, BQ, Mr, d, dl, bb, hV, q, X, ar, ff, jG, u, Mi, ad, IX, G, et, ao, nV, yC, wP, IS, fl, A, iL, jR, fr, pR, xc, qY, jc, nJ, JC, aW, jx, oy, c, aX, Qm, h, cU, rR, cB, p, QJ, fU, nQ, cV, an, J, cvH, W, dU, jo, QI, SF, ji, nP, by, fM, Oi, at); #c1(PROM2) c2(NP_001159449) c3(8977) c4(35091, 48148, 61205, 22034, 74262) c5(bK, Uq, A, B, dB); #c1(PROP1) c2(NP_006252) c3(8978) c4(35092, 48149, 61206, 22035, 74263) c5(iF, bBN, cvK, auK, yD, OW, nc, DH, US, Ry, W, yE, xr, bO, UT, bBW, acK, bHI, aA, biS); #c1(PROS1) c2(NP_000304) c3(8979) c4(35093, 48150, 61207, 22036, 74264) c5(dx, gK, A, aw, b, X, Hk, eu, hS, vY, fl, wY, Fr, JH, Up, dv, bb, cvL, B, WO, ar, y, hb, av, u, CG, wR, da, bc, tg, Mi, sH, du, gL, bqw, fl, T, tj, YT, jU, aei, sh, tO, ih, cvM, cdM, cvz, pN, aR, at, ap); #c1(PROSER1) c2(NP_079414) c3(8980) c4(35094, 48151, 61208, 22037, 74265) c5(jH); #c1(PROX1) c2(XP_011508075) c3(8981) c4(35095, 48152, 61209, 22038, 74266) c5(aw, b, gG, eu, dk, BY, bw, VJ, acL, U, y, d, jh, bb, il, f, q, e, ik, O, VM, cs, u, V, I, cV, gv, W, T, Qt, cr, ad, yG, pS, bm, yC, aoq, ag, qO, bh, aA); #c1(PROZ) c2(NP_001243063) c3(8982) c4(35096, 48153, 61210, 22039, 74267) c5(vq, bb, fD, sH, aaP, cvN, bc, fw, fu, gA, ix, tg, bq, fh, et, dh, ap); #c1(PRPF19) C2(NP_055317) c3(8983) c4(35097, 48154, 61211, 22040, 74268) c5(wU, cy, f, bu, u, y); #c1(PRPF31) c2(XP_006726118) c3(8984)

c4(35098, 48155, 61212, 22041, 74269) c5(d, aw, nQ, ml, nv, e, dt, ea, y, yn, QZ, cvO, nW, aW, alM); #c1(PRPF38B) c2(XP_011539987) c3(8985) c4(35099, 48156, 61213, 22042, 74270) c5(g, awj, awi, b, AX, f, q, bu, T, ar, by, u, y, JY); #c1(PRPF3) c2(XP_011508434) c3(8986) c4(35100, 48157, 61214, 22043, 74271) c5(nQ, ml, cvP, yn, u, nW, y); #c1(PRPF40A) c2(NP_060362) c3(8987) c4(35101, 48158, 61215, 22044, 74272) c5(si, bK, bT, cs, ad, Qx); #c1 (PRPF4B) c2(NP_003904) c3(8988) c4(35102, 48159, 61216, 22045, 74273) c5(b, X, q, bu, T, bWE, av, by, u); #c1(PRPF4) c2(NP_001231855) c3(8989) c4(35103, 48160, 61217, 22046, 74274) c5(b, X, q, yn, av, IV); #c1(PRPF6) c2(NP_036601) c3(8990) c4(35104, 48161, 61218, 22047, 74275) c5(f, bhb, nr, b, ns, nm, nt, nq, yn, nn, no, np, xl, ala, kW, cK, ak, mR, cs, oD, Qx, Yb, nW, bgW, ad, dt, awT, rO, jT, cvQ, axC); #c1(PRPF8) c2(NP_006436) c3(8991) c4(35105, 48162, 61219, 22048, 74276) c5(A, aVR, ml, P, yn, cvR, nW); #c1(PRPH2) c2(NP_000313) c3(8992) c4(35106, 48163, 61220, 22049, 74277) c5(afE, Pa, cvS, ea, cas, yn, GV, aW, amp, ml, nv, vu, bke, nR, Uy, cvT, nQ, nW, cvV, arf, SF, bnU, cvU, bGj, dX, nE, Nx); #c1(PRPH) c2(NP_006253) c3(8993) c4(35107, 48164, 61221, 22050, 74278) c5(cG, Pa, cvU, yn, aW, amp, ml, f, nv, Vr, bke, nR, nQ, cV, nW, arf, SF, ao, Y, Bu, PY, bGj, dX, nE); #c1(PRPS1) c2(NP_002755) c3(8994) c4(35108, 48165, 61222, 22051, 74279) c5(bhn, b, Gl, cvX, cvY, cG, t, aqR, cvZ, G, w, na, vL, dZ, k, dV, Bx, axi, cvW, bCs, ac); #c1(PRPS1L1) c2(NP_787082) c3(8995) c4(35109, 48166, 61223, 22052, 74280) c5(bhn, Gl, I, cG, ac, cO, na, vL, dZ, dV, Bx, bCs, Fg); #c1(PRPS2) c2(NP_001034180) c3(8996) c4(35110, 48167, 61224, 22053, 74281) c5(b); #c1(PRP-SAP1) c2(NP_002757) c3(8997) c4(35111, 48168, 61225, 22054, 74282) c5(ob); #c1(PRPSAP2) c2(NP_001230865) c3(8998) c4(35112, 48169, 61226, 22055, 74283) c5(ob); #c1(PRR11) c2(NP_060774) c3(8999) c4(35113, 48170, 61227, 22056, 74284) c5(co); #c1(PRR13) C2(NP_001005354) c3(9000) c4(35114, 48171, 61228, 22057, 74285) c5(ji, fy, ar); #c1(PRR15) c2(XP_011513501) c3(9001) c4(35115, 48172, 61229, 22058, 74286) c5(V, Qt, bq, U, hR, hP); #c1(PRR16) c2(NP_001287712) c3(9002) c4(35116, 48173, 61230, 22059, 74287) c5(dA); #c1(PRR34) c2(NP_060750) c3(9003) c4(35117, 48174, 61231, 22060, 74288) c5(av); #c1(PRR3) C2(NP_001070965) c3(9004) c4(35118, 48175, 61232, 22061, 74289) c5(m, nl, iu, nj); #c1(PRR5) c2(NP_001017528) c3(9005) c4(35119, 48176, 61233, 22062, 74290) c5(bq, U, u, y); #c1(PRR9) c2(XP_011508108) c3(9006) c4(35120, 48177, 61234, 22063, 74291) c5(da); #c1(PRRC1) c2(NP_001273737) c3(9007) c4(35121, 48178, 61235, 22064, 74292) c5(t, G, at, fl, fP); #c1(PRRC2A) c2(NP_542417) c3(9008) c4(35122, 48179, 61236, 22065, 74293) c5(d, fh, jl, e, bb, ae, jH, aum, ox, aE, m, aC, P, Io, bq, aD, cr, aA, at, jD, ap); #c1(PRRC2C) c2(NP_055987) c3(9009) c4(35123, 48180, 61237, 22066, 74294) c5(bp); #c1(PRRG4) c2(NP_076986) c3(9010) c4(35124, 48181, 61238, 22067, 74295) c5(bj); #c1(PRRT1) c2(NP_085154) c3(9011) c4(35125, 48182, 61239, 22068, 74296) c5(aC, m, aE); #c1(PRRT2) c2(NP_001243372) c3(9012) c4(35126, 48183, 61240, 22069, 74297) c5(B, cwa, DT, vB, eW, w, ayY, cO, e, O, cva, NM, aC, bK, fO, rQ, cV, x, av, ag, cT, axC, X, hS, U, y, bsI, co, cK, f, bu, cs, gg, fy, bm, eG, V, ae, Qt, Fr, akA, Gh, nU, b, akB, jC, ey, azn, d, Fp, yN, vf, q, es, yp, IY, fM, hb, hV, Wy, u, ahe, akp, I, qL, el, j, by, akw, Ny, cwb, nV, hT, bVn, Jh, A, pD, aFe, wf, aX, sG, h, F, aV, ayv, be, J, P, jl, ad, ac, xM, cvb, vW, bM, LQ); #c1(PRRX1) c2(NP_008833) c3(9013) c4(35127, 48184, 61241, 22070, 74298) c5(A, aw, b, cwc, cnz, U, y, co, h, f, M, chJ, jG, fy, aq, o, cnu, V, sX, J, cwd, u, bh, aA); #c1(PRRX2) c2(NP_057391) c3(9014) c4(35128, 48185, 61242, 22071, 74299) c5(A, f, b, ayJ, yC, cwc, PY, B, VM, fy, aq, o); #c1(PRSS12) c2(NP_003610) c3(9015) c4(35129, 48186, 61243, 22072, 74300) c5(cwe, nU, bb); #c1(PRSS16) c2(NP_005856) c3(9016) c4(35130, 48187, 61244, 22073, 74301) c5(iB, pw, aE); #c1(PRSSI) c2(NP_002760) c3(9017) c4(35131, 48188, 61245, 22074, 74302) c5(A, pV, b, gE, aCZ, eH, HC, bn, bw, bf, Mr, aX, or, kJ, wG, f, cwg, ar, aMq, qB, aMj, fv, av, aM, aE, cwf, cs, aMk, ad, dt, T, x, et, by, mm, azh, alH, aKy, OR, ju, ex, ag, agm, bk, oT); #c1(PRSS21) c2(NP_001257381) c3(9018) c4(35132, 48189, 61246, 22075, 74303) c5(mz, I, eu, tF, P, sf, Jm, Hh); #c1(PRSS22) c2(NP_071402) c3(9019) c4(35133, 48190, 61247, 22076, 74304) c5(b, X, q, ad, cs, av, bm, O); #c1(PRSS23) C2(NP_001280107) c3(9020) c4(35134, 48191, 61248, 22077, 74305) c5(aX, aA, u, y, b); #c1(PRSS27) c2(NP_114154) c3(9021) c4(35135, 48192, 61249, 22078, 74306) c5(cj, n, hF, b, aqn, h, bc, zh, J, pJ, pF, pn, nW, kX, aiE, aw, jG, pz, ci, pv); #c1(PRSS2) c2(NP_002761) c3(9022) c4(35136, 48193, 61250, 22079, 74307) c5(A, b, zH, gG, bn, bw, e, d, jh, wG, zB, ar, ju, fH, av, V, aC, T, Fk, X, fJ, azh, rL); #c1(PRSS33) c2(NP_690851) c3(9023) c4(35137, 48194, 61251, 22080, 74308) c5(bEk, Qx); #c1(PRSS35) c2(NP_001163894) c3(9024) c4(35138, 48195, 61252, 22081, 74309) c5(Ns, amS, di, Nq); #c1(PRSS3) c2(NP_001184026) c3(9025) c4(35139, 48196, 61253, 22082, 74310) c5(jh, A, b, wG, rr, ak, vQ, B, EN, ag, lu, i, ju, fy, fH, fx, aV, u, fJ, y, JY); #c1(PRSS50) c2(NP_037402) c3(9026) c4(35140, 48197, 61254, 22083, 74311) c5(Lr, U, u, y, nJ); #c1(PRSS53) C2(NP_001034592) c3(9027) c4(35141, 48198, 61255, 22084, 74312) c5(bj); #c1(PRSS55) c2(NP_001183949) c3(9028) c4(35142, 48199, 61256, 22085, 74313) c5(A, b, asx, cY, dB, oi, DX, cO, Eh, e, y, d, co, aX, pp, Tq, re, B, bu, cU, X, aaZ, O, cs, av, fy, u, dh, iT, mz, cV, aC, be, j, ad, W, jo, bQ, T, fO, iA, by, DG, DR, er, jR, ji, aA, Jh, afd, ap); #c1(PRSS57) c2(NP_999875) c3(9029) c4(35143, 48200, 61257, 22086, 74314) c5(cwh, Pw, Oa, BT, bOx, II, qj, bek); #c1(PRSS58) c2(NP_001001317) c3(9030) c4(35144, 48201, 61258, 22087, 74315) c5(bn, alH, kJ, OR, aMk, aCZ, ct, dt, ag, agm, cwg, bk, aMq, ju, x, aX, aE); #c1(PRSS8) c2(NP_002764) c3(9031) c4(35145, 48202, 61259, 22088, 74316) c5(A, b, X, dB, mk, di, bf, U, Uq, y, f, bu, B, xt, av, iR, Dp, P, T, dq, aM, u, gA, bk, E); #c1(PRTFDC1) c2(NP_001269715) c3(9032) c4(35146, 48203, 61260, 22089, 74317) c5(X, d, e); #c1(PRTG) c2(NP_776175) c3(9033) c4(35147, 48204, 61261, 22090, 74318) c5(yQ); #c1(PRTN3) c2(NP_002768) c3(9034) c4(35148, 48205, 61262, 22091, 74319) c5(bP, bL, id, anY, b, qd, IE, brk, aos, vl, aYA, y, m, bi, iR, zc, h, zH, M, fx, pt, jG, DY, u, fe, aP, i, im, aC, J, Fo, aZ, vM, bJY, jU, jH, Eu, pY, ie, xU, fR, bk, OI, oM, fD); #c1(PRUNE2) c2(NP_056040) c3(9035) c4(35149, 48206, 61263, 22092, 74320) c5(A, aX, b, cV, B, dZ, dV, fM, iK); #c1(PRUNE) c2(NP_001290158) c3(9036) c4(35150, 48207, 61264, 22093, 74321) c5(cV, bu, y, bo, iJ, u, iK); #c1(PRX) c2(NP_066007) c3(9037) c4(35151, 48208, 61265, 22094, 74322) c5(mZ, A, Y, bld, PL, cG, qZ, cwi, B, aZ, ahe, ac); #c1(PRY) c2(XP_011529813) c3(9038) c4(35152, 48209, 61266, 22095, 74323) c5(A, B, am); #c1(PSAP) c2(NP_001035930) c3(9039) c4(35153, 48210, 61267, 22096, 74324) c5(da, Zm, A, b, X, aE, sE, tR, NA, akR, fl, ahK, wX, U, cwl, zf, y, Ba, fq, B, beG, pB, u, cwj, ahG, fs, V, ae, sj, LG, Zr, J, dt, cwk, aAA, Dp, ahJ, aeq, Rj, wz); #c1(PSAT1) c2(NP_066977) c3(9040) c4(35154, 48211, 61268, 22097, 74325) c5(A, aw, b, X, Hk, eu, di, ct, JH, y, bb, B, WO, ar, Up, pN, av, u, da, hb, Mi, cwm, T, II, Fr, jU, dP, sh, ih, fl); #c1(PSCA) c2(NP_005663) c3(9041) c4(35155, 48212, 61269, 22098, 74326) c5(Dr, A, b, gN, ki, bw, hP, e, d, jh, YY, fv, qn, B, jc, bu, ik, ar, kN, ZU, u, R, is, Dd, by, cwn, od, bt, Qt, fx, qH, iR, BY, ag, i, fl, T, af); #c1(PSD3) c2(NP_056125) c3(9042) c4(35156, 48213, 61270, 22099, 74327) c5(d, A, bb, k, X, Ks, xq, ad, w, ik, cs, av, e, O); #c1(PSD4) c2(NP_036587) c3(9043) c4(35157, 48214, 61271, 22100, 74328) c5(yg, dM, aX, b, cV, et, fl, q, w, T, co, i, O, U, u, fx, y, agQ); #c1(PSD) c2(NP_002770) c3(9044) c4(35158, 48215, 61272, 22101, 74329) c5(jH, rQ, hW, V, cz, w, cA, U, KE, O); #c1(PSEN1) c2(XP_011535274) c3(9045) c4(35159, 48216, 61273, 22102, 74330) c5(sE, dB, aN, xb, GF, cO, aK, e, O, b, do, mR, cwo, g, mz, cwr, ee, cwv, aQa, OA, aL, cwu, aaz, aaS, fD, dc, aA, cbU, gk, bS, X, jf, ul, hS, ai, xw, cM, aUg, f, aaZ, av, tQ, em, cwt, v, Wh, cK, tX, acd, aY, aYe, HB, cwp, acX, cws, Dm, bg, fl, gZ, d, bb, avH, avN, q, aya, ar, u, dh, o, I, acW, QI, kS, ao, HN, ih, avn, bL, cwq, k, LF, fw, FE, abr, HS, bj, aW, tF, y, aq, cV, dt, aj, Lc, eB, aaI, aT, cja, vt); #c1(PSEN2) c2(NP_036618) c3(9046) c4(35160, 48217, 61274, 22103, 74331) c5(cbU, sa, gk, ar, bS, b, X, fq, Dm, aN, O, hS, A, di, ak, DI, cO, bf, ai, aK, U, aW, Ne, MT, tX, bn, Qe, f, q, bu, tF, do, iZ, cww, y, bv, mR, av, u, o, g, mz, cV, acW, ft, v, Wh, ee, T, aj, cK, FE, iG, aM, Ew, mD, cwu, fr, aq, B, by, eB, HB, aaS, E, acX, GF); #c1(PSENEN) c2(NP_001268461) c3(9047) c4(35161, 48218, 61275, 22104, 74332) c5(aN, cja, cV, o, cwx); #c1(PSG1) c2(NP_001171754) c3(9048) c4(35162, 48219, 61276, 22105, 74333) c5(aX, V, b, J, we, ag, oi, cI, cy, vl, fy, iu, U); #c1(PSG2) c2(NPJI2536) c3(9049) c4(35163, 48220, 61277, 22106, 74334) c5(by, Qv, aw, b, X, iP, eu, Ty, ji, U, hP, fx, y, d, co, zu, re, e, q, bu, cU, gX, dQ, cI, cB, cs, aoQ, av, ZU, u, iT, V, VD, cV, Dg, bp, ad, W, G, Ce, T, Qt, x, nP, Dd, aoI, JY, fy, dY, ag, YS, i, fl, Oi, ar); #c1(PSG5) c2(NP_001123486) c3(9050) c4(35164, 48221, 61278, 22107, 74335) c5(ami, sH, q, xk, di, Dd, ZU, bm, re); #c1(PSG6) c2(NP_001027020) c3(9051) c4(35165, 48222, 61279, 22108, 74336) c5(Dd, ZU, aoI); #c1(PSG8) c2(NP_001123639) c3(9052) c4(35166, 48223, 61280, 22109, 74337) c5(re, ZU, Dd); #c1(PSG9) c2(NP_001288636) c3(9053) c4(35167, 48224, 61281, 22110, 74338) c5(ct); #c1(PSIP1) c2(NP_001121689) c3(9054) c4(35168, 48225, 61282, 22111, 74339) c5(A, JH, b, X, bYo, aN, iG, bf, cA, Pl, O, aK, y, cy, jh, LS, LI, fq, h, f, N, bu, M, ar, B, iv, bw, kX, av, fy, u, fs, aqQ, ae, cV, bK, cs, J, gL, by, Fy, T, eR, aX, anf, ao, P, jR, ag, zO, aCQ, Xm); #c1(PSKH1) c2(NP_006733) c3(9055) c4(35169, 48226, 61283, 22112, 74340) c5(A, B); #c1(PSMA1) c2(NP_001137409) c3(9056) c4(35170, 48227, 61284, 22113, 74341) c5(b, h, iT, u, re, y, n); #c1(PSMA2) c2(NP_002778) c3(9057) c4(35171, 48228, 61285, 22114, 74342) c5(hR, cp); #c1(PSMA3) c2(NP_002779) c3(9058) c4(35172, 48229, 61286, 22115, 74343) c5(vQ); #c1 (PSMA4) c2(NP_001096137) c3(9059) c4(35173, 48230, 61287, 22116, 74344) c5(Ag, co, bb, b, aC, bp, P, T, Af, Vw, I, bm, bT); #c1(PSMA6) c2(NP_001269161) c3(9060) c4(35174, 48231, 61288, 22117, 74345) c5(dx, b, di, bf, aO, dv, bb, eX, aM, fh, da, I, sj, du, fO, P, jT, dH, dS, xe, fz, bq, at, iu); #c1(PSMA7) c2(NP_002783) c3(9061) c4(35175, 48232, 61289, 22118, 74346) c5(P, U, II, pc, V); #c1 (PSMB10) c2(NP_002792) c3(9062) c4(35176, 48233, 61290, 22119, 74347) c5(DG, b, fO, P, x, u, y); #c1(PSMB1) c2(NP_002784) c3(9063) c4(35177, 48234, 61291, 22120, 74348) c5(aE, ac); #c1(PSMB4) c2(NP_002787) c3(9064) c4(35178, 48235, 61292, 22121, 74349) c5(bb, b, aY, P, cA, O); #c1(PSMB5) c2(NP_001124197) c3(9065) c4(35179, 48236, 61293, 22122, 74350) c5(anb, b, aC, t, px, G, at); #c1(PSMB6) c2(NP_002789) c3(9066) c4(35180, 48237, 61294, 22123, 74351) c5(jJ, aDD, b, bge, dj, EN, ig, bgd, Iv, iL, G, cM, awa, co, aX, t, h, yh, M, ra, n, bgb, iv, jG, pP, bga, aqQ, I, m, aC, cs, dB, J, ad, P, T, cy, jT, RV, bgc, Y, ie, Gk, bcR, ih, cT, pl, aA); #c1(PSMB7) c2(NP_002790) c3(9067) c4(35181, 48238, 61295, 22124, 74352) c5(x, bb, u, ac, y); #c1(PSMB8) c2(NP_004150) c3(9068) c4(35182, 48239, 61296, 22125, 74353) c5(asL, fl, aw, b, Dv, gE, gn, sJ, tB, di, iL, z, al, U, m, cy, bvK, fq, DM, DI, dQ, qB, auD, aV, aE, o, da, ax, il, aC, cs, dB, gL, ad, dt, x, Hh, iU, dH, Zv, bQp, aCP, dY, xe, IO, bQn, iT, fl, Im, iu, re, nl); #c1(PSMB9) c2(NP_002791) c3(9069) c4(35183, 48240, 61297, 22126, 74354) c5(asL, A, b, X, aiW, iU, Zs, fl, di, fH, iL, U, y, rN, m, jT, aX, fq, re, B, dQ, oJ, ar, amq, ZU, u, aE, o, da, Zv, ax, V, ae, aC, be, BC, wh, dB, T, aYz, bq, x, aCP, Dd, fJ, dH, pk, aV, jM, cf, dY, xe, nl, iT, Im, jl, iu, rn); #c1(PSMC1) c2(NP_002793) c3(9070) c4(35184, 48241, 61298, 22127, 74355) c5(aCw, Bu, v, cq); #c1(PSMC2) c2(NP_001191382) c3(9071) c4(35185, 48242, 61299, 22128, 74356) c5(Vw); #c1(PSMC3) c2(NP_002795) c3(9072) c4(35186, 48243, 61300, 22129, 74357) c5(P); #c1(PSMC3IP) c2(NP_001242943) c3(9073) c4(35187, 48244, 61301, 22130, 74358) c5(A, X, wn, cwy, av, Ap, avz, jw); #c1(PSMC4) c2(NP_006494) c3(9074) c4(35188, 48245, 61302, 22131, 74359) c5(f, iy, u, Xu, dB, fl, bj); #c1(PSMC5) c2(NP_001186092) c3(9075) c4(35189, 48246, 61303, 22132, 74360) c5(dx, dv, cV, du, P, zO, u); #c1(PSMC6) c2(NP_002797) c3(9076) c4(35190, 48247, 61304, 22133, 74361) c5(wV, A, aJ, b, ck, B, eu, wP, P, kz, yM, VT, kV); #c1(PSMD10) c2(NP_002805) c3(9077) c4(35191, 48248, 61305, 22134, 74362) c5(b, gG, jz, iL, bf, U, e, y, jQ, d, f, q, bu, cU, Mr, bm, aoc, V, il, qL, gm, W, T, iA, aM, jE, u, Bu, nJ, ag); #c1(PSMD12) c2(NP_002807) c3(9078) c4(35192, 48249, 61306, 22135, 74363) c5(ae, aC, h, P, xU, sJ, aE, al, anf); #c1(PSMD13) c2(NP_002808) c3(9079) c4(35193, 48250, 61307, 22136, 74364) c5(P, II); #c1(PSMD14) c2(NP_005796) c3(9080) c4(35194, 48251, 61308, 22137, 74365) c5(aC, at); #c1(PSMD1) c2(NP_001177966) c3(9081) c4(35195, 48252, 61309, 22138, 74366) c5(d, b, v, u, e, y); #c1(PSMD2) c2(NP_001265638) c3(9082) c4(35196, 48253, 61310, 22139, 74367) c5(bS, b, alV, w, iL, co, aX, h, f, q, ar, n, oD, aV, jZ, o, cj, v, KL, T, J, ao, ci, iT, re); #c1(PSMD3) c2(NP_002800) c3(9083) c4(35197, 48254, 61311, 22140, 74368) c5(oM, P, pt); #c1(PSMD4) c2(NP_002801) c3(9084) c4(35198, 48255, 61312, 22141, 74369) c5(en, b, Ik, Ip, e, y, d, re, jo, kz, ff, jG, fy, u, iT, cV, bp, cz, ME, Il, oH, aV, Eu, ahu); #c1(PSMDG) c2(NP_001258708) c3(9085) c4(35199, 48256, 61313, 22142, 74370) c5(aX, I, DO, P, bb, u, y); #c1(PSMD7) c2(NP_002802) c3(9086) c4(35200, 48257, 61314, 22143, 74371) c5(A, JH, U, m, cy, fq, B, dQ, aD, HE, aV, aE, da, V, ae, aC, P, aX, fc, aeS, aeR, fP); #c1(PSMD8) c2(NP_002803) c3(9087) c4(35201, 48258, 61315, 22144, 74372) c5(iP, v, P, iL, aA, u, y); #c1(PSMD9) c2(NP_002804) c3(9088) c4(35202, 48259, 61316, 22145, 74373) c5(dx, ak, aw, dD, gG, dB, w, bf, e, O, yg, dv, iy, n, og, du, gm, fO, gY, fx, jT, wh, yE, cT, i, dc, aA, bT, X, iP, jz, Ku, iG, U, cM, co, ag, f, N, bu, B, cs, av, fy, bm, iT, iF, jB, V, qq, Qz, ad, aEw, Hh, zf, d, aY, dY, b, hh, jh, apI, re, hV, q, OC, jG, u, o, I, by, nd, et, aoO, nV, ih, fg, bL, A, k, EN, di, jR, iL, jw, jQ, aX, h, F, cU, y, cB, cV, J, W, P, T, Ap, fM, aM, Ic, E, Oi, at); #c1(PSME1) c2(NP_006254) c3(9089) c4(35203, 48260, 61317, 22146, 74374) c5(Ag, DG, jh, X, P, T, Af, x); #c1(PSME2) c2(NP_002809) c3(9090) c4(35204, 48261, 61318, 22147, 74375) c5(jh, b, fO, bu, P, ar, x, JY); #c1(PSME3) c2(NP_001253974) c3(9091) c4(35205, 48262, 61319, 22148, 74376) c5(m, fl, b, fN, q, nJ, P, mW, gE, fy, dL, gl, cq); #c1(PSME4) c2(NP_055429) c3(9092) c4(35206, 48263, 61320, 22149, 74377) c5(P); #c1(PSMF1) c2(NP_848693) c3(9093) c4(35207, 48264, 61321, 22150, 74378) c5(bb); #c1(PSMG1) c2(NP_003711) c3(9094) c4(35208, 48265, 61322, 22151, 74379) c5(B, Ey, A, ak, O, co, kJ, qc, f, cB, iv, av, hW, cV, Fs, fO, Fr, jH, qp, sG, fP, vt); #c1(PSMG2) c2(NP_064617) c3(9095) c4(35209, 48266, 61323, 22152, 74380) c5(m, f, n, fl, bm, aE); #c1(PSMG3) c2(XP_011513881) c3(9096) c4(35210, 48267, 61324, 22153, 74381) c5(WG, bjn); #c1(PSORS1C1) c2(NP_054787) c3(9097) c4(35211, 48268, 61325, 22154, 74382) c5(da, m, yi, ht, ox, j, xe, ix, Bm, Io, aV, jD, uO); #c1(PSORS1C2) c2(NP_054788) c3(9098) c4(35212, 48269, 61326, 22155, 74383) c5(da, m, JH, b, fO, ix, u, y); #c1(PSPC1) C2(XP_006719907) c3(9099) c4(35213, 48270, 61327, 22156, 74384) c5(acE); #c1(PSPH) c2(XP_011513763) c3(9100) c4(35214, 48271, 61328, 22157, 74385) c5(acE, bn, kJ, B, A, sc, cub, cwz); #c1 (PSPN) c2(NP_004149) c3(9101) c4(35215, 48272, 61329, 22158, 74386) c5(acE, bn, kJ, bxC, ak, ahS, fw, ahO, B, A); #c1(PSTPIP1) c2(NP_003969) c3(9102) c4(35216, 48273, 61330, 22159, 74387) c5(ax, bQO, aC, iV, xe, eE, ix, ew, Om, rp, fP, dH); #c1(PSTPIP2) c2(NP_077748) c3(9103) c4(35217, 48274, 61331, 22160, 74388) c5(cal, fl, azp); #c1(PTBP1) c2(NP_002810) c3(9104) c4(35218, 48275, 61332, 22161, 74389) c5(en, aw, iU, aHc, w, e, O, cy, kz, mR, aoh, g, aC, bK, nz, cs, dB, jT, xx, jE, ag, X, wy, hS, brZ, kY, bw, ai, y, ed, co, f, bu, B, iv, Tk, oD, av, fy, bm, ae, v, cz, b, AA, jy, d, Ag, nU, q, es, u, o, sz, el, gL, by, rO, an, KK, fl, QP, QU, A, SS, iL, gE, bj, m, aX, aEz, Vr, QJ, fU, si, cV, Ua, J, dt, P, T, j, aj, aro, ad, fM, Jh, Af); #c1(PTBP2) c2(NP_001287914) c3(9105) c4(35219, 48276, 61333, 22162, 74390) c5(acE, qf, aw, cV, X, f, HN, iU, O, bxC, P, o, gE, av, cwA, u, y, aoh); #c1(PTCD1) c2(NP_056360) c3(9106) c4(35220, 48277, 61334, 22163, 74391) c5(oy); #c1(PTCH1) c2(NP_000255) c3(9107) c4(35221, 48278, 61335, 22164, 74392) c5(aw, bLe, dB, w, PM, bkJ, iq, adr, e, O, cwD, kJ, aze, aui, cl, g, fe, asQ, aeM, jt, Dt, aow, fO, fy, fx, wh, xO, Lz, aai, Yw, cwB, ag, cT, FN, i, bsZ, Dr, cmo, sm, X, jj, kB, iG, ate, bw, U, azq, y, yV, aAH, cwG, f, bu, av, DF, bm, QD, aal, jB, Bd, V, dA, auw, YU, QG, jR, og, tl, b, QB, A, ic, ey, d, hV, q, es, ND, ra, ar, ff, fv, u, cwE, VD, by, aZ, ct, aCq, nV, iR, aCp, Dj, Ns, yA, ye, Qv, eZ, gw, cwG, alm, dl, aX, Bi, F, aBd, gT, Gs, oJ, aCr, aq, cV, Be, J, bDh, W, P, T, nP, AP, Xw, aAu, LY, Nq, cwF, amS, E, eG); #c1(PTCHD1) c2(NP_775766) c3(9108) c4(35222, 48279, 61336, 22165, 74393) c5(Wk, nz, nU, rQ, cz); #c1 (PTCHD4) c2(NP_001013754) c3(9109) c4(35223, 48280, 61337, 22166, 74394) c5(Eo); #c1(PTCRA) c2(NP_001230098) c3(9110) c4(35224, 48281, 61338, 22167, 74395) c5(kF, vg, B, gL, mk, vc, xb, Iv, tG, eN, apT, aE); #c1(PTDSS1) c2(NP_001277154) c3(9111) c4(35225, 48282, 61339, 22168, 74396) c5(bm, aV, iu, q, cwH); #c1(PTEN) c2(NP_000305) c3(9112) c4(35226, 48283, 61340, 22169, 74397) c5(ml, aHH, EM, dB, Ip, aoK, e, vr, bWO, kJ, dl, wS, mR, cl, fe, aC, aow, ft, pq, aHi, jE, qN, DO, ag, cwO, aA, cwN, Dr, em, X, eu, Dj, iG, bw, xl, Oh, hg, av, fy, fi, V, ae, ze, jC, ahT, Ih, gR, ji, aG, ck, GL, jy, aul, hh, jh, Bc, oB, aua, dh, fs, il, Mi, bc, ad, QI, cwQ, aeC, wV, nV, Yg, aiJ, yA, af, Iv, QU, cwJ, fr, pR, aMP, vZ, iL, jw, jQ, bkK, oJ, m, an, be, J, jo, Pk, mb, Ic, asx, beJ, E, rb, amF, HG, Ty, qP, bf, bNG, Up, yg, bQ, yh, FN, cwP, IV, zW, pb, og, gm, bp, Ce, x, fp, wh, aQT, mD, ib, fl, QF, Hk, afY, oH, mk, kY, Iw, U, co, F, f, bu, iJ, Bs, cwR, ny, bq, pJ, QG, Le, ajF, MS, oR, z, d, QO, jd, aBG, q, ra, RF, hb, hV, iR, ff, Nb, Xu, bZh, sf, aZ, ct, rQ, xU, k, FE, JC, zY, iK, Px, LI, cB, LR, hW, Fs, dT, dt, T, js, cwS, Qn, aw, iD, dN, QA, iy, g, bK, Qf, po, fO, fx, HR, aDJ, YA, cT, yJ, cY, fE, Qg, jz, awm, bW, px, pp, B, LI, gX, O, ccM, bBw, iT, aEq, SA, bkl, afn, Qz, Fr, iA, JY, aJX, aum, nJ, b, jq, Ne, SI, apG, re, nU, OC, gh, cwl, ahF, cz, Lt, cW, hT, BY, Bg, ahm, bUq, IO, gw, jl, Lu, in, Ct, jx, Tq, bj, Bi, cU, ik, ZU, Be, W, sq, AP, fM, aM, aHE, oW, NG, adu, Yv, Ez, eG, iq, gG, w, cO, cwK, cy, t, do, R, pN, zU, od, aZn, ca, jT, dL, mO, oQ, fN, agm, i, cwT, oX, wy, hS, ma, y, aKF, cs, bm, iF, Bd, YV, pr, Jc, auw, VP, aec, qW, aoy, iY, jR, fG, cwM, Kl, qO, An, QB, anb, ic, oZ, aO, aJB, apB, ar, VM, jG, u, I, by, as, G, boB, Ca, aAB, KK, wP, oY, I, bL, A, aov, Lv, qQ, di, hP, MT, aX, h, anM, F, M, Dd, fU, cV, cfx, P, gF, aKM, Oi, cwL, vt); #c1(PTER) c2(NP_001248766) c3(9113) c4(35227, 48284, 61341, 22170, 74398) c5(bP, aX, V, I, eG, fD, z, U, bm, aA); #c1(PTF1A) c2(NP_835455) c3(9114) c4(35228, 48285, 61342, 22171, 74399) c5(atn, cwU, kJ, Nw, mB, axr, ag, fv, cpF); #c1(PTGDR2) c2(NP_004769) c3(9115) c4(35229, 48286, 61343, 22172, 74400) c5(aw, bx, DT, NH, U, JN, Xy, aCU, fq, uB, aD, Hs, V, TK, ti, vM, cy, jT, dP, NG, gd, pH); #c1(PTGDR) c2(XP_005267948) c3(9116) c4(35230, 48287, 61344, 22173, 74401) c5(d, cy, cV, wG, q, ti, aN, cwV, fw, fq, aD, et, av, jT, bp, e, o); #c1(PTGDS) c2(NP_000945) c3(9117) c4(35231, 48288, 61345, 22174, 74402) c5(dx, da, hV, iq, jT, b, bx, X, sd, EM, Vz, aN, qP, cwW, ak, cwX, bf, U, aNa, A, vl, y, V, bLd, dv, aX, I, aCU, jd, fq, f, Pn, AK, eE, k, B, cs, aD, asQ, av, Hs, u, o, g, nV, yV, VD, an, du, ad, as, ti, T, bt, Qt, cy, gF, Pk, jU, aM, jH, Al, dO, akn, iu, ag, jR, yy, alo, w, bBL, fD, Bx, gd, ph, na, rZ); #c1(PTGER1) c2(NP_000946) c3(9118) c4(35232, 48289, 61346, 22175, 74403) c5(kB, di, e, d, Ag, bb, q, ar, cs, av, o, qL, sH, bp, ad, ee, cy, aqw, fw, tO, eB, Af); #c1(PTGER2) c2(NP_000947) c3(9119) c4(35233, 48290, 61347, 22176, 74404) c5(A, vg, b, X, EB, mk, tG, baB, U, aO, cwZ, cy, B, bu, cwY, ar, fy, u, sH, o, RG, xc, V, cV, aC, TK, gL, by, W, vc, T, bp, bq, ao, agl, py, Ic, tO, fl, Oi, at, eG, ap); #c1(PTGER3) c2(XP_011540111) c3(9120) c4(35234, 48291, 61348, 22177, 74405) c5(A, tG, b, k, mk, vg, yi, gM, cy, f, bu, ar, B, cs, av, bm, o, aNY, kF, sH, gL, ad, vc, ct, by, aRS, jE, Eu, tO); #c1(PTGER4) c2(NP_000949) c3(9121) c4(35235, 48292, 61349, 22178, 74406) c5(dx, AK, by, A, b, dB, di, bW, U, bu, aO, aTX, cy, hm, Bc, re, B, q, uB, yp, ar, y, cs, NB, aV, u, aE, ri, RG, o, nl, V, I, cV, aC, sH, du, gm, bp, J, W, Fe, ti, T, ad, jH, jT, fy, py, DR, iT, tO, ag, xr, fP, pZ, fl, Oi, at, eG, aRf, gl); #c1(PTGES2) c2(NP_079348) c3(9122) c4(35236, 48293, 61350, 22179, 74407) c5(mz, b, nV, pw, V, I, awz, B, eX, A, ar, aA, vl, gE, U, av, o); #c1(PTGES3) c2(NP_006592) c3(9123) c4(35237, 48294, 61351, 22180, 74408) c5(A, cy, alY, b, fs, Pv, f, v, bu, alW, ar, B, cB, avb, alX, by, u, vl, aW, gl); #c1(PTGES) c2(NP_004869) c3(9124) c4(35238, 48295, 61352, 22181, 74409) c5(by, f, vg, b, k, X, gG, eu, atK, Ip, mk, A, di, C, tG, eO, bW, U, vl, y, d, jh, jT, bb, awz, DB, F, q, bu, yp, ik, B, cs, ar, fy, u, dh, o, fh, ma, V, aC, atr, v, gL, gm, W, vc, zU, T, bp, bq, gC, ad, JY, ao, vz, py, iR, xU, e, fP, O, Mp, eG, gl); #c1(PTGIR) c2(NP_000951) C3(9125) c4(35239, 48296, 61353, 22182, 74410) c5(dx, bL, dv, cy, TK, du, AK, aR, hR, o, ap); #c1(PTGIS) c2(NP_000952) c3(9126) c4(35240, 48297, 61354, 22183, 74411) c5(dx, uS, di, nl, IW, bf, U, e, y, d, qs, co, bb, DM, eX, AK, ar, cs, av, fy, u, dh, o, fh, og, V, du, bp, ad, W, IX, dv, xd, bh, ac, aM, IR, Y, aei, fw, IS, fD, bq, zS, ap); #c1(PTGR1) c2(NP_001139581) c3(9127) c4(35241, 48298, 61355, 22184, 74412) c5(ar, co, bm, q, iG); #c1 (PTGS1) c2(NP_000953) c3(9128) c4(35242, 48299, 61356, 22185, 74413) c5(dx, en, aw, bx, dB, eH, W, CO, bf, aWk, e, gM, dv, cy, wv, dl, gl, R, xc, aC, sH, du, fO, bp, vc, x, fx, Yp, akn, LR, Ox, tO, aeR, ag, bk, i, dc, bq, Kt, aPm, X, mk, IW, U, cM, V, co, BL, ip, f, bu, B, cs, bv, av, fy, MG, iT, ali, rN, kp, acU, eX, bt, qH, aen, py, aY, xe, uK, apG, tl, cxb, II, ake, tr, b, zH, Pv, MS, cxa, tG, fD, aO, d, cqL, bb, eA, MX, re, jV, OC, ar, jG, u, o, fh, BT, sC, gL, ad, mW, aZ, sD, ct, jH, ch, eQ, gd, LA, SS, Ik, gN, di, vg, hP, m, S, F, M, ik, y, tK, ma, be, J, W, aNx, ti, T, aox, jl, nP, Pk, ac, aM, eJ, at, fP, Oi, ap, gl); #c1(PTGS2) c2(NP_000954) c3(9129) c4(35243, 48300, 61357, 22186, 74414) c5(en, dB, vB, Ip, baB, Ir, e, vr, aDo, akv, nZ, dl, gP, xl, TP, xc, fe, aC, ft, pb, jE, vz, DO, tO, ag, bkQ, bk, fD, acM, bq, aA, aKj, Dr, X, vD, ali, dV, iG, bw, vl, Oh, cM, sr, eX, aqU, Mp, av, fy, is, fi, vR, NW, ae, aNt, kp, afz, bGq, J, f J, aY, xe, cuB, HB, ji, aG, ck, tV, dk, pi, jh, gf, Bc, yp, fv, oO, dh, bQX, il, gL, ad, aeC, uf, ao, nV, agQ, aFa, en, aU, yA, rj, fr, gN, jc, vZ, C, iL, gE, m, IE, ajn, awz, wG, Uq, rR, gB, ev, aPI, be, bd, bR, zX, mb, fP, Af, E, gl, dx, sd, YB, bf, aK, O, RR, yg, azb, AX, DB, yh, oJ, og, aeM, du, gm, bp, Jk, Ce, x, Yp, wh, gs, Vb, sN, bT, sU, He, ie, iP, atd, mk, cA, U, co, BL, f, bu, dZ, iJ, pH, Bs, gv, ny, Qt, qH, aH, aen, akO, Le, jd, tl, Mo, Pv, MS, z, vn, d, bb, eA, MX, PA, q, ra, ff, hb, ar, TW, iR, o, fh, YL, qL, at, LR, aDv, aZ, et, cqZ, jU, jH, Eu, ch, NG, gd, fl, Xm, Jh, gU, Ik, eO, al, iK, bmO, bn, Hx, aq, BT, ez, sB, Fs, aZI, T, II, nk, DI, j, DM, aw, dN, DT, Eh, iq, adr, Rh, fH, g, bK, Xc, fO, vc, fx, akn, cT, dX, crO, EO, QD, kM, Al, cY, kB, NH, bW, V, tp, pp, hm, ml, B, LI, aWk, gX, k, bv, oD, gg, iT, aEq, SA, GI, rN, aZz, v, BV, Js, Hq, cd, bt, Fr, iA, JY, in, b, aF, aw, bg, au, cxa, tG, wZ, apG, re, hV, OC, vu, atr, cz, Fo, et, aJA, DR, cX, IO, mW, qi, fw, vg, wf, Qm, sG, bj, Bi, gT, cU, iZ, ik, aE, Be, W, QI, jl, nP, aM, eJ, agl, Y, avB, YJ, Ez, ciu, ap, eG, gK, pV, zw, Ob, bx, gG, aN, sJ, w, cO, M, dv, cy, t, Si, wv, aoE, jq, acy, gl, R, cB, aBE, sH, Lz, jT, BX, fN, Yw, Ox, os, i, dc, cl, td, Kt, jf, aFd, ma, IW, y, jb, ed, MI, ip, UV, vQ, cs, kN, bm, iF, Bd, acU, Ih, cxc, VP, cK, pi, qW, py, jR, Im, An, ic, ey, eV, aO, bX, jV, dQ, jG, u, nj, PJ, aDu, I, TK, hv, by, BZ, aAB, yG, aJJ, eQ, gC, ih, dn, I, azt, bL, A, Lv, ot, BY, di, Oy, hP, yw, MT, aX, kn, fq, h, F, qr, az, aV, jZ, fU, si, cV, hZ, GB, P, IC, aox, bh, pw, aAx, axx, IN, Oi, oT, LQ, rZ); #c1(PTH1R) c2(NP_000307) c3(9130) c4(35244, 48301, 61358, 22187, 74415) c5(bP, b, fr, ia, dB, kB, exh, D, bw, y, cp, t, It, as, u, o, wR, vR, fD, ft, gL, cxe, dt, T, aZ, x, azo, cxd, qW, nV, ym, ID, exf, arA, ahl, cxg); #c1(PTH2) c2(NP_848544) c3(9131) c4(35245, 48302, 61359, 22188, 74416) c5(fU); #c1(PTH2R) c2(NP_005039) c3(9132) c4(35246, 48303, 61360, 22189, 74417) c5(aDY, aDX, bb, cp); #c1(PTH) c2(NP_000306) c3(9133) c4(35247, 48304, 61361, 22190, 74418) c5(B, zw, dN, cpl, eH, HC, Pf, adt, cO, bf, pz, gO, bQ, b, aAX, t, nZ, cl, D, nB, fH, si, Qx, fe, VA, gJ, azo, rQ, exj, x, Jw, aAP, pq, bDX, bBX, yB, EZ, ym, aTZ, LO, ag, aLq, i, arz, pO, ih, bP, xN, sm, jz, NF, cxm, hW, y, co, pw, pp, f, cs, mm, cp, bm, yK, em, vR, Gl, fD, qq, gv, dv, aJV, fJ, aAE, W, YR, nc, afd, ahl, ap, xm, ia, yU, aMh, gF, Km, bsL, nU, q, bRN, jF, bos, TW, cxk, u, aE, o, wR, kF, I, Fb, bsO, arq, uw, agi, et, jG, nV, aYZ, hS, aAV, arA, I, di, adq, QU, A, Pb, sO, fr, zF, cxn, rU, AQ, lv, pu, AO, jQ, qs, h, xJ, avW, yx, It, Pm, p, aAS, HP, amL, fU, cxi, bsX, adh, arx, dt, T, bkj, nP, ft, cxd, aM, cxo, qp, ii, ID, TU, LC, AR, zM, adi, Yv, bh, at, amK, cxl); #c1(PTHLH) c2(NP_945315) c3(9134) c4(35248, 48305, 61362, 22191, 74419) c5(dx, B, awh, dB, HC, sJ, cO, bf, eD, e, O, cp, dv, va, tE, ju, aHN, aC, p, du, fO, asM, bp, azo, cxr, x, cpH, jT, wh, aPc, EZ, ym, rS, TX, xr, fD, mD, afd, hP, mZ, fl, X, jz, wy, NF, kB, dV, bw, U, y, co, ag, pz, Dq, f, dZ, ky, cs, av, fy, fi, GS, V, cJ, VP, Fr, fv, EE, dt, jo, ji, bn, b, exp, yU, d, zJ, jd, q, zx, bRN, jF, ar, ff, Xp, as, HE, jG, Tv, u, pR, cl, qW, qL, Fb, gL, ad, aZ, uw, agi, cW, eQ, hT, sj, xf, cxq, A, IO, k, fr, zF, cxn, rU, D, C, yw, jQ, aX, Tq, lv, wG, xJ, M, It, oJ, bK, QI, fU, cV, YR, KU, J, W, bel, T, II, ft, cxd, aM, exo, qp, exs, ID, mb, zM, zp, Yv, Nu); #c1(PTK2B) c2(NP_775267) c3(9135) c4(35249, 48306, 61363, 22192, 74420) c5(f, aw, dN, dB, w, cO, bf, e, O, cp, kJ, aHN, eg, aC, zv, iv, gm, bp, ca, buh, ag, i, anY, jz, eu, fU, y, co, ak, gX, B, qY, fy, bm, iF, Gl, jR, ji, aDX, b, aF, dk, yU, ic, QT, ey, d, q, jV, ar, jG, u, Qq, fh, Qo, I, pF, ew, et, ao, pS, iR, bL, A, IO, mz, ahV, di, iL, gE, jQ, qs, aX, h, F, ma, cV, be, J, aDY, P, fO, asn, ac, aM, bfX, fx, MU); #c1(PTK2) c2(NP_001186578) c3(9136) c4(35250, 48307, 61364, 22193, 74421) c5(gK, by, f, aw, iD, b, k, X, gG, dB, w, id, iL, O, e, U, bu, A, ra, y, jx, d, ed, MT, co, aX, Ob, fv, jd, pz, DH, F, q, es, fr, ik, B, cs, ar, av, aV, u, dh, wR, yJ, ma, V, cV, aC, LR, BC, bp, ad, W, P, T, fO, aZ, ji, x, ft, et, jG, yG, en, nV, bm, QJ, m, cT, Af, di, BW); #c1(PTK6) c2(NP_001243287) c3(9137) c4(35251, 48308, 61365, 22194, 74422) c5(d, jh, A, ar, b, ag, X, avg, B, ad, qL, T, cs, x, Fr, av, jT, u, e, y); #c1(PTK7) c2(NP_001257327) c3(9138) c4(35252, 48309, 61366, 22195, 74423) c5(ji, co, aX, b, cY, h, wX, J, tR, ad, ih, Gs, Mr, cs, ar, fy, u, fs, y); #c1(PTMA) C2(NP_001092755) c3(9139) c4(35253, 48310, 61367, 22196, 74424) c5(A, b, U, y, B, ar, cl, u, xc, V, cV, aC, bp, W, P, T, fO, fx, JY, fN, Nz, xU, i); #c1(PTMS) c2(NP_002815) c3(9140) c4(35254, 48311, 61368, 22197, 74425) c5(o); #c1(PTN) c2(XP_005250572) C3(9141) c4(35255, 48312, 61369, 22198, 74426) c5(dx, beO, A, zw, b, PC, afY, jj, LM, od, w, cO, bw, y, cp, Ag, fe, co, aX, re, B, PR, iT, ar, O, PE, fy, u, ajz, cc, g, fU, V, dA, aC, du, bp, P, dv, T, fO, PD, k, jT, beQ, cV, agb, m, Af, tl, bh, at, eG); #c1(PTOV1) C2(NP_059128) c3(9142) c4(35256, 48313, 61370, 22199, 74427) c5(A, B, bu, afD, Ex, ar, T, di); #c1(PTP4A1) c2(XP_011534414) C3(9143) c4(35257, 48314, 61371, 22200, 74428) c5(d, BO, co, b, jh, X, gm, fl, ar, u, e, y); #c1(PTP4A3) c2(XP_005250824) c3(9144) c4(35258, 48315, 61372, 22201, 74429) c5(aw, b, cY, iL, U, e, y, d, jh, co, aX, h, q, bu, X, ar, O, cs, jG, u, V, cV, J, bp, ad, dU, T, fO, x, jC, by, pb); #c1(PTPMT1) c2(NP_001137456) c3(9145) c4(35259, 48316, 61373, 22202, 74430) c5(b, cV); #c1(PTPN11) c2(NP_002825) c3(9146) c4(35260, 48317, 61374, 22203, 74431) c5(ml, aGV, EM, aiW, w, e, O, azp, zi, cy, t, AX, cl, fH, cdS, cs, gm, hR, cxv, iz, pb, ie, ag, mx, aC, aA, auB, aNk, jB, aFd, kY, bw, VJ, y, co, rY, RD, DM, f, N, xr, bu, Be, iv, bv, fg, kN, fy, iT, SA, ze, NZ, Wh, IR, pJ, bt, auw, cK, ael, en, akO, dY, ap, b, jL, z, blU, d, aDV, re, aua, q, AK, apB, dQ, cxu, atT, ar, jG, u, aE, kP, bEg, qL, Um, gL, ad, IX, G, Mw, jU, jH, aNI, rQ, acw, cC, na, IS, cxx, ckq, k, gN, gE, aux, Bz, cr, or, cxw, h, cjv, n, nQ, cV, an, fJ, be, Dw, J, W, P, T, II, aX, by, AP, sK, jT, Ic, UE, bpb, fP, eN, ext, as); #c1(PTPN12) c2(NP_001124480) c3(9147) c4(35261, 48318, 61375, 22204, 74432) c5(jh, pk, A, aw, b, iu, f, q, J, T, kY, cs, ad, u, nj, y); #c1(PTPN13) c2(NP_006255) c3(9148) c4(35262, 48319, 61376, 22205, 74433) c5(A, b, cxy, jz, U, bu, aK, e, y, jQ, d, m, co, ip, wP, B, F, q, es, ik, KL, cs, QJ, u, ov, fi, jB, si, V, ajc, v, bp, J, sf, T, ad, k, ac, wV, fy, nb, amj, ag, Lo, cxz); #c1(PTPN14) c2(NP_005392) c3(9149) c4(35263, 48320, 61377, 22206, 74434) c5(V, b, q, bu, cxA, cxB, U, VJ); #c1(PTPN18) c2(NP_001135842) c3(9150) c4(35264, 48321, 61378, 22207, 74435) c5(u, fM, y); #c1(PTPN1) c2(NP_001265547) C3(9151) c4(35265, 48322, 61379, 22208, 74436) c5(dx, by, A, td, b, mz, X, gN, rd, add, di, bf, wf, aw, U, fD, y, jx, jh, qs, dv, jl, or, pp, h, f, q, bu, B, cs, kO, fH, av, sK, u, aE, o, em, V, I, bWu, du, blU, cx, j, gm, zi, eX, aZ, x, gF, ad, jG, aM, jT, Lc, wp, bm, Jh, bKt, f J, tl, Hd, I, O, aA, at); #c1(PTPN21) c2(XP_011534669) c3(9152) c4(35266, 48323, 61380, 22209, 74437) c5(iu, b); #c1(PTPN22) c2(XP_011539526) c3(9153) c4(35267, 48324, 61381, 22210, 74438) c5(dx, pV, dN, sE, iU, hM, JH, eD, dv, gC, eE, cl, aD, iz, gl, Fx, aC, du, gY, vc, vM, dH, xO, Lz, axA, cT, agS, bT, asL, fl, gE, ig, ix, bf, y, Ei, BL, f, Em, UM, yV, yY, nl, wA, pi, pk, anB, xe, oj, iu, ap, b, zH, qz, atU, tG, IS, aYA, HQ, bb, zc, qd, q, zm, yW, u, nj, o, da, PJ, Jo, I, im, gL, IJ, ew, et, jU, jH, mk, fD, aos, iq, aE, El, Bm, Pp, A, gU, Ik, gn, mW, IE, di, vg, eM, Pl, aW, m, aX, wp, Pm, qB, aV, ax, bzH, be, P, j, pw, aM, ce, ii, apT, MP, fP, iB, at, eG); #c1(PTPN23) C2(NP_001291411) c3(9154) c4(35268, 48325, 61382, 22211, 74439) c5(P, u, y, wy); #c1(PTPN2) c2(NP_001193942) c3(9155) c4(35269, 48326, 61383, 22212, 74440) c5(gz, b, adJ, ig, w, Iv, kY, bf, y, m, yX, rr, eX, aC, jG, dH, u, aE, yd, ax, I, aMH, be, J, dt, jT, jU, iz, jH, IE, fP, aM); #c1(PTPN3) c2(NP_001138840) c3(9156) c4(35270, 48327, 61384, 22213, 74441) c5(gG, aw, b, cV, bm, f, ate, q, ad, Mr, YU, iL, cs, fy, u, y); #c1(PTPN4) c2(NP_002821) c3(9157) c4(35271, 48328, 61385, 22214, 74442) c5(jK, rQ, q, J, jG, pz); #c1(PTPN5) c2(NP_001265165) c3(9158) c4(35272, 48329, 61386, 22215, 74443) c5(ak, cV, X, f, P, HS, cA, av, yG); #c1(PTPN6) c2(NP_002822) c3(9159) c4(35273, 48330, 61387, 22216, 74444) c5(by, A, pF, b, vd, X, zh, cs, jz, pD, mk, adJ, rp, Iv, pK, O, bf, U, G, gF, y, jQ, d, m, jT, cy, bvK, t, h, f, N, q, bu, fr, k, B, JF, av, aV, u, dh, o, n, da, V, mm, ft, iv, cxC, fO, gm, dt, IJ, jG, T, p J, Hh, J, ad, oh, aA, aM, fy, oQ, pS, fc, aOS, pq, P, fG, e, cT, fq, zO, fq, ael, Nu, ja); #c1(PTPN7) c2(NP_001186726) c3(9160) c4(35274, 48331, 61388, 22217, 74445) c5(A, b, hX, f, B, pc); #c1 (PTPN9) c2(NP_002824) c3(9161) c4(35275, 48332, 61389, 22218, 74446) c5(ey, u, I, y, pF); #c1(PTPRA) c2(NP_002827) c3(9162) c4(35276, 48333, 61390, 22219, 74447) c5(b, jz, eH, Iv, vl, y, jQ, co, t, h, f, bu, cU, iv, av, aV, u, dh, o, I, cV, cs, J, fO, xs, G, T, fy, hX, QP, bq, at); #c1(PTPRB) c2(NP_001103224) c3(9163) c4(35277, 48334, 61391, 22220, 74448) c5(Gj, u, IV, VM); #c1(PT-PRCAP) c2(NP_005599) c3(9164) c4(35278, 48335, 61392, 22221, 74449) c5(by, aV, bu); #c1(PTPRD) c2(NP_001035802) c3(9165) c4(35279, 48336, 61393, 22222, 74450) c5(cxD, dx, b, w, di, cO, bf, adr, e, d, qf, co, bb, zo, cV, do, IL, u, Fg, I, dA, du, cy, gF, aM, nk, hT, acg, Ez, aA, at); #c1(PTPRE) c2(NP_006495) c3(9166) c4(35280, 48337, 61394, 22223, 74451) c5(aD, at, cy, fl, nk); #c1(PTPRG) c2(NP_002832) c3(9167) c4(35281, 48338, 61395, 22224, 74452) c5(l, co, G, V, b, ak, dB, cs, bu, W, ag, ad, Ce, T, II, buo, LK, at, u, buk, y); #c1(PTPRH) c2(NP_001154912) c3(9168) c4(35282, 48339, 61396, 22225, 74453) c5(Zm, Ba, V, ae, aF, sE, q, Zr, Dp, beG, sj, pB, U); #c1(PTPRJ) c2(NP_001091973) c3(9169) c4(35283, 48340, 61397, 22226, 74454) c5(Dr, px, b, F, pR, di, U, e, y, d, Os, ip, jd, t, h, hV, N, ik, O, cs, u, QD, og, V, aC, be, gm, bp, ad, W, T, fO, jT, nV, xU, eN); #c1(PTPRK) c2(NP_001129120) c3(9170) c4(35284, 48341, 61398, 22227, 74455) c5(A, aX, b, B, J, ig, O, td, u, y); #c1 (PTPRM) c2(NP_001098714) c3(9171) c4(35285, 48342, 61399, 22228, 74456) c5(m, A, b, I, aV, u, y); #c1(PTPRN2) c2(NP_002838) c3(9172) c4(35286, 48343, 61400, 22229, 74457) c5(mz, bb, I, mD, u, MP, bf, hW, et, aE, ac, aM); #c1(PTPRN) c2(NP_001186692) c3(9173) c4(35287, 48344, 61401, 22230, 74458) c5(mz, I, iz, hq, MP, ex, aE, mD, bf, ey, aV, HD, aM); #c1(PTPR0) c2(NP_002839) c3(9174) c4(35288, 48345, 61402, 22231, 74459) c5(b, di, Iv, z, vp, y, cxE, jh, aX, bxk, q, jG, bm, te, dA, bd, bp, gm, G, J, jT, jE, u, cT); #c1(PTPRQ) c2(NP_001138498) c3(9175) c4(35289, 48346, 61403, 22232, 74460) c5(cxF, ak, Fg, Bx); #c1(PTPRR) c2(NP_001193944) c3(9176) c4(35290, 48347, 61404, 22233, 74461) c5(Bu, bj, Bx); #c1(PTPRS) c2(NP_002841) C3(9177) c4(35291, 48348, 61405, 22234, 74462) c5(jH, jU, I); #c1(PTPRT) c2(NP_008981) c3(9178) c4(35292, 48349, 61406, 22235, 74463) c5(A, b, k, dB, w, bf, bw, buk, O, m, B, fv, cs, I, cV, aC, zl, ad, Wp, et, jU, aM); #c1(PTPRZ1) c2(NP_001193768) c3(9179) c4(35293, 48350, 61407, 22236, 74464) c5(b, k, fr, dB, gN, dk, w, O, cR, bu, iZ, sR, aV, u, fU, V, bK, Fs, ft, cz, HL, ao, qp); #c1(PTRF) c2(NP_036364) c3(9180) c4(35294, 48351, 61408, 22237, 74465) c5(jH, A, b, p, Qf, B, cxG, jG, QY, w, mO, oD, Hh, aA, fy, re, xl); #c1(PTRH1) c2(NP_001002913) c3(9181) c4(35295, 48352, 61409, 22238, 74466) c5(bP, bm, nU, Pb, zw, xm, Km, zF, bsX, eH, HC, D, adt, pz, AO, gO, yK, b, co, pw, sm, jF, aAX, amK, f, q, yx, bRN, fr, y, Pm, YR, nB, aAS, cp, u, cl, em, vR, hW, fD, I, rU, VA, Fb, qq, gJ, xJ, azo, dt, bsO, QU, jG, cxj, Jw, aAP, ft, cxd, aAE, EZ, bDX, W, arq, ym, aYZ, TU, nc, aAV, LG, xN, AR, zM, ag, adi, TW, yB, arA, ahl, at, pO, ib, amL); #c1(PTRH2) c2(NP_057161) c3(9182) c4(35296, 48353, 61410, 22239, 74467) c5(d, tp, A, b, jh, fU, u, e, y); #c1(PTRHD1) c2(NP_001013685) c3(9183) c4(35297, 48354, 61411, 22240, 74468) c5(ak); #c1(PTS) c2(NP_000308) c3(9184) c4(35298, 48355, 61412, 22241, 74469) c5(em, adf, PY, q, cxH, bfi, WA, bM, cz, bm, WN); #c1(PTTG1) c2(NP_001269312) c3(9185) c4(35299, 48356, 61413, 22242, 74470) c5(A, JH, b, X, pR, jj, gn, wy, O, m, ck, bf, aw, U, hP, yE, y, d, jh, co, aX, kJ, jk, hV, q, e, do, ik, B, cs, bw, ar, fy, u, o, oJ, da, if, V, nQ, cV, qL, jE, fO, ad, W, T, Jj, cK, hR, aM, wh, nV, hX, bm, kM, xe, aaz, fl, asT); #c1(PTTG1IP) c2(NP_001273751) c3(9186) c4(35300, 48357, 61414, 22243, 74471) c5(iF, nV, aw, b, fr, hV, ft, W, iq, u, y); #c1(PTTG2) c2(NP_006598) c3(9187) c4(35301, 48358, 61415, 22244, 74472) c5(jE, bm); #c1(PTX3) c2(NP_002843) c3(9188) c4(35302, 48359, 61416, 22245, 74473) c5(dx, bL, id, dN, aF, aiW, iU, pv, mk, aDu, bzL, cO, si, sj, ajf, y, dv, aX, b, yX, et, f, baz, O, wT, hZ, fH, gg, yG, u, wR, aAf, aBs, ax, Pz, bo, aC, aGB, sH, LR, gL, pF, da, Fo, eX, gV, pi, fJ, be, dH, du, Ic, Ht, sE, yE, gA, j, bk, fD, I, bg, aA, ap, fl, aG); #c1(PUF60) c2(NP_001129505) c3(9189) c4(35303, 48360, 61417, 22246, 74474) c5(cr, V, b, iP, oi, cxI, U, oP); #c1(PUM2) c2(NP_001269681) c3(9190) c4(35304, 48361, 61418, 22247, 74475) c5(wn, am); #c1(PURA) c2(NP_005850) c3(9191) c4(35305, 48362, 61419, 22248, 74476) c5(A, h, n, bf, o, aM); #c1(PURB) c2(NP_150093) c3(9192) c4(35306, 48363, 61420, 22249, 74477) c5(h, n, c0); #c1 (PUS10) c2(XP_011530879) c3(9193) c4(35307, 48364, 61421, 22250, 74478) c5(ig, gz, jH); #c1(PUS1) c2(NP_001002019) c3(9194) c4(35308, 48365, 61422, 22251, 74479) c5(aNN, oD, kU, cxJ, bu); #c1(PVALB) c2(XP_011545203) c3(9195) c4(35309, 48366, 61423, 22252, 74480) c5(ak, eZ, dB, hS, aeP, cA, xw, bj, cM, it, f, Uq, vu, cxK, aV, aaQ, Ir, cV, Et, zj, cz, P, T, kz, sK, ao, aY, eo, dc, aG); #c1(PVR) c2(NP_001129240) c3(9196) c4(35310, 48367, 61424, 22253, 74481) c5(b, w, U, y, co, js, ayd, M, ar, O, aV, u, pE, V, cV, J, gL, pF, W, vS, aFj, II, x, Aj, Pw, P, xY, bry, cxL, ji, apU, eG); #c1(PVRL1) c2(NP_002846) c3(9197) c4(35311, 48368, 61425, 22254, 74482) c5(Pp, cxM, b, sE, sv, Ak, mk, iL, bf, O, e, y, oy, m, xT, fq, all, hV, Ns, ar, ff, cxN, u, da, d, jB, cV, aC, bK, Dp, gL, aM, nV, arJ, Nq, dY, xY, amS, fP, fl, eG); #c1(PVRL2) c2(NP_001036189) c3(9198) c4(35312, 48369, 61426, 22255, 74483) c5(gk, b, X, fc, Nq, gm, Ns, J, M, at, xY, fl, av, aV, Aj, o, ap); #c1(PVRL3) c2(NP_001230215) c3(9199) c4(35313, 48370, 61427, 22256, 74484) c5(u, HN, iu, I, eG, nj, y); #c1(PVRL4) c2(NP_112178) c3(9200) c4(35314, 48371, 61428, 22257, 74485) c5(d, co, b, eG, Dg, cxO, Ak amS, T, ji, ar, Aj, fy, u, e, y); #c1(PWP2) c2(NP_005040) c3(9201) c4(35315, 48372, 61429, 22258, 74486) c5(aq); #c1(PWWP2B) c2(NP_001092107) c3(9202) c4(35316, 48373, 61430, 22259, 74487) c5(kF); #c1(PXDN) c2(NP_036425) c3(9203) c4(35317, 48374, 61431, 22260, 74488) c5(co, aX, V, h, cxP, bb, U, et, cdW, bbN); #c1 (PXDNL) c2(NP_653252) c3(9204) c4(35318, 48375, 61432, 22261, 74489) c5(oy, akQ, NT, am); #c1(PXK) c2(NP_001276025) c3(9205) c4(35319, 48376, 61433, 22262, 74490) c5(aC, m, fl, j); #c1(PXMP2) c2(NP_061133) c3(9206) c4(35320, 48377, 61434, 22263, 74491) c5(aeK, aFY, cG, bld, HG, cc, s, y, qZ, csF, fr, O, u, ov, te, csE, csz, nl, ft, nd, cbr, bel, T, ac, xV, cN, Y, ble, csB, ahe, na); #c1(PXN) c2(NP_001074324) c3(9207) c4(35321, 48378, 61435, 22264, 74492) c5(by, A, b, X, EM, dB, Ip, O, U, y, BO, co, aX, f, F, q, bu, fr, ar, B, cs, av, fy, u, fU, V, gm, bp, ad, T, bt, ji, fx, ft, jG, i, Ez); #c1(PXT1) c2(XP_011512702) c3(9208) c4(35322, 48379, 61436, 22265, 74493) c5(am); #c1(PYCARD) c2(NP_037390) c3(9209) c4(35323, 48380, 61437, 22266, 74494) c5(dx, by, en, td, b, vd, cY, gG, w, xf, Bg, aw, U, aoK, A, zY, y, d, co, aX, DM, f, e, q, bty, X, ajJ, B, cs, hV, av, fy, u, iT, fU, V, ae, mm, aG, hZ, du, J, bp, gv, W, P, dv, T, II, cV, ar, og, ad, et, bu, be, cW, nV, QN, ale, bm, ahf, Rd, iV, xU, k, fl, bh, re, iE, Ca); #c1(PYCR1) c2(NP_001269208) c3(9210) c4(35324, 48381, 61438, 22267, 74495) c5(cxQ, Sg, Dg, nU, M, cxS, A, B, Jf, cxR, Ux, rT); #c1(PYDC1) c2(NP_690865) c3(9211) c4(35325, 48382, 61439, 22268, 74496) c5(adK, b, ciY, f, afD, Ex, awJ); #c1(PYDC2) c2(NP_001076777) c3(9212) c4(35326, 48383, 61440, 22269, 74497) c5(bw, Ge, bb, Gf, dA); #c1(PYGB) c2(NP_002853) c3(9213) c4(35327, 48384, 61441, 22270, 74498) c5(fy, bb, ar, o, at, rb); #c1(PYGL) c2(NP_001157412) c3(9214) c4(35328, 48385, 61442, 22271, 74499) c5(byw, BM, q, Vh, aE, wC); #c1(PYGM) c2(NP_001158188) c3(9215) c4(35329, 48386, 61443, 22272, 74500) c5(em, aHE, ado, nX, aF, sH, qq, mD, gB, BM, T, ib, ch, oD, iF, at, u, y, wC); #c1(PYGO1) c2(NP_056432) c3(9216) c4(35330, 48387, 61444, 22273, 74501) c5(V); #c1(PYGO2) c2(NP_612157) c3(9217) c4(35331, 48388, 61445, 22274, 74502) c5(b, X, w, T, O, u, y); #c1(PYHIN1) c2(NP_689714) c3(9218) c4(35332, 48389, 61446, 22275, 74503) c5(cy, u, y, m); #c1(PYROXD1) c2(NP_079130) c3(9219) c4(35333, 48390, 61447, 22276, 74504) c5(od, wy); #c1(PYY) c2(NP_004151) c3(9220) c4(35334, 48391, 61448, 22277, 74505) c5(fi, I, b, aeB, rh, eX, jJ, ys, rd, di, agc, ct, exT, aA, u, gF, o, Jy); #c1(PZP) c2(NP_002855) c3(9221) c4(35335, 48392, 61449, 22278, 74506) c5(fN, o); #c1(QARS) c2(NP_001259002) c3(9222) c4(35336, 48393, 61450, 22279, 74507) c5(QZ, hS, A); #c1(QDPR) c2(NP_000311) c3(9223) c4(35337, 48394, 61451, 22280, 74508) c5(adf, nU, pV, qB, an, eh, f, beK, At, dk, bAo, bM, di, ak, bK, as, bfi, Xt, cz, Jm); #c1(QKI) c2(NP_001288014) c3(9224) c4(35338, 48395, 61452, 22281, 74509) c5(mZ, gf, A, hW, b, X, ih, B, ED, aC, cM, eO, cA, bq, O, Fg); #c1(QPCT) c2(NP_036545) c3(9225) c4(35339, 48396, 61453, 22282, 74510) c5(pV, b, X, aF, dB, wy, bey, ix, zK, aw, U, e, cp, d, m, aX, UZ, fq, ak, Lo, bu, cU, jF, ar, qB, fy, aE, o, da, Ps, V, cV, aC, yY, el, J, by, sf, T, Ca, fp, wV, af, wP, cT, Fg, gj, Ri, at, iu); #c1(QPCTL) c2(NP_001156849) c3(9226) c4(35340, 48397, 61454, 22283, 74511) c5(dA); #c1(QPRT) c2(NP_055113) c3(9227) c4(35341, 48398, 61455, 22284, 74512) c5(ra, Bi, Bd); #c1(QRFP) c2(NP_937823) c3(9228) c4(35342, 48399, 61456, 22285, 74513) c5(aA); #c1 (QRFPR) c2(NP_937822) c3(9229) c4(35343, 48400, 61457, 22286, 74514) c5(at); #c1(QRSL1) c2(NP_060762) c3(9230) c4(35344, 48401, 61458, 22287, 74515) c5(jK, B, aw, b, X, sE, A, Ni, cO, U, ps, y, co, cr, h, f, q, jV, bu, ik, Pm, cs, av, u, ye, n, fe, il, cV, aSA, J, ad, MD, BW, Qj, by, jG, L, hQ, aq, aE, aA, at, eG); #c1(QS0X1) c2(NP_001004128) c3(9231) c4(35345, 48402, 61459, 22288, 74516) c5(kJ, f, aq, aJ, bw, IV, u, y); #c1(QSOX2) c2(NP_859052) c3(9232) c4(35346, 48403, 61460, 22289, 74517) c5(cV); #c1(QTRT1) c2(N_112486) c3(9233) c4(35347, 48404, 61461, 22290, 74518) c5(iw, co, arl, azy, bn, k, fO, bp, aC, hN, T, fl, Kv, ct, aJT, ar, aT, jF, jH, qK); #c1(R3HCC1) c2(NP_001129580) c3(9234) c4(35348, 48405, 61462, 22291, 74519) c5(cxU, kF); #c1(R3HCC1L) c2(NP_001243548) c3(9235) c4(35349, 48406, 61463, 22292, 74520) c5(Pv); #c1(R3HDM1) c2(NP_001269728) c3(9236) c4(35350, 48407, 61464, 22293, 74521) c5(cV); #c1(R3HDML) c2(NP_848586) c3(9237) c4(35351, 48408, 61465, 22294, 74522) c5(gZ); #c1(RAB11A) c2(NP_001193765) c3(9238) c4(35352, 48409, 61466, 22295, 74523) c5(d, gB, en, bpo, f, e, P, T, NB, u, yA, y); #c1(RAB11B) c2(NP_004209) c3(9239) c4(35353, 48410, 61467, 22296, 74524) c5(P); #c1(RAB11FIP1) c2(NP_001002814) c3(9240) c4(35354, 48411, 61468, 22297, 74525) c5(P, u, y); #c1(RAB11FIP2) c2(NP_055719) c3(9241) c4(35355, 48412, 61469, 22298, 74526) c5(fl); #c1(RAB11FIP3) c2(NP_001135744) c3(9242) c4(35356, 48413, 61470, 22299, 74527) c5(u, y, Uh); #c1(RAB11FIP4) c2(NP_116321) c3(9243) c4(35357, 48414, 61471, 22300, 74528) c5(di); #c1(RAB11FIP5) c2(NP_056285) c3(9244) c4(35358, 48415, 61472, 22301, 74529) c5(cz); #c1(RAB12) c2(NP_001020471) c3(9245) c4(35359, 48416, 61473, 22302, 74530) c5(at); #c1 (RAB14) c2(NP_057406) c3(9246) c4(35360, 48417, 61474, 22303, 74531) c5(P, fy, Qx); #c1(RAB15) c2(NP_941959) c3(9247) c4(35361, 48418, 61475, 22304, 74532) c5(l, i); #c1(RAB18) c2(NP_001243339) c3(9248) c4(35362, 48419, 61476, 22305, 74533) c5(iF, cxV, cWV, q, cxX, W, yE, DU, iL, gE, Km, aA, bm); #c1(RAB1A) c2(NP_004152) c3(9249) c4(35363, 48420, 61477, 22306, 74534) c5(A, B, kz, T, cO, nT); #c1(RAB1B) c2(NP_112243) c3(9250) c4(35364, 48421, 61478, 22307, 74535) c5(b, cV, el, f, wy, at, u, y); #c1(RAB20) c2(NP_060287) c3(9251) c4(35365, 48422, 61479, 22308, 74536) c5(aw, b, W, aq, T, bw, ar); #c1(RAB21) c2(NP_055814) c3(9252) c4(35366, 48423, 61480, 22309, 74537) c5(b); #c1(RAB22A) c2(NP_065724) c3(9253) c4(35367, 48424, 61481, 22310, 74538) c5(bf); #c1 (RAB23) c2(NP_001265595) c3(9254) c4(35368, 48425, 61482, 22311, 74539) c5(by, co, Ph, dA, bDm, q, bu, sJ, bDp, Al, aA, at); #c1(RAB24) c2(NP_570137) c3(9255) c4(35369, 48426, 61483, 22312, 74540) c5(KR); #c1 (RAB25) c2(NP_065120) c3(9256) c4(35370, 48427, 61484, 22313, 74541) c5(aw, b, X, kY, bj, y, tp, co, f, F, ar, cs, av, u, jh, qL, x, fx, Yp, pb, cxY, i); #c1(RAB27A) c2(NP_899059) c3(9257) c4(35371, 48428, 61485, 22314, 74542) c5(IY, fl, Bj, O, aX, pp, aPN, tF, y, zQ, u, ax, kG, nQ, aC, bK, XS, J, T, fx, dH, pS, i, ew); #c1(RAB27B) c2(XP_005266790) c3(9258) c4(35372, 48429, 61486, 22315, 74543) c5(IY, y, i, fx, u, Bj); #c1(RAB28) c2(NP_001017979) c3(9259) c4(35373, 48430, 61487, 22316, 74544) c5(nW, dA, nR, cxZ); #c1(RAB29) c2(NP_001129135) c3(9260) c4(35374, 48431, 61488, 22317, 74545) c5(bj); #c1(RAB2A) c2(NP_001229573) c3(9261) c4(35375, 48432, 61489, 22318, 74546) c5(kF, b); #c1(RAB31) c2(NP_006859) c3(9262) c4(35376, 48433, 61490, 22319, 74547) c5(X, av, u, y, b); #c1(RAB32) c2(NP_006825) c3(9263) c4(35377, 48434, 61491, 22320, 74548) c5(by, fl, IZ, ad, cU, P, ar, Bm, gj, bu); #c1(RAB33B) c2(NP_112586) c3(9264) c4(35378, 48435, 61492, 22321, 74549) c5(cya, aRK, Qt); #c1(RAB34) c2(NP_001136096) c3(9265) c4(35379, 48436, 61493, 22322, 74550) c5(u, y); #c1(RAB35) c2(NP_001161078) c3(9266) c4(35380, 48437, 61494, 22323, 74551) c5(X, av, b); #c1(RAB36) c2(NP_004905) c3(9267) c4(35381, 48438, 61495, 22324, 74552) c5(OG); #c1(RAB37) c2(NP_001006639) c3(9268) c4(35382, 48439, 61496, 22325, 74553) c5(fy, dB, ac); #c1(RAB38) c2(NP_071732) c3(9269) c4(35383, 48440, 61497, 22326, 74554) c5(aX, b, IZ, sU, td, Bj); #c1(RAB39A) c2(NP_059986) c3(9270) c4(35384, 48441, 61498, 22327, 74555) c5(cy); #c1(RAB39B) c2(NP_741995) c3(9271) c4(35385, 48442, 61499, 22328, 74556) c5(nz, nU, cz, hS, AP, cyb); #c1(RAB3A) c2(XP_011526466) c3(9272) c4(35386, 48443, 61500, 22329, 74557) c5(nW, cz, GN, aN, u, y); #c1(RAB3D) c2(NP_004274) c3(9273) c4(35387, 48444, 61501, 22330, 74558) c5(Fs, u, y); #c1(RAB3GAP1) c2(NP_001165906) c3(9274) c4(35388, 48445, 61502, 22331, 74559) c5(A, b, aN, Ip, w, U, ba, e, y, d, aJL, re, B, q, bu, cB, cxX, av, u, o, fU, V, bK, by, T, jT, fp, cxV, iT); #c1(RAB3GAP2) c2(NP_036546) c3(9275) c4(35389, 48446, 61503, 22332, 74560) c5(pE, cxV, dA, pL, eye, cxX, av); #c1(RAB3IL1) c2(NP_001258615) c3(9276) c4(35390, 48447, 61504, 22333, 74561) c5(bzq, cv); #c1(RAB3IP) c2(NP_001019818) c3(9277) c4(35391, 48448, 61505, 22334, 74562) c5(U, V); #c1(RAB40AL) c2(NP_001027004) c3(9278) c4(35392, 48449, 61506, 22335, 74563) c5(c, cyd, AP, nz, fO, xr, u, y); #c1(RAB40B) c2(NP_006813) c3(9279) c4(35393, 48450, 61507, 22336, 74564) c5(by, f, b, nJ, e, y, d, co, aX, t, h, ak, q, jV, bu, ra, vu, ik, ff, iv, pB, ar, u, iT, il, cV, lb, cs, J, bp, ad, jo, T, cz, jT, G, dY, re, ic); #c1(RAB40C) c2(NP_001166136) c3(9280) c4(35394, 48451, 61508, 22337, 74565) c5(c, fO, by, bu, u, y); #c1(RAB4A) c2(NP_004569) c3(9281) c4(35395, 48452, 61509, 22338, 74566) c5(m, aX, fm, fc, aq, pF, jz, gn, mW, dh, P, aV, et, gl, jQ); #c1(RAB4B) c2(NP_057238) c3(9282) c4(35396, 48453, 61510, 22339, 74567) c5(I, A); #c1(RAB5A) c2(NP_001278977) c3(9283) c4(35397, 48454, 61511, 22340, 74568) c5(en, b, X, dB, gE, DK, BO, co, cy, re, q, tF, DA, fy, aq, iT, Bd, SV, P, II, av, ao, aeq, u, ji, at); #c1(RAB5B) c2(NP_001238966) c3(9284) c4(35398, 48455, 61512, 22341, 74569) c5(aX, aE, gB); #c1(RAB5C) c2(NP_001238968) c3(9285) c4(35399, 48456, 61513, 22342, 74570) c5(b); #c1(RAB6A) c2(NP_001230647) c3(9286) c4(35400, 48457, 61514, 22343, 74571) c5(A, pp, b, B, Bj, cK, o); #c1(RAB6B) c2(NP_057661) c3(9287) c4(35401, 48458, 61515, 22344, 74572) c5(b, cV, el, f, wy, u, y); #c1(RAB6C) c2(NP_115520) c3(9288) c4(35402, 48459, 61516, 22345, 74573) c5(bb, u, y); #c1(RAB7A) c2(NP_004628) c3(9289) c4(35403, 48460, 61517, 22346, 74574) c5(bhh, en, aX, aeq, b, cG, cV, Y, XP, aJV, tF, cH, PL, aFh, Bj, Bd, asg, yk, at, P, ac); #c1(RAB8A) c2(NP_005361) c3(9290) c4(35404, 48461, 61518, 22347, 74575) c5(aDV, jV, aX, b, bpo, Ib, nW, q, gL, J, W, ea, aJV, O, aC, jC, u, y); #c1(RAB8B) c2(NP_057614) c3(9291) c4(35405, 48462, 61519, 22348, 74576) c5(alH, fl); #c1(RAB9A) c2(NP_001182257) c3(9292) c4(35406, 48463, 61520, 22349, 74577) c5(dD, XP); #c1(RABAC1) c2(NP_006414) c3(9293) c4(35407, 48464, 61521, 22350, 74578) c5(P, sE, O, b); #c1(RABEP1) c2(NP_001077054) c3(9294) c4(35408, 48465, 61522, 22351, 74579) c5(N, by, u, bu); #c1(RABEP2) c2(NP_079092) c3(9295) c4(35409, 48466, 61523, 22352, 74580) c5(d, KK, nU, qG, u, e); #c1(RABEPK) c2(NP_001167623) c3(9296) c4(35410, 48467, 61524, 22353, 74581) c5(da, m, JH, V, ae, fc, fq, fP, eo, aeR, aC, P, dQ, aE, HE, aD, aX, U, aV, aeS, cy); #c1(RABGAP1L) c2(NP_001230692) c3(9297) c4(35411, 48468, 61525, 22354, 74582) c5(m, bb, UK, h, UT, di, u); #c1(RABGEF1) c2(NP_001273989) c3(9298) c4(35412, 48469, 61526, 22355, 74583) c5(f, aw, b, X, w, U, A, e, aW, d, co, aX, h, ak, F, q, nv, bu, eE, arR, y, av, fy, u, mz, og, V, ae, cV, aC, cM, by, pF, nV, sS, aY, byf, B, ag, cT, fP, dc, aA, pv); #c1(RAB1F) c2(NP_002862) c3(9299) c4(35413, 48470, 61527, 22356, 74584) c5(ag, di); #c1(RABL6) c2(NP_001167459) c3(9300) c4(35414, 48471, 61528, 22357, 74585) c5(n0, u, y); #c1(RAC1) c2(NP_008839) c3(9301) c4(35415, 48472, 61529, 22358, 74586) c5(B, aw, iD, EM, dB, Ip, w, cO, e, O, gO, BO, kJ, et, mR, cl, g, mz, Oe, bp, x, jT, fy, ag, cT, i, dc, jl, aDf, X, Ak, bw, U, cM, co, ml, f, N, bu, aeE, k, cs, gg, azp, iT, V, v, gv, ad, akg, BV, py, aY, fw, ji, b, apC, yU, bQO, z, d, bb, re, nU, PA, q, es, jG, u, dh, sX, by, rB, wd, jU, yG, xv, jH, I, bL, A, fd, UA, eye, di, Iv, zK, jR, jx, LS, LI, wG, h, M, y, cV, J, P, Q1, T, aX, cz, fP, bh); #c1(RAC2) c2(NP_002863) c3(9302) c4(35416, 48473, 61530, 22359, 74587) c5(B, b, X, A, yU, cyf, bw, ajT, ps, O, BO, jT, aX, pp, jd, bj, h, f, q, ky, Dc, av, u, g, AU, J, CM, P, akg, rB, jl, hR, jG, eT, K, fP, Kn, ael, iu, rr); #c1(RAC3) c2(NP_005043) c3(9303) c4(35417, 48474, 61531, 22360, 74588) c5(g, A, aw, b, B, T, O, jG, u, y); #c1(RACGAP1) c2(NP_001306935) c3(9304) c4(35418, 48475, 61532, 22361, 74589) c5(f, aw, b, EM, fl, di, iL, A, y, co, iy, ag, aeE, fq, nU, q, cxX, B, jG, fy, u, kF, V, cyg, iD, fx, jd, i, ji); #c1(RADI7) c2(NP_579917) c3(9305) c4(35419, 48476, 61533, 22362, 74590) c5(wV, co, fs, ip, b, wP, f, F, bp, ag, T, cs, fy, u, y); #c1(RADI8) c2(NP_064550) c3(9306) c4(35420, 48477, 61534, 22363, 74591) c5(co, ar, V, b, bp, T, II, pt, oM, fy, u); #c1(RAD1) c2(NP_002844) c3(9307) c4(35421, 48478, 61535, 22364, 74592) c5(en, I, do, cT, bf, jT, u, aM); #c1(RAD21) c2(NP_006256) c3(9308) c4(35422, 48479, 61536, 22365, 74593) c5(A, b, U, e, y, aYo, d, ave, B, F, M, cs, u, QD, V, wp, ad, aNS, T, cyh, Ck, cT); #c1(RAD21L1) c2(NP_001130038) c3(9309) c4(35423, 48480, 61537, 22366, 74594) c5(aV); #c1(RAD23A) c2(NP_001257292) c3(9310) c4(35424, 48481, 61538, 22367, 74595) c5(aX, aaz, f, Dj, bu, P, aV, u); #c1(RAD23B) c2(NP_001231642) c3(9311) c4(35425, 48482, 61539, 22368, 74596) c5(GD, A, b, O, y, co, am, jd, f, q, ik, rR, aV, u, q, il, dA, Qz, GB, zU, fO, fx, AP, fy, aaz, os, cT, i, I); #c1(RAD50) c2(NP_005723) c3(9312) c4(35426, 48483, 61540, 22369, 74597) c5(GD, A, b, X, cyi, O, bw, U, Bz, bRB, eV, y, d, cy, fq, h, B, e, M, ar, rR, Xx, av, u, ajt, g, V, J, fO, dt, Ce, T, pt, jl, jT, cq, WZ, DI, i, oM, DM); #c1(RAD51AP1) c2(NP_001124334) c3(9313) c4(35427, 48484, 61541, 22370, 74598) c5(ajw, f, J, Mr, gG); #c1(RAD51B) c2(NP_002868) c3(9314) c4(35428, 48485, 61542, 22371, 74599) c5(X, w, kY, y, Ag, pw, aW, nv, age, O, PT, av, aV, u, oJ, g, fs, aC, sX, afn, IV, wh, bT); #c1(RAD51C) c2(NP_002867) c3(9315) c4(35429, 48486, 61543, 22372, 74600) c5(by, V, b, X, qN, F, cyk, bu, qO, agm, pt, Lt, i, cyj, oM, av, aV, u, U, y); #c1(RAD51D) c2(NP_001136043) c3(9316) c4(35430, 48487, 61544, 22373, 74601) c5(ar, BX, b, X, fj, cyl, i, ip, cT, pd, ny, pt, bw, oM, av, aV, u, U, y, V); #c1(RAD51) c2(NP_001157742) c3(9317) c4(35431, 48488, 61545, 22374, 74602) c5(B, HC, e, O, M, dl, jF, oJ, g, asr, cs, fO, ft, jT, pq, wh, qN, ag, cT, bk, i, pt, Dr, fl, Zx, kY, bw, U, y, co, ip, f, bu, iv, av, fy, iT, V, Qz, jG, iA, jR, qO, oM, ci, b, Pv, cK, Mr, d, cym, jd, re, hV, q, X, ar, fv, jG, u, fs, il, qL, ad, nV, gd, fl, I, A, fr, nJ, jl, h, F, cU, ik, n, aV, YR, J, W, P, T, bp, by, fM, wU); #c1(RAD52) c2(NP_001284348) c3(9318) c4(35432, 48489, 61546, 22375, 74603) c5(Dr, b, X, O, co, jd, re, f, y, av, QJ, u, iT, n, g, J, Qz, T, nV, aV, cT, i, I, ji); #c1(RAD54B) c2(NP_001192191) c3(9319) c4(35433, 48490, 61547, 22376, 74604) c5(g, jl, bQ, kF, b, vF, ad, ar, cs, bw, aV, u, O); #c1(RAD9A) c2(NP_004575) c3(9320) c4(35434, 48491, 61548, 22377, 74605) c5(co, aw, BX, b, f, aeR, A, B, ji, yA, fy, u, y); #c1(RAD9B) c2(NP_001273461) c3(9321) c4(35435, 48492, 61549, 22378, 74606) c5(wP, wV); #c1(RAE1) c2(XP_005260640) c3(9322) c4(35436, 48493, 61550, 22379, 74607) c5(Pw, jE, rY, b, cV, J, bm); #c1(RAET1E) c2(NP_001230254) c3(9323) c4(35437, 48494, 61551, 22380, 74608) c5(av, II, cs); #c1(RAET1L) c2(NP_570970) c3(9324) c4(35438, 48495, 61552, 22381, 74609) c5(PI); #c1(RAF1) c2(NP_002871) c3(9325) c4(35439, 48496, 61553, 22382, 74610) c5(pm, B, EM, gG, dB, HG, w, bf, adr, e, O, M, zi, cy, ajF, kJ, AX, mR, kP, nB, g, og, ac, jE, bp, ft, Ce, fx, jT, zK, oQ, aEs, DO, ag, i, pJ, auB, nF, eu, mk, cA, U, cM, co, DM, f, bu, gX, cs, av, fy, bm, V, ze, NZ, Wh, cY, VP, jG, W, aen, ji, wf, hV, b, cK, d, aua, q, QE, ar, RF, jG, aM, iR, o, ff, QL, fs, eye, cyp, gL, ad, iD, Ut, gQ, nV, u, Yg, Bg, na, yA, zD, VB, A, k, fr, ea, Iv, iL, gE, aux, cr, h, F, cU, y, cB, fU, nQ, cyn, J, dt, Q1, T, fO, aX, nP, by, fM, sK, qp, QN, Yv, Di, X, eG); #c1(RAG1) c2(XP_005253098) c3(9326) c4(35440, 48497, 61554, 22383, 74611) c5(dx, px, b, sE, eu, pD, ig, bdP, bRh, vl, xl, m, co, aX, pp, t, ja, eX, cT, ky, n, cs, zQ, Zs, cvc, cV, aC, Oq, du, bEk, fO, J, cyq, G, dv, aGJ, cy, ad, et, jU, jT, sS, Dc, ie, zT, i, CV, I, jl, cyr); #c1(RAG2) c2(NP_001230714) c3(9327) c4(35441, 48498, 61555, 22384, 74612) c5(A, b, q, qd, sE, eu, pD, Zs, bdP, qw, NH, Iv, Eh, G, xl, m, rY, pp, ajK, bn, t, nU, cT, es, bnh, bRW, cs, fy, u, cvc, yV, bag, kt, be, J, fO, dB, P, T, aX, jT, jU, jH, ao, fm, af, NG, cyr, yX, Dc, B, fG, ag, IN, pH, fl, aC, aA, jl, Nu, y); #c1(RAI14) c2(NP_001138992) c3(9328) c4(35442, 48499, 61556, 22385, 74613) c5(X, av); #c1(RAI1) c2(NPJ09590) c3(9329) c4(35443, 48500, 61557, 22386, 74614) c5(n0, dD, ck, ak, amh, bj, aX, bII, Wk, f, xr, bjb, alX, cV, cz, dt, eX, cr, AP, jR, ih, cT, aal, Yv, DU, aA); #c1(RAI2) c2(NP_001166203) c3(9330) c4(35444, 48501, 61558, 22387, 74615) c5(aJc); #c1(RALA) c2(XP_006715825) c3(9331) c4(35445, 48502, 61559, 22388, 74616) c5(Wp, kJ, q, P, T, i, bw, fx, fy); #c1(RALB) c2(NP_002872) c3(9332) c4(35446, 48503, 61560, 22389, 74617) c5(T, ao, arl, i, bw); #c1(RALBP1) c2(NP_006779) c3(9333) c4(35447, 48504, 61561, 22390, 74618) c5(bL, B, ER, b, nF, eu, hS, w, di, O, bf, U, A, fx, y, co, aX, f, F, X, ff, cs, av, fy, u, fU, fs, V, cV, aC, dB, J, bp, ad, jo, T, gF, yW, aM, cf, ag, i, ji, at); #c1(RALGAPA1) c2(NP_001269972) c3(9334) c4(35448, 48505, 61562, 22391, 74619) c5(aYj); #c1(RALGAPA2) c2(NP_065076) c3(9335) c4(35449, 48506, 61563, 22392, 74620) c5(fx, aV, iy, i); #c1(RALGAPB) c2(NP_001269847) c3(9336) c4(35450, 48507, 61564, 22393, 74621) c5(f0, iy, b, t, h, cs, dB, q, fO, J, hi, G, n, iL, iv, bh, jG, ad, u, y); #c1(RALGDS) c2(NP_001035827) c3(9337) c4(35451, 48508, 61565, 22394, 74622) c5(d, ao, aX, b, kJ, nU, ic, e); #c1(RALGPS1) c2(NP_001177657) c3(9338) c4(35452, 48509, 61566, 22395, 74623) c5(dA); #c1(RALY) c2(NP_031393) c3(9339) c4(35453, 48510, 61567, 22396, 74624) c5(fi, V, xq, U, u, y); #c1(RALYL) c2(NP_001093861) c3(9340) c4(35454, 48511, 61568, 22397, 74625) c5(bb, at, u, cV); #c1(RAMP1) c2(NP_005846) c3(9341) c4(35455, 48512, 61569, 22398, 74626) c5(A, bb, bgB, b, sG, hq, fw, B, dv, dZ, T, dV, dn, bq, di, nP); #c1(RAMP2) c2(NP_005845) c3(9342) c4(35456, 48513, 61570, 22399, 74627) c5(gK, co, ar, aC, ch, f, IW, bp, aE, crx, w, T, cO, gg, di, aA, Ah, et, gf, at); #c1(RAMP3) c2(NP_005847) c3(9343) c4(35457, 48514, 61571, 22400, 74628) c5(at, ag, w, T, hR, O); #c1(RANBPIO) c2(NP_065901) c3(9344) c4(35458, 48515, 61572, 22401, 74629) c5(bu); #c1(RANBP17) c2(NP_075048) c3(9345) c4(35459, 48516, 61573, 22402, 74630) c5(c0); #c1(RANBP1) c2(NP_002873) c3(9346) c4(35460, 48517, 61574, 22403, 74631) c5(aX, P, u, b, cs); #c1(RANBP2) c2(NP_006258) c3(9347) c4(35461, 48518, 61575, 22404, 74632) c5(hT, pV, b, cys, rG, f, acs, cs, fO, ad, dt, P, w, T, asY, TB, qB, If, aX, O); #c1(RANBP3) c2(NP_003615) c3(9348) c4(35462, 48519, 61576, 22405, 74633) c5(X, ad, II, cs, av, Iv); #c1(RANBP3L) c2(NP_001154901) c3(9349) c4(35463, 48520, 61577, 22406, 74634) c5(oy, at); #c1(RANBP6) c2(NP_036548) c3(9350) c4(35464, 48521, 61578, 22407, 74635) c5(cy); #c1(RANBP9) c2(NP_005484) c3(9351) c4(35465, 48522, 61579, 22408, 74636) c5(u, o, y); #c1(RANGAP1) c2(NP_001265580) c3(9352) c4(35466, 48523, 61580, 22409, 74637) c5(aX, I, el, xJ, gm, pD, J, dt, KL, RA, jT); #c1(RANGRF) c2(NP_001171272) c3(9353) c4(35467, 48524, 61581, 22410, 74638) c5(arL, ajW); #c1(RAN) c2(NP_001287725) c3(9354) c4(35468, 48525, 61582, 22411, 74639) c5(A, b, X, iP, dB, j J, iL, wX, jw, y, Ag, co, rY, yQ, ip, B, q, ff, cs, av, u, wp, fO, ad, P, T, ny, ct, jG, ao, BX, Af); #c1(RAP1B) c2(NP_001010942) c3(9355) c4(35469, 48526, 61583, 22412, 74640) c5(d, Dr, nV, b, ag, el, f, jh, wy, gd, di, n, cV, U, u, e, y); #c1(RAP1GAP2) c2(NP_001093868) c3(9356) c4(35470, 48527, 61584, 22413, 74641) c5(di, bb, bg); #c1(RAP1GDS1) c2(NP_001093896) c3(9357) c4(35471, 48528, 61585, 22414, 74642) c5(A, b, t, h, B, ie, G, T, fy, u, y); #c1(RAP2A) c2(NP_066361) c3(9358) c4(35472, 48529, 61586, 22415, 74643) c5(oy, VB, nV, ae, aC, hV, A, B, bq, u, y); #c1(RAP2B) c2(NP_002877) c3(9359) c4(35473, 48530, 61587, 22416, 74644) c5(aX, b, cV, el, f, wy, Eo, T, u, y); #c1(RAPGEF1) c2(NP_001291204) c3(9360) c4(35474, 48531, 61588, 22417, 74645) c5(d, b, I, dA, X, bu, av, ad, hP, e); #c1(RAPGEF2) c2(NP_055062) c3(9361) c4(35475, 48532, 61589, 22418, 74646) c5(HI, O, cp); #c1(RAPGEF3) c2(NP_001092001) c3(9362) c4(35476, 48533, 61590, 22419, 74647) c5(Yk, aH, A, LS, cY, t, bb, B, ih, aY, T, dc, I, cyt, aX, cM); #c1(RAPGEF4) c2(NP_001093867) c3(9363) c4(35477, 48534, 61591, 22420, 74648) c5(aY, Yk, cz, cM, dc); #c1(RAPGEF5) c2(NP_036426) c3(9364) c4(35478, 48535, 61592, 22421, 74649) c5(bP, aSV, dM, di, Ni, bf, ey, aK, gO, m, qs, aX, ob, cyu, amK, ak, arm, pn, bsO, aE, hW, I, cV, gJ, xq, rw, bb, et, aM, qt, bAI, he, AR, ue, so, fD, amL, ap); #c1(RAPH1) c2(NP_976241) c3(9365) c4(35479, 48536, 61593, 22422, 74650) c5(b, fr, eu, al, y, Aa, ja, q, cs, Ah, u, Ac, aC, ft, II, jT, ac, zZ, cT, fl, bq, zD); #c1(RAPSN) c2(NP_005046) c3(9366) c4(35480, 48537, 61594, 22423, 74651) c5(xQ, aOp, aOm, cyv, oD, aCT); #c1(RARA) c2(NP_001019980) c3(9367) c4(35481, 48538, 61595, 22424, 74652) c5(ml, aw, e, cU, t, n, fe, lb, cs, gm, bp, ft, jT, csw, BX, pb, jE, f, ie, dc, aA, X, oH, aVc, cM, co, ak, N, bu, B, iv, av, fy, bm, iT, iA, xd, aY, nJ, cz, cn, b, ic, d, re, q, jV, ra, vu, ar, ff, pB, jG, DY, u, o, il, Dg, by, G, vw, MO, wV, Bu, wP, Ns, fg, A, fr, dY, baW, aX, h, gT, M, aC, ik, y, cB, dj, cV, J, jo, T, ad, ao, Nq, ci, bh, eN); #c1(RARB) c2(NP_000956) c3(9368) c4(35482, 48539, 61596, 22425, 74653) c5(bm, oC, en, aw, b, X, F, rT, dB, QY, Ip, VP, A, jV, iL, et, bkA, O, pz, fx, y, Ne, d, jh, jv, co, aX, ip, re, hV, wN, q, zY, bu, cU, ik, B, aJ, cs, pB, cyw, av, fy, u, o, RG, fU, il, cV, lb, Dg, Gd, Dt, J, bp, po, W, ad, nV, T, ar, x, jc, iA, M0, fp, xd, cW, eJ, qp, eG, Bu, DO, he, by, e, oi, iT, i, avx, bh, aA, cvv, kD); #c1(RARG) c2(NP_001036193) c3(9369) c4(35483, 48540, 61597, 22426, 74654) c5(b, gG, et, bw, e, y, d, aX, h, F, q, jV, ar, aJ, HE, av, u, o, cV, Dg, gm, J, xd, Nq, bh); #c1(RARRES1) c2(NP_002879) c3(9370) c4(35484, 48541, 61598, 22427, 74655) c5(d, jh, MT, A, da, b, gG, B, q, J, cU, ad, T, cs, Jk, ct, bu, e, y); #c1(RARRES2) c2(NP_002880) c3(9371) c4(35485, 48542, 61599, 22428, 74656) c5(dx, ed, bQ, aaa, I, dS, aC, du, mz, fP, da, dv, T, eX, kF, aX, di, at, aA, be, ap); #c1(RARRES3) c2(NP_004576) c3(9372) c4(35486, 48543, 61600, 22429, 74657) c5(en, JH, b, X, ie, aiW, mk, w, iL, gE, ER, U, re, al, y, d, m, aX, DG, kJ, AX, f, F, q, bu, dQ, ar, av, u, aE, iT, awq, da, fe, apx, aC, Dg, by, P, T, II, BL, ajd, jH, hU, aeq, aAu, bez, hT, Oa, UE, e, cT, fl, fl, yA, DM); #c1(RARS2) c2(NP_064716) c3(9373) c4(35487, 48544, 61601, 22430, 74658) c5(awV, hT, yH, pQ, hS, bgW, bda, boV, bF, Vf, cyx); #c1(RARS) c2(NP_002878) c3(9374) c4(35488, 48545, 61602, 22431, 74659) c5(JI, fl, b, kT, h, N, J, cyx, yE, cT, n, eM, JE, kX, pv, pz, Vf, cU, pq); #c1(RASA1) c2(NP_002881) c3(9375) c4(35489, 48546, 61603, 22432, 74660) c5(Dr, nU, b, k, aFF, EM, dB, cyz, A, di, Ug, Iw, U, Le, aHp, Ct, Up, Ag, co, iy, aeF, t, h, f, N, q, B, dl, cjv, y, cs, cxX, jG, fy, u, zO, V, aeM, cyy, sH, Fs, kP, fl, dt, m, IG, ff, iD, ji, fx, cC, US, nV, CA, Cr, ag, gA, fg, Af, i, fq, T, cyA, iu, WO); #c1(RASA2) c2(NP_001290174) c3(9376) c4(35490, 48547, 61604, 22433, 74661) c5(eJ, A, V, b, h, B, cs, U, Up); #c1(RASAL1) c2(NP_001180449) c3(9377) c4(35491, 48548, 61605, 22434, 74662) c5(nV, V, hV, q, bu, W, ra, og, ar, x, U, by, et, ca, gO); #c1(RASAL2) c2(NP_004832) c3(9378) c4(35492, 48549, 61606, 22435, 74663) c5(aw, I, dA, bu, x, cy, aA, by, u, y); #c1(RASD1) c2(NP_001186918) c3(9379) c4(35493, 48550, 61607, 22436, 74664) c5(E0, A, I, sE, fO, mA, EQ, bf, apv, u, y, aM); #c1(RASD2) c2(NP_055125) c3(9380) c4(35494, 48551, 61608, 22437, 74665) c5(fH, si, fJ, FE); #c1(RASEF) c2(NP_689786) c3(9381) c4(35495, 48552, 61609, 22438, 74666) c5(co, aX, b, DO, jC, bq, jG, u); #c1(RASGEFIA) c2(NP_001269791) c3(9382) c4(35496, 48553, 61610, 22439, 74667) c5(ahS, aV, A); #c1(RASGEFIC) c2(NP_778232) c3(9383) c4(35497, 48554, 61611, 22440, 74668) c5(c0); #c1(RASGRF1) c2(NP_001139120) c3(9384) c4(35498, 48555, 61612, 22441, 74669) c5(dx, de, ak, b, X, cnm, hS, w, O, U, A, y, cy, aeQ, dv, aX, aeT, pp, h, f, q, bu, M, fr, jT, B, fP, OA, fy, u, nW, Fg, xc, aC, nz, du, v, ct, cz, zi, Bu, by, ao, IZ, dl, sS, bm, Bt, ag, XH, vj); #c1(RASGRF2) c2(NP_008840) c3(9385) c4(35499, 48556, 61613, 22442, 74670) c5(Ag, Nq, bp, T, Af, iG, Fg); #c1(RASGRP1) c2(NP_001122074) c3(9386) c4(35500, 48557, 61614, 22443, 74671) c5(oy, arR, I, b, m, aC, t, h, ak, Iv, eG, aE, ac); #c1(RASGRP2) c2(NP_001092141) c3(9387) c4(35501, 48558, 61615, 22444, 74672) c5(arR, nX); #c1(RASGRP3) c2(NP_056191) c3(9388) c4(35502, 48559, 61616, 22445, 74673) c5(oy, m, A, aX, pp, b, qL, B, q, di, hb, u, y); #c1(RASGRP4) c2(NP_001139674) c3(9389) c4(35503, 48560, 61617, 22446, 74674) c5(cy, ahq, h, apP, Tr, at); #c1(RASIP1) c2(NP_060275) c3(9390) c4(35504, 48561, 61618, 22447, 74675) c5(NI, hue, ak, a0, ap); #c1(RASLIOA) c2(NP_006468) c3(9391) c4(35505, 48562, 61619, 22448, 74676) c5(w, O, b); #c1(RASLIOB) c2(NP_201572) c3(9392) c4(35506, 48563, 61620, 22449, 74677) c5(bq, kF); #c1(RASL11A) c2(NP_996563) c3(9393) c4(35507, 48564, 61621, 22450, 74678) c5(A, eG, Eg); #c1(RASL11B) c2(NP_076429) c3(9394) c4(35508, 48565, 61622, 22451, 74679) c5(dv); #c1(RASLI2) c2(NP_057647) c3(9395) c4(35509, 48566, 61623, 22452, 74680) c5(FJ, aLZ, ach, oj, bJt); #c1(RASSF1) c2(NP_001193886) c3(9396) c4(35510, 48567, 61624, 22453, 74681) c5(ml, aw, amF, gG, jt, dB, Ty, ck, Ir, e, O, BO, t, aJP, Xi, jq, fH, EM, g, fe, asQ, aAL, Xc, bp, Ce, fx, jT, pb, jE, sg, DO, jh, aq, w, i, pJ, X, fE, iP, eu, iG, bo, U, y, aAH, co, yE, f, LI, vQ, bu, B, iJ, av, fy, bm, iT, aju, hh, jB, a NY, YV, V, yg, Qz, gv, VP, jC, iA, fJ, d, ahT, wp, anG, acj, jR, Le, aAN, apG, gA, gR, Xk, ji, aEg, OG, An, b, QB, anb, oi, apg, Mr, Ne, yK, Ag, biX, jF, jd, re, hV, PA, q, es, ra, ar, ff, Yr, JY, u, PJ, jj, il, dT, gL, by, G, Ca, aZ, ct, Lt, DP, cW, jH, nV, iR, eQ, jc, Bg, aqf, bls, A, kY, k, fr, Lv, pR, gw, BY, og, C, iL, iK, jx, MT, aX, LI, h, F, cU, ik, n, cB, NO, fU, tl, cV, Be, aHh, W, jo, QI, T, fO, Ze, Xj, fM, sK, qp, QN, fP, bh, iE); #c1(RASSF2) c2(NP_055552) c3(9397) c4(35511, 48568, 61625, 22454, 74682) c5(fl, b, X, U, bu, hP, e, d, tp, co, aX, re, hV, es, Xi, fy, u, iT, Bd, V, bp, by, W, T, Xj, cW, nV, ag, Bi); #c1(RASSF3) c2(NP_835463) c3(9398) c4(35512, 48569, 61626, 22455, 74683) c5(co, V, b, cV, F, ar, O, OV, fy, U, at, u, y); #c1(RASSF4) c2(NP_114412) c3(9399) c4(35513, 48570, 61627, 22456, 74684) c5(XH, O, o); #c1(RASSF5) c2(NP_872604) c3(9400) c4(35514, 48571, 61628, 22457, 74685) c5(f, b, k, pR, dB, oi, OV, U, O, m, co, Tq, hV, F, q, ra, ar, y, fy, bm, V, cV, bp, T, nV, anG, u); #c1(RASSFG) c2(NP_001257320) c3(9401) c4(35515, 48572, 61629, 22458, 74686) c5(aw, b, dA, cV, J, bu, bk, by); #c1(RASSF7) c2(NP_001137465) c3(9402) c4(35516, 48573, 61630, 22459, 74687) c5(b, X, jj, U, e, y, d, co, aX, h, ak, av, bm, aE, g, fe, V, cV, qq, J, bp, cz, fx, kl, nV, u, i); #c1(RASSF8) c2(NP_001158219) c3(9403) c4(35517, 48574, 61631, 22460, 74688) c5(f0, dA, bp, co, ar, aHO, ji); #c1(RAX2) c2(NP_116142) c3(9404) c4(35518, 48575, 61632, 22461, 74689) c5(nQ, cyC, cyB); #c1(RAX) c2(NP_038463) c3(9405) c4(35519, 48576, 61633, 22462, 74690) c5(aX, aeq, kH, kD, f, bYF, II, cyD, AP); #c1(RB1CC1) c2(NP_001077086) c3(9406) c4(35520, 48577, 61634, 22463, 74691) c5(A, cB, b, fr, ja, f, ft, I, w, B, i, x, et, u, y); #c1(RB1) c2(NP_000312) c3(9407) c4(35521, 48578, 61635, 22464, 74692) c5(dx, DP, aw, bx, dB, Ip, w, bZS, e, U, BO, dv, kJ, t, cl, n, g, fe, lb, zv, iv, gm, bp, ft, Tk, fx, jT, cg, M, oQ, BX, YA, jh, ag, cT, qP, i, mD, aA, ib, fl, X, jj, jz, wy, kB, W, bo, bw, U, y, co, ip, yE, bol, B, bu, cs, iJ, av, fy, iT, aEq, iF, YV, V, yg, Qz, gv, afz, Hq, Fr, iA, dt, du, gt, jR, jd, qO, Xk, fK, b, anb, ic, jy, zL, d, Ag, aJL, Be, re, q, jV, es, OC, ar, ff, aJ, HE, jG, u, o, fh, sQ, il, qL, aH, gL, ad, G, aHE, iD, ct, cW, wV, nV, iR, aoA, Bg, wP, cdh, cde, A, k, fr, BY, gE, fs, bj, iK, jx, QV, aX, h, fB, oc, cU, aC, ik, Nm, cB, jQ, fU, cV, YR, Zg, J, GB, jo, T, fO, jl, by, qp, QN, YQ, avl, bnX, XH, Af, E, bh, eG, rb); #c1(RBAK) c2(NP_066986) c3(9408) c4(35522, 48579, 61636, 22465, 74693) c5(oy, ED, agF, dA); #c1(RBBP5) c2(NP_001180201) c3(9409) c4(35523, 48580, 61637, 22466, 74694) c5(w, bb); #c1(RBBP6) c2(NP_008841) c3(9410) c4(35524, 48581, 61638, 22467, 74695) c5(d, co, bb, il, b, js, cs, bp, ad, fl, T, O, cB, bf, ik, ar, u, e, y, aM); #c1(RBBP7) c2(NP_001185648) c3(9411) c4(35525, 48582, 61639, 22468, 74696) c5(g, fe, nz, f, T, cB, u, y); #c1(RBBP8) c2(NP_976037) c3(9412) c4(35526, 48583, 61640, 22469, 74697) c5(A, b, X, sF, bw, U, y, jx, aQk, f, ar, B, cB, av, u, aij, V, cyE, gL, T, fx, ag, i, coN, WS); #c1(RBBP9) c2(NP_006597) c3(9413) c4(35527, 48584, 61641, 22470, 74698) c5(T, cB); #c1(RBCK1) c2(NP_006453) c3(9414) c4(35528, 48585, 61642, 22471, 74699) c5(u, cbO, cK, oD, zg, y); #c1(RBF0X1) c2(NP_001135805) c3(9415) c4(35529, 48586, 61643, 22472, 74700) c5(avQ, ak, V, U, sX, Bt, ao, fP, rJ, hS, cz, rQ, GF, aA, aDx, rO, rH, at, akp, CG, o); #c1(RBF0X2) c2(NP_001026865) c3(9416) c4(35530, 48587, 61644, 22473, 74701) c5(A, b, X, hS, y, gO, co, h, nU, cs, av, bm, akp, akd, J, j, ad, P, II, TW, yG, jE, u, zl, Oa, fD, Jh, rb); #c1(RBF0X3) c2(NP_001076044) c3(9417) c4(35531, 48588, 61645, 22474, 74702) c5(m, avQ, si, Kx, LF, f, ao, mW, dh, oH, hS, bj, gl, akp); #c1(RBL1) c2(NP_002886) c3(9418) c4(35532, 48589, 61646, 22475, 74703) c5(Dr, cU, fU, aw, cB, b, X, re, B, bp, W, co, T, iT, A, u, y); #c1(RBL2) c2(XP_005256140) c3(9419) c4(35533, 48590, 61647, 22476, 74704) c5(A, aw, b, X, iP, pD, aN, Ip, w, U, e, y, d, jh, co, jl, aJL, re, B, q, bu, cU, fr, O, cB, av, u, o, fU, V, cV, bp, ft, T, iA, by, fp, jT, cT, iT, iE); #c1(RBM10 c2(NP_001191397) c3(9420) c4(35534, 48591, 61648, 22477, 74705) c5(co, b, Nq, cyF, u, y); #c1(RBM12) c2(NP_001185769) c3(9421) c4(35535, 48592, 61649, 22478, 74706) c5(PT); #c1(RBM14) c2(NP_001185765) c3(9422) c4(35536, 48593, 61650, 22479, 74707) c5(jT, fy, aw, b, dB, bu, ag, jo, w, T, O, cK, by, u, y); #c1(RBM14-RBM4) c2(NP_001185774) c3(9423) c4(35537, 48594, 61651, 22480, 74708) c5(jT, fy, aw, b, dB, bu, ag, jo, w, O, cK, by, u, y); #c1(RBM15) c2(XP_011540270) c3(9424) c4(35538, 48595, 61652, 22481, 74709) c5(jK, b, h, J, jG, aq); #c1(RBM17) c2(NP_001139019) c3(9425) c4(35539, 48596, 61653, 22482, 74710) c5(Kx, b, re, T, kV, aE); #c1(RBM20) c2(NP_001127835) c3(9426) c4(35540, 48597, 61654, 22483, 74711) c5(aoa, oy, sz, cyG, mR, cO, cK); #c1(RBM25) c2(XP_011535346) c3(9427) c4(35541, 48598, 61655, 22484, 74712) c5(c0); #c1(RBM26) c2(NP_001273561) c3(9428) c4(35542, 48599, 61656, 22485, 74713) c5(jT); #c1(RBM27) c2(NP_061862) c3(9429) c4(35543, 48600, 61657, 22486, 74714) c5(ain); #c1(RBM28) c2(NP_001159607) c3(9430) c4(35544, 48601, 61658, 22487, 74715) c5(bHI, nc, cyH); #c1 (RBM38) c2(NP_001278709) c3(9431) c4(35545, 48602, 61659, 22488, 74716) c5(b, X, f, bq, av, jT, u, y); #c1 (RBM39) c2(NP_001229528) c3(9432) c4(35546, 48603, 61660, 22489, 74717) c5(co, fD, b, q, gv, fv, iL, iv, bh, fy, u, y); #c1(RBM3) c2(NP_006734) c3(9433) c4(35547, 48604, 61661, 22490, 74718) c5(A, aw, V, b, Hk, f, cyl, B, U, u, y); #c1(RBM45) c2(NP_694453) c3(9434) c4(35548, 48605, 61662, 22491, 74719) c5(lJ, ml, pV, Io, bx, oz, iU, Ka, Zs, sJ, dM, cO, aw, fR, yi, Na, O, fm, cy, t, AX, aDx, yh, aVV, oQ, azc, bh, mR, Lt, aMq, aD, ky, biz, TP, kN, bJr, og, aC, bJF, jG, fO, po, apl, dB, ME, oD, aZS, Vv, JN, mm, awY, dH, Ig, xO, azW, gC, aZg, bJB, bJw, a EX, sN, anb, fc, cT, Pf, fD, bT, rn, bP, fl, gE, Kt, aBv, X, bJA, jz, bY, ig, aer, vp, bab, Co, Jo, y, co, rY, RD, aoR, gd, IS, ml, f, vQ, bu, axC, aFL, B, iv, UM, av, rr, iT, bJt, bJh, yV, ae, nl, cd, gv, pr, Jc, bAH, wA, cl, qH, rS, PJ, JY, en, pk, wu, dP, acF, aum, P, aYE, jd, br, abs, bJL, iu, ci, aln, cdh, ach, afE, b, ag, ami, Pv, qz, atU, wn, tN, BL, NU, z, hr, aMI, ey, aGX, aYA, HQ, ahX, bb, eA, vC, re, iW, q, fJ, CO, aFr, atT, n, yW, qT, u, aE, o, da, Id, Jn, kF, I, im, ir, Dg, RK, LR, j, cz, IX, G, aYz, JJ, et, bJs, JH, jh, aAs, bJH, ale, xU, by, na, Bm, cK, asm, azt, A, bf, qd, Ik, gn, QV, pw, D, C, iL, eM, sQ, al, xe, bIT, Ld, jQ, bJi, bbE, bs, oj, sG, h, do, bn, aW, cB, qB, bzq, aV, jZ, yd, aFc, ax, m, aMH, be, J, ei, axl, ti, T, II, bJQ, Im, bJO, aX, ya, Pk, qe, aM, aGc, at, DG, bwW, MU, Jh, eX, fP, jU, iB, XO, ap, LQ, Dq, hz, oT); #c1(RBM4G) c2(NP_659416) c3(9435) c4(35549, 48606, 61663, 22492, 74720) c5(td); #c1(RBM47) c2(NP_001092104) c3(9436) c4(35550, 48607, 61664, 22493, 74721) c5(bf, at); #c1(RBM4) c2(NP_001185772) c3(9437) c4(35551, 48608, 61665, 22494, 74722) c5(HN, aq, u, y); #c1(RBM5) c2(NP_005769) c3(9438) c4(35552, 48609, 61666, 22495, 74723) c5(f0, b, ag, beC, bp, wn, co, T, ji, ar, fy, u, y); #c1(RBM6) c2(NP_005768) c3(9439) c4(35553, 48610, 61667, 22496, 74724) c5(jK, fU, b, beC, J, co, aA); #c1 (RBM7) c2(NP_057174) c3(9440) c4(35554, 48611, 61668, 22497, 74725) c5(fy); #c1(RBMS1) c2(NP_002888) c3(9441) c4(35555, 48612, 61669, 22498, 74726) c5(ao, Wo, bb, I, Zq, aF, q, asM, bh, at); #c1(RBMS2) c2(NP_002889) c3(9442) c4(35556, 48613, 61670, 22499, 74727) c5(ao); #c1(RBMS3) c2(NP_001003792) c3(9443) c4(35557, 48614, 61671, 22500, 74728) c5(by, en, iL, b, dB, wy, AA, hS, m, w, brZ, kY, rO, jy, bf, ai, bu, A, e, y, cy, oy, ed, co, aX, bw, bj, aEz, f, el, q, es, Vr, kz, mR, B, iv, Tk, QJ, u, nz, o, O, sz, fU, si, jE, ae, jh, bK, Ua, cs, v, j, J, T, bp, aj, fy, bb, are, ad, xx, fM, d, ao, KK, bm, Jh, ag, cz, jT, fl, QP, nU); #c1(RBMX2) c2(NP_057108) c3(9444) c4(35558, 48615, 61672, 22501, 74729) c5(iT); #c1(RBMX) c2(NP_001158275) c3(9445) c4(35559, 48616, 61673, 22502, 74730) c5(d, m, b, wn, fy, u, e); #c1(RBMXL2) c2(NP_055284) c3(9446) c4(35560, 48617, 61674, 22503, 74731) c5(am); #c1(RBMYIA1) c2(XP_011529738) c3(9447) c4(35561, 48618, 61675, 22504, 74732) c5(by, en, iL, am, dB, wy, AA, hS, w, brZ, kY, bw, jy, nU, ai, bu, A, e, y, cy, d, ed, co, aX, b, bj, aEz, f, el, q, es, Vr, kz, mR, B, iv, Tk, QJ, u, nz, o, O, sz, fU, si, jE, ae, m, bK, Ua, cs, v, j, J, P, cyJ, aj, fy, rO, aro, ad, xx, fM, ao, KK, wn, bm, Jh, yy, ag, cz, jT, fl, QP, T, NT); #c1(RBP1) c2(NP_001124464) c3(9448) c4(35562, 48619, 61676, 22505, 74733) c5(GD, B, b, X, rR, dB, A, bbB, O, fx, y, d, Ag, aX, ZB, Bc, f, PA, q, bu, cU, aFQ, FN, ar, oJ, cB, av, nR, u, nj, e, bk, nW, W, T, Mr, iA, jT, avq, wh, nV, bm, BU, ag, Af, i); #c1(RBP2) c2(NP_004155) c3(9449) c4(35563, 48620, 61677, 22506, 74734) c5(co, pp, b, q, jR, bu, fe, T, fy, cB, by, y); #c1(RBP3) c2(NP_002891) c3(9450) c4(35564, 48621, 61678, 22507, 74735) c5(g, aPI, YR, ax, nQ, bxC, cyK, ml, f, F, wf, P, bry, cB, wg, nE, nP, nR, nW, rn, dH); #c1(RBP4) c2(NP_006735) c3(9451) c4(35565, 48622, 61679, 22508, 74736) c5(dx, bL, gk, b, mz, ahS, MP, Ck, w, hM, ic, aM, gE, wf, bf, al, A, jQ, Ag, bQ, vr, pq, B, q, bu, aPA, nR, aq, aE, o, em, kF, I, ed, jz, du, v, dK, gv, ctp, P, dv, T, eX, gF, by, et, Ha, ao, cyM, bm, iT, cyL, mA, Af, fN, bh, aA, at, re, ap); #c1(RBPJ) c2(NP_005340) c3(9452) c4(35566, 48623, 61680, 22509, 74737) c5(jK, A, b, fr, w, O, Ob, fq, B, bu, y, u, cI, cV, aC, cyN, acv, v, J, dt, P, akX, UG, ca, by, jU, xd, bh, eG); #c1(RBPMS2) c2(NP_919248) c3(9453) c4(35567, 48624, 61681, 22510, 74738) c5(cyO, fM, b); #c1(RBSN) c2(NP_001289307) c3(9454) c4(35568, 48625, 61682, 22511, 74739) c5(A); #c1(RBX1) c2(NP_055063) c3(9455) c4(35569, 48626, 61683, 22512, 74740) c5(hh, bL, jE, E, b, q, dB, i, fx, bm, y); #c1(RC3H1) c2(NP_001287780) c3(9456) c4(35570, 48627, 61684, 22513, 74741) c5(m, gl, mW); #c1(RCAN1) c2(NP_001272318) c3(9457) c4(35571, 48628, 61685, 22514, 74742) c5(dx, bL, nU, b, cr, w, bb, U, dv, bhQ, Bc, AP, f, mx, mR, ans, hV, u, dh, o, ff, du, si, V, aC, sB, bp, dU, jo, KK, ar, aX, xx, jU, nV, uJ, aq, hT, HN, ih, cT, bk, bq, bbH); #c1(RCAN2) c2(NP_005813) c3(9458) c4(35572, 48629, 61686, 22515, 74743) c5(aq, ans, ld); #c1(RCBTB1) c2(XP_005266498) c3(9459) c4(35573, 48630, 61687, 22516, 74744) c5(fr, cT, nk, cy, ft); #c1(RCBTB2) c2(NP_001273759) c3(9460) c4(35574, 48631, 61688, 22517, 74745) c5(zZ, A, fO, B, ib); #c1(RCHY1) c2(NP_001009922) c3(9461) c4(35575, 48632, 61689, 22518, 74746) c5(A, aw, b, aC, pR, f, F, q, jo, B, u, ff); #c1(RCL1) c2(NP_001273629) c3(9462) c4(35576, 48633, 61690, 22519, 74747) c5(jH, awK, agl, cO); #c1(RCN1) c2(NP_002892) c3(9463) c4(35577, 48634, 61691, 22520, 74748) c5(Ag, A, B, bu, jo, T, Af, by, ff); #c1(RCN2) c2(NP_002893) c3(9464) c4(35578, 48635, 61692, 22521, 74749) c5(ld, b); #c1(RCOR1) c2(NP_055971) c3(9465) c4(35579, 48636, 61693, 22522, 74750) c5(nz, co, fl, cdr, aAl); #c1(RCSD1) c2(NP_443094) c3(9466) c4(35580, 48637, 61694, 22523, 74751) c5(t, di, cp); #c1(RCVRN) c2(NP_002894) c3(9467) c4(35581, 48638, 61695, 22524, 74752) c5(fU, aX, nQ, b, ml, f, TD, cyP, ow, cB, nE, cwA, nW); #c1(RD3) c2(NP_001158160) c3(9468) c4(35582, 48639, 61696, 22525, 74753) c5(bFu, nQ, alM, ml, ao, ea); #c1(RDH10) c2(NP_742034) c3(9469) c4(35583, 48640, 61697, 22526, 74754) c5(aV, dA, q, W, FN, T, fy, nR); #c1(RDH11) c2(NP_057110) c3(9470) c4(35584, 48641, 61698, 22527, 74755) c5(jT, A, q, B); #c1(RDH12) c2(NP_689656) c3(9471) c4(35585, 48642, 61699, 22528, 74756) c5(cyQ, fC, nQ, ml, f, cyR, Nx, yn, bnU, nR, aVC, nW); #c1(RDH14) c2(NP_065956) c3(9472) c4(35586, 48643, 61700, 22529, 74757) c5(U, V, b); #c1(RDH16) c2(NP_003699) c3(9473) c4(35587, 48644, 61701, 22530, 74758) c5(iA); #c1(RDH5) c2(NP_002896) c3(9474) c4(35588, 48645, 61702, 22531, 74759) c5(Pa, Od, cas, dV, z, aTd, aW, nQ, ml, dZ, as, I, an, nW, aVB, SF, et, bnU, pk, ayr, Bu, nE); #c1(RDH8) c2(NP_056540) c3(9475) c4(35589, 48646, 61703, 22532, 74760) c5(ea, Bu, nQ); #c1(RDM1) c2(NP_001030008) c3(9476) c4(35590, 48647, 61704, 22533, 74761) c5(ac); #c1(RDX) c2(NP_001247421) c3(9477) c4(35591, 48648, 61705, 22534, 74762) c5(A, b, EM, hg, z, bw, O, it, js, jd, gB, qr, bu, B, u, ly, by, cyS, bq, BV, iY, Bx, ji, bT, y); #c1(REC8) c2(NP_001041670) c3(9478) c4(35592, 48649, 61706, 22535, 74763) c5(cr, NT, A, aX, wn); #c1(RECK) c2(NP_066934) c3(9479) c4(35593, 48650, 61707, 22536, 74764) c5(by, A, aw, b, X, gG, cv, w, bw, bW, U, hP, e, y, d, m, co, cy, kJ, re, B, q, bu, fr, ar, O, cs, av, fy, u, R, yJ, fs, V, iI, cV, aC, nl, bp, ad, T, fO, x, fx, ft, ao, Jz, i, ji); #c1(RECQL5) c2(NP_001003715) c3(9480) c4(35594, 48651, 61708, 22537, 74765) c5(GD, V, b, wU, fr, f, QY, ad, dt, ag, rR, cs, U, ft); #c1(RECQL) c2(XP_006719196) c3(9481) c4(35595, 48652, 61709, 22538, 74766) c5(GD, fl, axq, b, X, w, bw, f, F, fr, ar, rR, fv, av, bm, wU, ft, dt, T, iw, ast, ag); #c1(REEP1) c2(NP_001158202) c3(9482) c4(35596, 48653, 61710, 22539, 74767) c5(Ma, cyT, ajl, v, cyU, bN, eD, bG, vL); #c1(REEP2) c2(NP_001258732) c3(9483) c4(35597, 48654, 61711, 22540, 74768) c5(cyV, bN); #c1(REEP3) c2(NP_001001330) c3(9484) c4(35598, 48655, 61712, 22541, 74769) c5(bg, bgW, cz); #c1(REEP5) c2(NP_005660) c3(9485) c4(35599, 48656, 61713, 22542, 74770) c5(d, co, bb, V, b, X, e, q, bp, aN, cA, Ce, x, et, U, jT, av, o, ap); #c1(REEP6) c2(NP_612402) c3(9486) c4(35600, 48657, 61714, 22543, 74771) c5(jH, cs, fP, b, ad); #c1(REG1A) c2(NP_002900) c3(9487) c4(35601, 48658, 61715, 22544, 74772) c5(B, JH, dB, bf, O, zi, kJ, bJm, bze, mm, aC, bp, ft, Lw, fx, YY, fp, fc, aFB, OJ, yE, bk, aA, bT, X, jz, ig, ix, aJE, U, Oh, y, co, f, bu, iv, av, fy, bm, jB, Gl, V, ze, v, aNO, pJ, JY, W, aKy, aKw, aox, bn, b, bxd, Og, ey, q, jV, ar, ff, HE, u, aE, ri, da, I, by, agl, jH, ao, akp, Mp, C, acE, A, k, fr, gn, jc, di, lv, iL, buk, jQ, o, aX, M, ik, n, cB, aV, fU, cV, J, dt, P, T, ll, pF, aM, aeq, fP); #c1(REG1B) c2(NP_006498) c3(9488) c4(35602, 48659, 61716, 22545, 74773) c5(fP, aE, I); #c1(REG3A) c2(NP_620355) c3(9489) c4(35603, 48660, 61717, 22546, 74774) c5(bP, vq, f, b, jE, eu, w, yn, cO, bf, U, aoK, zY, aX, yE, bn, wG, re, ak, q, iT, cs, as, bm, zW, o, da, jB, V, I, an, ju, J, ad, W, T, Hh, yA, aM, cyW, eK, ag, bk, aA, jl, wT); #c1(RELA) c2(NP_001138610) c3(9490) c4(35604, 48661, 61718, 22547, 74775) c5(en, DT, w, bf, O, oU, xl, dv, cy, kJ, gB, e, wv, cl, jq, azx, oP, g, lb, fO, gm, bp, iU, nV, x, jE, qt, fN, ag, cT, fO, pt, rn, asL, X, vD, jz, lW, bw, U, y, f, bu, B, iv, av, bm, iT, yJ, V, Bs, bd, bt, BV, pi, xd, jR, oM, hc, ck, b, aE, dk, oi, ic, ey, d, jh, bb, lz, fv, re, hV, q, dQ, pB, ar, u, o, fh, iP, fs, I, gL, by, Fo, xq, aGn, Fk, et, jU, jH, ao, axM, aAs, ch, eQ, fl, Mp, hd, de, A, fr, di, lv, brx, yw, jQ, m, aX, fq, h, F, aC, ik, n, aV, aq, ma, cV, hZ, dB, J, bEC, T, j, XO, azY, aM, ii, Jh, fP, bh, eG); #c1(RELB) c2(NP_006500) c3(9491) c4(35605, 48662, 61719, 22548, 74776) c5(A, aC, aF, f, q, fO, B, cU, cc, cT, aGn, fq, et, O, MP, u, aE, y, at); #c1(REL) c2(NP_001278675) c3(9492) c4(35606, 48663, 61720, 22549, 74777) c5(JH, b, N, ig, y, m, jl, ag, fq, F, azx, fH, u, oN, da, aC, be, gm, fO, T, aGn, jT, fJ, aph, yG, jH, hX, xe, Ot, cT, pJ, ll); #c1(RELN) c2(NP_005036) c3(9493) c4(35607, 48664, 61721, 22550, 74778) c5(gK, en, aw, nX, dj, aN, hS, FT, hM, z, bw, xw, aK, y, oy, Wk, ak, q, bu, iZ, cs, aV, u, o, cyX, hW, il, FR, qA, cz, cV, Lw, by, rQ, f, dk, hT, he, ag, dc); #c1(REM1) c2(NP_054731) c3(9494) c4(35608, 48665, 61722, 22551, 74779) c5(b, ami, cA, wf, bf, aO, ayB, f, bu, NJ, do, vu, Ex, cM, aM, dj, hW, alX, bHs, el, by, xk, bt, cyY, aY, ih, bAQ, dc, aA, at, FY); #c1(RENBP) c2(NP_002901) c3(9495) c4(35609, 48666, 61723, 22552, 74780) c5(bP, bL, b, k, qz, jz, AA, w, di, dx, hW, wf, bf, ey, bu, aK, pI, aW, jQ, m, qs, dv, bb, yQ, re, f, alz, q, LP, mR, cM, fH, pq, bm, aE, iT, wR, si, i, I, du, gJ, v, by, bvH, fx, et, fJ, aM, eH, ao, alt, bSB, Nm, Ck, vH, Ol, bq, aA, at, alw); #c1(REN) c2(NP_000528) c3(9496) c4(35610, 48667, 61724, 22553, 74781) c5(ek, dx, dM, dN, dD, vH, ctB, jw, eC, w, cO, bf, eD, xl, gO, vr, dv, va, t, eQ, wv, mR, gP, et, Hs, gl, avP, cc, mz, asd, fe, xc, sH, du, gJ, dB, vG, sV, Nz, sW, bSt, hR, xx, su, pq, eH, abS, f, dS, wK, clS, tO, we, oi, vK, fz, dc, vJ, bq, aA, bT, bP, ug, ux, id, td, iF, iP, hS, ob, Ni, iG, IW, MN, U, OJ, A, cM, V, AD, sT, aqK, cK, aoW, UV, bu, li, B, czb, cp, fY, em, GI, MH, bbq, kZ, v, cd, eX, Hh, qD, sP, W, uM, Fz, aY, Fu, er, fw, uK, gA, JO, cf, zS, ll, aEg, uy, b, Xv, eR, tV, vY, uk, sU, z, ey, fD, aO, bLL, aoa, xi, bb, Sl, eA, wd, oB, MV, ap, mL, DZ, uz, aLV, sK, u, dh, o, fh, da, sz, jj, JP, I, Mi, Fw, bc, by, bkX, dO, uw, bbl, uf, vs, hU, ch, DR, aJy, aE, ih, fl, I, wR, nc, sF, bL, hq, sO, sv, mW, aOv, di, jR, bWE, wf, al, sx, vl, cyZ, qs, cr, wp, sG, tL, h, XQ, ami, cza, iZ, y, aic, aeP, te, fU, hW, tP, m, Nc, sj, J, pv, dt, P, uF, MK, gF, pF, aM, iz, MF, ta, lc, G, bh, at, gf, MQ); #c1(REPS1) c2(NP_001122089) c3(9497) c4(35611, 48668, 61725, 22554, 74782) c5(A, fs, b, ag, f, J, hS, co, B, i, fx, fy, u); #c1(REPS2) c2(NP_001074444) c3(9498) c4(35612, 48669, 61726, 22555, 74783) c5(A, B, fy, u, y, jx); #c1(RERG) c2(NP_001177655) c3(9499) c4(35613, 48670, 61727, 22556, 74784) c5(b, T, i, I, u, y); #c1(RERGL) c2(NP_079006) c3(9500) c4(35614, 48671, 61728, 22557, 74785) c5(qf, u, U, y, V); #c1(REST) c2(NP_001180437) c3(9501) c4(35615, 48672, 61729, 22558, 74786) c5(KS, A, aw, b, X, hS, w, fH, bb, cA, O, xw, aW, jR, co, aX, f, es, mR, aO, HE, av, u, dh, fh, g, fU, si, cV, nz, Fs, v, T, auw, bSf, hR, fJ, aq, fw, B, y); #c1(RET) c2(NP_065681) c3(9502) c4(35616, 48673, 61730, 22559, 74787) c5(dx, aw, EM, HC, hM, iq, pz, aTh, Hq, aJm, dl, FN, bfB, fH, bzz, g, fe, bK, du, aow, bp, azo, auH, ahO, HR, aCr, vz, pb, xO, Lz, BX, aJI, DO, ag, oi, i, btv, aAp, Dr, cze, QF, Jy, X, Ev, ahS, eu, bw, U, qW, azq, y, tp, co, ip, yE, f, N, bu, cs, fy, bjY, if, Bd, V, aub, qq, bjS, QP, ny, mD, VP, fJ, YU, DE, dt, uM, anG, nc, jR, bjZ, tl, ji, ale, b, ahP, dk, A, ic, vn, fD, ec, Yj, jF, hV, ra, czf, ar, RF, hb, fv, Gj, u, fh, VD, czc, cyp, wV, ad, QK, Sq, czd, Vw, auA, aaK, et, jG, aCq, nV, hX, aCp, ON, wP, fg, bka, I, D, yo, QU, KC, Qv, gw, pD, og, di, aud, bj, Ld, m, aX, LI, Tq, h, aBd, yx, gT, Ir, aW, sV, aAS, Tl, aq, czg, fU, si, Sv, cV, YR, KN, J, W, T, aig, nP, by, ac, wU, qp, ce, cnj, ao, Fl, Dt, aMp, Yv, Bi); #c1(RETN) c2(NP_001180303) c3(9503) c4(35617, 48674, 61731, 22560, 74788) c5(dx, bL, Qv, bW, b, ug, z, gn, Hj, rd, dv, hM, jJ, cO, bf, U, ey, y, gO, oy, vr, co, bb, dN, jP, cK, f, cy, cd, om, sO, sK, u, em, be, kF, V, I, m, aC, du, cx, gL, vF, P, bQ, od, eX, bh, x, Hh, gF, hR, et, bq, jU, aM, tS, tm, ii, mz, dS, fN, bY, vH, rv, Hd, di, aA, at, fD, ap); #c1(RETNLB) c2(NP_115968) c3(9504) c4(35618, 48675, 61732, 22561, 74789) c5(dx, LR, cy, Kt, du, DM, J, gd, dv, aZ, x, gg, jU); #c1(RETSAT) c2(NP_060220) c3(9505) c4(35619, 48676, 61733, 22562, 74790) c5(fQ); #c1(REV1) c2(NP_001032961) c3(9506) c4(35620, 48677, 61734, 22563, 74791) c5(asL, iw, hV, nV, b, jd, re, f, e, cW, cT, hN, T, co, pt, oM, av, u, WN, iT, d); #c1(REV3L) c2(NP_001273361) c3(9507) c4(35621, 48678, 61735, 22564, 74792) c5(da, f, iP, iG, b, brj, gm, cT, co, T, O, i, cs, u, y); #c1(REX01) c2(NP_065746) c3(9508) c4(35622, 48679, 61736, 22565, 74793) c5(Dr, A, kF, b, IO, B, jz, Uq, w, ff, HE, Mn, O, jQ); #c1(REX02) c2(NP_056338) c3(9509) c4(35623, 48680, 61737, 22566, 74794) c5(tp, co, aw, b, fO, ar, cs, ji, zY, u, y); #c1(REX04) c2(NP_001266278) c3(9510) c4(35624, 48681, 61738, 22567, 74795) c5(cr, bb); #c1(RFC1) c2(NP_001191676) c3(9511) c4(35625, 48682, 61739, 22568, 74796) c5(lJ, A, b, fr, iX, di, sF, jy, e, U, ps, yw, y, d, jT, bb, QO, jd, t, f, F, bu, ar, tE, cB, nA, aV, u, o, g, V, aC, ft, G, T, x, cr, fx, by, et, Ut, aph, fy, aq, xe, iT, i, xf); #c1(RFC2) c2(NP_002905) c3(9512) c4(35626, 48683, 61740, 22569, 74797) c5(cy, I, cV, fr, eX, MP, ft, aW, i, aA, aV, u, y, alM); #c1(RFC3) c2(NP_002906) c3(9513) c4(35627, 48684, 61741, 22570, 74798) c5(bb, V, b, py, nJ, i, at, o); #c1(RFC4) c2(NP_853551) c3(9514) c4(35628, 48685, 61742, 22571, 74799) c5(w, aV, q, i); #c1(RFC5) c2(NP_001123584) c3(9515) c4(35629, 48686, 61743, 22572, 74800) c5(aV, i); #c1(RFFL) c2(NP_001017368) c3(9516) c4(35630, 48687, 61744, 22573, 74801) c5(do); #c1(RFK) c2(NP_060809) c3(9517) c4(35631, 48688, 61745, 22574, 74802) c5(A); #c1(RFPL1) c2(NP_066306) c3(9518) c4(35632, 48689, 61746, 22575, 74803) c5(aRr, eO); #c1(RFT1) c2(NP_443091) c3(9519) c4(35633, 48690, 61747, 22576, 74804) c5(KC, bf, eq, czh, aM); #c1(RFTN1) c2(NP_055965) c3(9520) c4(35634, 48691, 61748, 22577, 74805) c5(wh, er, ad, oJ, cs, aA, iK); #c1(RFTN2) c2(NP_653230) c3(9521) c4(35635, 48692, 61749, 22578, 74806) c5(Eo); #c1(RFWD2) c2(NP_001001740) c3(9522) c4(35636, 48693, 61750, 22579, 74807) c5(ao, aw, b, qL, h, f, jf, q, bu, by, ag, do, ar, gE, cz, u, y); #c1(RFWD3) c2(NP_060594) c3(9523) c4(35637, 48694, 61751, 22580, 74808) c5(fl, Lt); #c1(RFX1) c2(NP_002909) c3(9524) c4(35638, 48695, 61752, 22581, 74809) c5(m, Pu, b, jR, fc, MW, Xn, q, mW, Xl, eu, w, ar, O, aV, u, gl, y, TD); #c1(RFX2) c2(NP_000626) c3(9525) c4(35639, 48696, 61753, 22582, 74810) c5(ayZ); #c1(RFX3) c2(NP_001269046) c3(9526) c4(35640, 48697, 61754, 22583, 74811) c5(mk, at, Pz, awX); #c1(RFX4) c2(NP_001193620) c3(9527) c4(35641, 48698, 61755, 22584, 74812) c5(ak); #c1(RFX5) c2(NP_001020774) c3(9528) c4(35642, 48699, 61756, 22585, 74813) c5(czi, dx, dv, V, czj, du, Xn, Xl, bJU, aW); #c1(RFX6) c2(NP_775831) c3(9529) c4(35643, 48700, 61757, 22586, 74814) c5(A, aX, mB, B, bf, czk, aM); #c1(RFX8) c2(NP_001139136) c3(9530) c4(35644, 48701, 61758, 22587, 74815) c5(oy, qf); #c1(RFXANK) c2(NP_001265656) c3(9531) c4(35645, 48702, 61759, 22588, 74816) c5(czl, CV, Xn, Xl, eu); #c1(RFXAP) c2(NP_000529) c3(9532) c4(35646, 48703, 61760, 22589, 74817) c5(eu, Xn, bb, Xl, czm); #c1(RGCC) c2(NP_054778) c3(9533) c4(35647, 48704, 61761, 22590, 74818) c5(f, b, k, X, O, co, fy, fq, hV, jV, HY, ff, cB, cs, Hs, u, lb, J, ad, W, T, x, jT, nV, ag, cT, at, y); #c1(RGL1) c2(NP_001284598) c3(9534) c4(35648, 48705, 61762, 22591, 74819) c5(alF); #c1(RGL2) c2(NP_004752) c3(9535) c4(35649, 48706, 61763, 22592, 74820) c5(m, kJ); #c1(RGL4) c2(NP_705843) c3(9536) c4(35650, 48707, 61764, 22593, 74821) c5(dZ, dV, b, dX); #c1(RGMA) c2(NP_001159755) c3(9537) c4(35651, 48708, 61765, 22594, 74822) c5(oy, bP, aY, ds, fD, aV); #c1(RGMB) c2(NP_001012779) c3(9538) c4(35652, 48709, 61766, 22595, 74823) c5(aC, u, y); #c1(RGN) c2(NP_004674) c3(9539) c4(35653, 48710, 61767, 22596, 74824) c5(gK, A, gt, b, aY, ch, amK, B, q, eH, bm, y, dc, et, u, cM); #c1(RGPD2) c2(NP_001071638) c3(9540) c4(35654, 48711, 61768, 22597, 74825) c5(b, hX, h, jG, J, M, P, n, iv, av, ci); #c1(RGR) c2(NP_001012738) c3(9541) c4(35655, 48712, 61769, 22598, 74826) c5(nQ, Pv, ml, czn, dZ, dX, VT, nR, nW, aW, dV); #c1(RGS10) c2(NP_001005339) c3(9542) c4(35656, 48713, 61770, 22599, 74827) c5(d, BX, b, X, f, ip, zM, akg, ny, cs, av, ad, e, aW); #c1(RGS11) c2(NP_003825) c3(9543) c4(35657, 48714, 61771, 22600, 74828) c5(d, BX, ip, nl, ny, e); #c1(RGS12) c2(NP_937870) c3(9544) c4(35658, 48715, 61772, 22601, 74829) c5(d, bb, BX, ip, ny, e); #c1(RGS13) c2(NP_002918) c3(9545) c4(35659, 48716, 61773, 22602, 74830) c5(d, BX, ip, Vy, ny, jT, e); #c1(RGS14) c2(NP_006471) c3(9546) c4(35660, 48717, 61774, 22603, 74831) c5(d, BX, ip, ny, aV, e); #c1(RGS16) c2(NP_002919) c3(9547) c4(35661, 48718, 61775, 22604, 74832) c5(d, BX, ip, cV, hP, ag, T, ny, U, u, e, V); #c1(RGS17) c2(XP_011534055) c3(9548) c4(35662, 48719, 61776, 22605, 74833) c5(oy, co, i, X, bp, xq, A, cO, I, av, u, y); #c1(RGS18) c2(NP_570138) c3(9549) c4(35663, 48720, 61777, 22606, 74834) c5(d, BX, ip, Vy, ny, jT, e); #c1(RGS19) c2(XP_011526788) c3(9550) c4(35664, 48721, 61778, 22607, 74835) c5(cs, ad); #c1(RGS1) c2(NP_002913) c3(9551) c4(35665, 48722, 61779, 22608, 74836) c5(d, jT, e, Pz, BX, b, ig, fr, jz, ip, mk, jQ, lv, ny, gj, aX, aV, aE, dH); #c1(RGS20) c2(NP_003693) c3(9552) c4(35666, 48723, 61780, 22609, 74837) c5(d, BX, ip, di, ny, e); #c1(RGS21) c2(NP_001034241) c3(9553) c4(35667, 48724, 61781, 22610, 74838) c5(ig, yo); #c1(RGS22) c2(NP_001273621) c3(9554) c4(35668, 48725, 61782, 22611, 74839) c5(d, il, BX, b, ip, ny, ik, tl, e); #c1(RGS2) c2(NP_002914) c3(9555) c4(35669, 48726, 61783, 22612, 74840) c5(dx, bAS, A, aw, k, X, tR, eH, di, wX, U, bj, fx, cM, oy, qs, dv, ip, h, f, e, bu, B, hb, fH, aV, u, tQ, d, JB, si, V, du, eX, ny, zf, akK, fJ, bdu, to, dO, bBt, BX, czo, ih, jN, i, Rj, aA, ap); #c1(RGS3) c2(NP_001263190) c3(9556) c4(35670, 48727, 61784, 22613, 74841) c5(d, BX, ip, ny, cO, e, O); #c1(RGS4) c2(NP_001095915) c3(9557) c4(35671, 48728, 61785, 22614, 74842) c5(fl, di, cO, cA, O, e, y, d, lz, ip, ak, bwb, cM, u, o, hW, cV, ny, bdw, fx, jv, to, KK, BX, tW, he, jN, i, eG); #c1(RGS5) c2(NP_001241677) c3(9558) c4(35672, 48729, 61786, 22615, 74843) c5(dx, aw, b, dB, HC, di, cO, e, d, qs, aX, ip, ak, q, jF, av, bm, YR, du, jo, ny, jE, BX, i, I); #c1(RGS6) c2(NP_001191346) c3(9559) c4(35673, 48730, 61787, 22616, 74844) c5(B, b, k, EM, dB, A, di, cC, y, co, iy, aeF, fq, h, nU, q, cxX, WO, cjv, ff, jG, fy, u, kP, V, Fs, dt, IG, iD, fx, US, f, Le, ag, zO, i, I, ji, aA, iu); #c1(RGS7BP) c2(NP_001025046) c3(9560) c4(35674, 48731, 61788, 22617, 74845) c5(tY, cy, aCU); #c1(RGS7) c2(NP_001269702) c3(9561) c4(35675, 48732, 61789, 22618, 74846) c5(d, at, BX, ip, nU, tR, ny, wX, aV, e); #c1(RGS8) c2(XP_005245612) c3(9562) c4(35676, 48733, 61790, 22619, 74847) c5(d, BX, ip, ny, e, Up); #c1(RGS9BP) c2(NP_997274) c3(9563) c4(35677, 48734, 61791, 22620, 74848) c5(dx, lb, KU, czp, HX, du, HV); #c1(RGS9) c2(NP_001075424) c3(9564) c4(35678, 48735, 61792, 22621, 74849) c5(to, de, lb, bb, BX, ip, HX, du, cV, e, czp, ny, HV, bq, dx, d); #c1(RGSL1) c2(NP_001131141) c3(9565) c4(35679, 48736, 61793, 22622, 74850) c5(u, o, y); #c1(RHAG) c2(NP_000315) c3(9566) c4(35680, 48737, 61794, 22623, 74851) c5(sG, czr, cfU, czq); #c1(RHBDD2) c2(NP_001035546) c3(9567) c4(35681, 48738, 61795, 22624, 74852) c5(aw, V, f, U, u, y); #c1(RHBDD3) c2(NP_036397) c3(9568) c4(35682, 48739, 61796, 22625, 74853) c5(iF, lV); #c1(RHBDF1) c2(NP_071895) c3(9569) c4(35683, 48740, 61797, 22626, 74854) c5(d, by, V, b, qL, bu, ag, ar, cs, U, ad, u, e, y, pp); #c1(RHBDF2) c2(NP_001005498) c3(9570) c4(35684, 48741, 61798, 22627, 74855) c5(b, X, aNH, kB, bCz, baW, e, y, d, pw, czs, q, ik, n, av, u, il, cV, be, dB, T, iB, ci); #c1(RHBDL1) c2(NP_001265649) c3(9571) c4(35685, 48742, 61799, 22628, 74856) c5(aw, cO); #c1(RHBDL2) c2(NP_001291675) c3(9572) c4(35686, 48743, 61800, 22629, 74857) c5(ho, A); #c1(RHCE) c2(XP_011540191) c3(9573) c4(35687, 48744, 61801, 22630, 74858) c5(CY, aX, lz, ae, qv, czu, czt, qM, qt, yb, auc, yA); #c1(RHCG) c2(XP_011519965) c3(9574) c4(35688, 48745, 61802, 22631, 74859) c5(aY); #c1(RHEB) c2(NP_005605) c3(9575) c4(35689, 48746, 61803, 22632, 74860) c5(jT, A, aX, iy, EM, B, T, DP, i, bf, ey, fy, aM); #c1(RHEBL1) c2(NP_653194) c3(9576) c4(35690, 48747, 61804, 22633, 74861) c5(pR); #c1(RHNO1) c2(NP_001239428) c3(9577) c4(35691, 48748, 61805, 22634, 74862) c5(u, y); #c1(RHOB) c2(NP_004031) c3(9578) c4(35692, 48749, 61806, 22635, 74863) c5(d, czv, aX, V, b, X, f, e, q, j, bu, w, T, bp, A, ji, nV, av, u, U, y); #c1(RHOBTB1) c2(XP_011538726) c3(9579) c4(35693, 48750, 61807, 22636, 74864) c5(d, cs, e, ad); #c1(RHOBTB2) c2(NP_001153508) c3(9580) c4(35694, 48751, 61808, 22637, 74865) c5(by, qU, b, qL, Pv, be, F, fO, bu, T, ac, i, di, fx, czw, u, y); #c1(RHOBTB3) c2(NP_055714) c3(9581) c4(35695, 48752, 61809, 22638, 74866) c5(oy, bf); #c1(RHOD) c2(NP_055393) c3(9582) c4(35696, 48753, 61810, 22639, 74867) c5(A, aw, b, X, dB, w, yn, y, aeQ, MT, bb, uj, f, q, gT, ar, B, av, fy, u, nW, g, aC, ui, bd, cz, T, aX, jE, bm, cT, nE, afd); #c1(RHOF) c2(NP_061907) c3(9583) c4(35697, 48754, 61811, 22640, 74868) c5(bDM, jT, ae, LX, yh, iU, bci, ccq, eW, P, ciS, CX); #c1(RHOG) c2(XP_005252973) c3(9584) c4(35698, 48755, 61812, 22641, 74869) c5(P); #c1(RHOH) c2(NP_001265298) c3(9585) c4(35699, 48756, 61813, 22642, 74870) c5(cy, Aa, h, gm, fO, cT, pu, Dc, as, fH, jT, iu, fJ, zD); #c1(RHO) c2(NP_000530) c3(9586) c4(35700, 48757, 61814, 22643, 74871) c5(A, b, X, czy, dB, bgm, ea, w, yn, wf, aW, aeQ, MT, aX, uj, ml, f, q, nv, gT, ar, B, nW, av, nR, u, czA, bk, g, bm, cB, nQ, cV, aC, ui, v, bd, dt, T, bb, bnU, cz, bFv, jE, fy, ayr, Bt, czx, czz, cT, cas, apy, nE, Bj, afd); #c1(RHOJ) c2(NP_065714) c3(9587) c4(35701, 48758, 61815, 22644, 74872) c5(b, pS, beL, pr, cK, x, auD, jT); #c1(RHOQ) c2(NP_036381) c3(9588) c4(35702, 48759, 61816, 22645, 74873) c5(U, I, V, b); #c1(RHOT1) c2(NP_001028738) c3(9589) c4(35703, 48760, 61817, 22646, 74874) c5(ao, bj); #c1(RHOU) c2(NP_067028) c3(9590) c4(35704, 48761, 61818, 22647, 74875) c5(d, aX, aeM, b, eG, bj, in, bu, ic, cO, by, u, e, y); #c1(RHOV) c2(NP_598378) c3(9591) c4(35705, 48762, 61819, 22648, 74876) c5(yq, OJ, cV, te); #c1(RHOXF1) c2(NP_644811) c3(9592) c4(35706, 48763, 61820, 22649, 74877) c5(b); #c1(RHOXF2) c2(NP_115887) c3(9593) c4(35707, 48764, 61821, 22650, 74878) c5(by, J, b, bu); #c1(RHPN1) c2(NP_443156) c3(9594) c4(35708, 48765, 61822, 22651, 74879) c5(kF); #c1(RHPN2) c2(NP_149094) c3(9595) c4(35709, 48766, 61823, 22652, 74880) c5(w, V, O); #c1(RIBC2) c2(NP_056468) c3(9596) c4(35710, 48767, 61824, 22653, 74881) c5(u); #c1(RIC1) c2(NP_001129392) c3(9597) c4(35711, 48768, 61825, 22654, 74882) c5(bj); #c1(RIC3) c2(NP_001128581) c3(9598) c4(35712, 48769, 61826, 22655, 74883) c5(aV, cV); #c1(RICTOR) c2(NP_001272368) c3(9599) c4(35713, 48770, 61827, 22656, 74884) c5(jR, A, aw, BX, ip, B, q, gL, ar, O, ny, aBz, iK); #c1(RIF1) c2(NP_001171134) c3(9600) c4(35714, 48771, 61828, 22657, 74885) c5(do, fs); #c1(RILP) c2(NP_113618) c3(9601) c4(35715, 48772, 61829, 22658, 74886) c5(czB); #c1(RILPL1) c2(NP_847884) c3(9602) c4(35716, 48773, 61830, 22659, 74887) c5(oy); #c1(RIMBP2) c2(NP_056162) c3(9603) c4(35717, 48774, 61831, 22660, 74888) c5(co, q, by, cB, fy, bu, o); #c1(RIMBP3C) c2(NP_001122105) c3(9604) c4(35718, 48775, 61832, 22661, 74889) c5(m); #c1(RIMS1) c2(NP_001161879) c3(9605) c4(35719, 48776, 61833, 22662, 74890) c5(nR, ml, blV, nv, aVB, at, nW, aW); #c1(RIMS2) c2(NP_001093587) c3(9606) c4(35720, 48777, 61834, 22663, 74891) c5(lY, pm, B, aw, aN, bgd, bf, aK, ca, xl, b, lZ, t, ji, gl, apz, fe, lb, cs, gm, fl, od, fx, jT, OA, cq, wh, Pc, agm, i, pt, bT, X, eu, mk, aCB, lW, bw, ai, y, co, f, aaZ, iv, oD, av, fy, bm, awe, iF, NZ, V, qq, v, alM, aYm, in, vH, oM, jP, kD, ck, am, aF, AA, KN, Lq, ey, jh, re, nU, q, jV, Kz, jG, u, il, ad, G, bUg, Nh, jU, ao, nV, kB, mA, Au, fj, A, k, mW, qY, eM, hP, U, dl, m, aX, I, fq, h, aBd, M, aC, ik, oJ, cB, fU, si, nQ, cV, Fs, J, P, T, ll, aj, fM, aM, wU, Lc, cjq, Oi, bM); #c1(RIMS4) c2(NP_001192246) c3(9607) c4(35721, 48778, 61835, 22664, 74892) c5(arm); #c1(RIN1) c2(NP_004283) c3(9608) c4(35722, 48779, 61836, 22665, 74893) c5(d, fe, aX, b, q, jV, ad, ar, cs, aw, ji, u, e, y, JY); #c1(RIN2) c2(NP_001229510) c3(9609) c4(35723, 48780, 61837, 22666, 74894) c5(jE, bb, czC, bm, eX, q, P, od, n, XH, u, O, mo); #c1(RIN3) c2(NP_079108) c3(9610) c4(35724, 48781, 61838, 22667, 74895) c5(bdT, bZ); #c1(RING1) c2(NP_002922) c3(9611) c4(35725, 48782, 61839, 22668, 74896) c5(dl, ag, A, aw, BX, ip, kJ, B, dB, lR, lX, m, lS, ff, ny, jl, aE, sK); #c1(RINT1) c2(NP_068749) c3(9612) c4(35726, 48783, 61840, 22669, 74897) c5(Ce, u, y, b); #c1(RIOK1) c2(NP_113668) c3(9613) c4(35727, 48784, 61841, 22670, 74898) c5(bw, w); #c1(RIOK2) c2(NP_001153221) c3(9614) c4(35728, 48785, 61842, 22671, 74899) c5(gA, w, di, sH); #c1(RIOK3) c2(NP_003822) c3(9615) c4(35729, 48786, 61843, 22672, 74900) c5(bw, fv); #c1(RIPK1) c2(NP_003795) c3(9616) c4(35730, 48787, 61844, 22673, 74901) c5(en, ER, b, nF, eu, czD, w, C, bf, U, A, y, jl, h, f, F, X, av, fy, u, fs, V, aC, gm, gL, lJ, T, bp, yW, aM, cf, ag); #c1(RIPK2) c2(NP_003812) c3(9617) c4(35731, 48788, 61845, 22674, 74902) c5(dx, A, lr, b, k, eu, tR, aCD, m, au, aCB, dV, O, wX, U, bu, hP, iK, az, dv, cy, DG, hV, hB, es, acO, DC, dZ, ar, B, fy, cl, g, si, V, I, cV, du, gm, gL, by, T, bp, mD, jT, pi, fM, jH, acN, tW, OJ, ih, ag, fP, Bm, zS, yq, Gn, jU, ap); #c1(RIPK3) c2(NP_006862) c3(9618) c4(35732, 48789, 61846, 22675, 74903) c5(dx, Bg, du, en, jl, nQ, vd, nF, wG, f, bp, dv, cT, w, fP, C, mm, ceF, aA, fU); #c1(RIPK4) c2(NP_065690) c3(9619) c4(35733, 48790, 61847, 22676, 74904) c5(bTp, Vx, gm, czD, czE, at, ag); #c1(RIPPLY2) c2(NP_001009994) c3(9620) c4(35734, 48791, 61848, 22677, 74905) c5(Yj); #c1(RIT1) c2(NP_001243749) c3(9621) c4(35735, 48792, 61849, 22678, 74906) c5(jE, zi, cr, czF, b, bm, J, q, GF, AP); #c1(RIT2) c2(NP_001259006) c3(9622) c4(35736, 48793, 61850, 22679, 74907) c5(aw, I, dA, C, gE, dB, vQ, aC, jo, GF, aA, z, mD, aI, apD, bj, dh, gT); #c1(RITA1) c2(NP_001273144) c3(9623) c4(35737, 48794, 61851, 22680, 74908) c5(nV, b, cV, h, J, fO, es, cT, fv, u, y); #c1(RLBP1) c2(XP_011520172) c3(9624) c4(35738, 48795, 61852, 22681, 74909) c5(nR, nQ, Pa, ml, czG, apy, cas, dX, et, nE, aTd, bnU, czH, nW, rn); #c1(RLF) c2(XP_011540196) c3(9625) c4(35739, 48796, 61853, 22682, 74910) c5(fU, KM); #c1(RLIM) c2(NP_899196) c3(9626) c4(35740, 48797, 61854, 22683, 74911) c5(A); #c1(RLN1) c2(NP_008842) c3(9627) c4(35741, 48798, 61855, 22684, 74912) c5(A, b, Lv, wy, nV, di, u, y); #c1(RLN2) c2(NP_005050) c3(9628) c4(35742, 48799, 61856, 22685, 74913) c5(nV, f, b, hV, A, bq, u, y); #c1(RLN3) c2(NP_543140) c3(9629) c4(35743, 48800, 61857, 22686, 74914) c5(f, at); #c1(RMDN1) c2(NP_001273648) c3(9630) c4(35744, 48801, 61858, 22687, 74915) c5(A, b, aF, cbK, w, cO, U, e, y, d, aX, f, q, B, av, dh, o, V, GS, gm, v, P, iy, Yl, HN, ag, amu); #c1(RMDN2) c2(NP_001164263) c3(9631) c4(35745, 48802, 61859, 22688, 74916) c5(A, aF, cbK, w, cO, e, y, d, aX, t, B, q, aW, av, dh, o, GS, v, Yl, P, iy, jT, f, HN, G, ag, amu, i, I); #c1(RMDN3) c2(NP_001291731) c3(9632) c4(35746, 48803, 61860, 22689, 74917) c5(A, b, aF, cbK, w, cO, O, e, y, d, aX, h, f, q, B, av, dh, o, GS, v, Yl, P, T, iy, aen, HN, ag, amu, tl); #c1(RMI1) c2(XP_011517336) c3(9633) c4(35747, 48804, 61861, 22690, 74918) c5(A, aX, V, b, fj, h, ic, bb, U, hD, ci, n); #c1(RMI2) c2(NP_689521) c3(9634) c4(35748, 48805, 61862, 22691, 74919) c5(bf, at, BL, f, aE); #c1(RMND1) c2(NP_001258866) c3(9635) c4(35749, 48806, 61863, 22692, 74920) c5(cK, hT, gm, czl); #c1(RNASE11) c2(NP_660293) c3(9636) c4(35750, 48807, 61864, 22693, 74921) c5(aVr); #c1(RNASE12) c2(NP_001019993) c3(9637) c4(35751, 48808, 61865, 22694, 74922) c5(cr, alX, dD, nU, cz, cT, bjb, aA, oG); #c1(RNASE13) c2(NP_001012264) c3(9638) c4(35752, 48809, 61866, 22695, 74923) c5(Wa, azF); #c1(RNASE1) c2(NP_937875) c3(9639) c4(35753, 48810, 61867, 22696, 74924) c5(en, aw, EM, dB, lp, w, e, O, gO, BO, kJ, et, AX, cl, g, mz, Oe, nl, Ce, x, jT, fy, ag, cT, la, aDf, X, Ak, bw, U, cM, co, f, N, bu, aeE, B, cs, gg, azp, iT, V, dc, v, BV, ad, akg, py, aY, fw, ji, nU, b, apC, yU, bQO, z, d, bb, re, k, PA, q, es, u, dh, by, wd, jU, yG, xv, jH, ao, bL, A, fd, zF, UA, di, lv, zK, jR, jx, LS, LI, wG, h, M, y, cV, YR, J, dt, P, Ql, aX, cz, TU, fP); #c1(RNASE2) c2(NP_002925) c3(9640) c4(35754, 48811, 61868, 22697, 74925) c5(aKO, qs, fl, bb, dP, oS, X, fq, uK, sG, bBL, aD, cy, aXf, aDF); #c1(RNASE3) c2(NP_002926) c3(9641) c4(35755, 48812, 61869, 22698, 74926) c5(aNu, Al, b, bad, Kc, eW, NH, e, d, cy, aCU, fq, nY, dQ, aD, pH, Kd, aos, bfG, yJ, baH, ae, JQ, ti, aDI, ll, ny, aDA, JN, CO, pq, NG, bYK, czJ, aFk, bBL); #c1(RNASE4) c2(NP_002928) c3(9642) c4(35756, 48813, 61870, 22699, 74927) c5(gK, aA, kz, A, aVr); #c1(RNASE6) c2(NP_005606) c3(9643) c4(35757, 48814, 61871, 22700, 74928) c5(fl, I, je, nY, z, bf, aM); #c1(RNASE7) c2(NP_115961) c3(9644) c4(35758, 48815, 61872, 22701, 74929) c5(vq, fq, nY); #c1(RNASE8) c2(NP_612204) c3(9645) c4(35759, 48816, 61873, 22702, 74930) c5(aVr); #c1(RNASE9) c2(NP_001103826) c3(9646) c4(35760, 48817, 61874, 22703, 74931) c5(A); #c1(RNASEH1) c2(NP_002927) c3(9647) c4(35761, 48818, 61875, 22704, 74932) c5(lt, by, b, bu); #c1(RNASEH2A) c2(NP_006388) c3(9648) c4(35762, 48819, 61876, 22705, 74933) c5(EO, da, czK, b, N, q, pF, cU, kB, fg, EQ, jG, C); #c1(RNASEH2B) c2(NP_001135751) c3(9649) c4(35763, 48820, 61877, 22706, 74934) c5(EO, czL, aSB, gL); #c1(RNASEH2C) c2(NP_115569) c3(9650) c4(35764, 48821, 61878, 22707, 74935) c5(EO, Nz, sE, xc, czM); #c1(RNASEK) c2(NP_001004333) c3(9651) c4(35765, 48822, 61879, 22708, 74936) c5(X, av, b); #c1(RNASEL) c2(NP_066956) c3(9652) c4(35766, 48823, 61880, 22709, 74937) c5(QD, A, b, X, aiW, jc, C, gE, bw, al, zL, adr, U, y, d, wZ, co, jl, AX, B, q, e, Up, acy, jG, u, o, is, jq, V, gL, ad, Ce, T, ll, pb, bm, os, ag, iT, i, cgg, I, re); #c1(RNASET2) c2(NP_003721) c3(9653) c4(35767, 48824, 61881, 22710, 74938) c5(hT, pV, b, czN, f, X, aVr, qB, aX, av, iu, JK); #c1(RND1) c2(NP_055285) c3(9654) c4(35768, 48825, 61882, 22711, 74939) c5(u, bu); #c1(RND3) c2(NP_005159) c3(9655) c4(35769, 48826, 61883, 22712, 74940) c5(oy, d, A, aX, I, b, dA, Qu, f, q, bu, W, B, cO, bb, by, cK, e, y); #c1(RNF103-CHMP3) c2(NP_001185883) c3(9656) c4(35770, 48827, 61884, 22713, 74941) c5(P, A, aq, B); #c1(RNF103) c2(NP_001185880) c3(9657) c4(35771, 48828, 61885, 22714, 74942) c5(dc); #c1(RNF111) c2(XP_006720638) c3(9658) c4(35772, 48829, 61886, 22715, 74943) c5(mc, mR, cO); #c1(RNF112) c2(NP_009079) c3(9659) c4(35773, 48830, 61887, 22716, 74944) c5(xO, nU, czO, aGZ, aHp, aW); #c1(RNF114) c2(NP_061153) c3(9660) c4(35774, 48831, 61888, 22717, 74945) c5(da, bj, xe); #c1(RNF123) c2(NP_071347) c3(9661) c4(35775, 48832, 61889, 22718, 74946) c5(f, aY, bdy, bdx, dc, cM); #c1(RNF125) c2(NP_060301) c3(9662) c4(35776, 48833, 61890, 22719, 74947) c5(U, V, aW); #c1(RNF128) c2(NP_078815) c3(9663) c4(35777, 48834, 61891, 22720, 74948) c5(jH, PH); #c1(RNF130) c2(NP_060904) c3(9664) c4(35778, 48835, 61892, 22721, 74949) c5(A, at); #c1(RNF135) c2(NP_001171921) c3(9665) c4(35779, 48836, 61893, 22722, 74950) c5(or, b, xJ, xr, iD, AP, czP); #c1(RNF138) c2(NP_057355) c3(9666) c4(35780, 48837, 61894, 22723, 74951) c5(fl); #c1(RNF139) c2(NP_009149) c3(9667) c4(35781, 48838, 61895, 22724, 74952) c5(hh, nV, b, pR, hV, dB, Lu, jo, w, ff, tl, czQ, nP); #c1(RNF144A) c2(XP_005246259) c3(9668) c4(35782, 48839, 61896, 22725, 74953) c5(ae, bb, b, Eo, u, y); #c1(RNF144B) c2(XP_005249041) c3(9669) c4(35783, 48840, 61897, 22726, 74954) c5(oy, f); #c1(RNF146) c2(NP_001229778) c3(9670) c4(35784, 48841, 61898, 22727, 74955) c5(co, X, y, fy, u, o); #c1(RNF149) c2(NP_775918) c3(9671) c4(35785, 48842, 61899, 22728, 74956) c5(bw); #c1(RNF14) c2(XP_005268598) c3(9672) c4(35786, 48843, 61900, 22729, 74957) c5(pM, ao, A, b, B, ad, wn, T, cs); #c1(RNF150) c2(NP_065775) c3(9673) c4(35787, 48844, 61901, 22730, 74958) c5(GF); #c1(RNF152) c2(NP_775828) c3(9674) c4(35788, 48845, 61902, 22731, 74959) c5(KM); #c1(RNF157) c2(NP_443148) c3(9675) c4(35789, 48846, 61903, 22732, 74960) c5(oy); #c1(RNF167) c2(NP_056343) c3(9676) c4(35790, 48847, 61904, 22733, 74961) c5(czR); #c1(RNF168) c2(NP_689830) c3(9677) c4(35791, 48848, 61905, 22734, 74962) c5(avd, u, y, b); #c1(RNF170) c2(NP_001153695) c3(9678) c4(35792, 48849, 61906, 22735, 74963) c5(bda, czS); #c1(RNF180) c2(NP_001107033) c3(9679) c4(35793, 48850, 61907, 22736, 74964) c5(by, aE, b, bu); #c1(RNF182) c2(NP_001158506) c3(9680) c4(35794, 48851, 61908, 22737, 74965) c5(aC, bq, u); #c1(RNF19A) c2(XP_005250910) c3(9681) c4(35795, 48852, 61909, 22738, 74966) c5(dx, en, Ob, gG, dB, Od, w, cO, bf, e, O, dv, dN, kz, cl, Hs, Oe, aC, du, aB, gm, bp, ft, jT, ag, cT, bk, dc, aA, fO, X, LM, mk, H, bw, U, y, V, co, DM, f, bu, B, cs, av, fy, bm, iT, iF, rN, ae, NZ, BV, Oa, yM, zS, b, aF, Of, NY, ey, gZ, d, fv, re, g, dQ, ar, jG, u, dh, o, da, I, j, ad, CZ, jU, ao, kB, HN, xU, yA, Jh, A, k, fr, di, gE, al, bj, jx, aX, h, F, n, aV, cV, be, J, Oc, P, II, ji, by, wU, mb, fP, iB, eG, ja); #c1(RNF207) c2(XP_011539741) c3(9682) c4(35796, 48853, 61910, 22739, 74967) c5(mO, Eg); #c1(RNF20) c2(NP_062538) c3(9683) c4(35797, 48854, 61911, 22740, 74968) c5(BY, A, B); #c1(RNF213) c2(NP_001243000) c3(9684) c4(35798, 48855, 61912, 22741, 74969) c5(bC, czT, bU, Hx); #c1(RNF214) c2(NP_997226) c3(9685) c4(35799, 48856, 61913, 22742, 74970) c5(ap); #c1(RNF216) c2(NP_996999) c3(9686) c4(35800, 48857, 61914, 22743, 74971) c5(tY, aA, bEr); #c1(RNF24) c2(NP_001127809) c3(9687) c4(35801, 48858, 61915, 22744, 74972) c5(oy); #c1(RNF2) c2(XP_005245470) c3(9688) c4(35802, 48859, 61916, 22745, 74973) c5(lJ, aw, b, X, pR, iP, eu, anF, oi, ic, iG, y, co, aX, kH, kJ, jd, f, ND, ff, HE, av, u, EM, n, gG, dB, anD, jo, VP, jC, anG, DO, P, ag, anE); #c1(RNF31) c2(NP_060469) c3(9689) c4(35803, 48860, 61917, 22746, 74974) c5(u, b); #c1(RNF34) c2(NP_079402) c3(9690) c4(35804, 48861, 61918, 22747, 74975) c5(bDM, jT, ae, LX, bci, eu, Dj, iU, ccq, eW, P, ik, ciS, x, CX); #c1(RNF39) c2(NP_079512) c3(9691) c4(35805, 48862, 61919, 22748, 74976) c5(m, P, aV, ix, jD); #c1(RNF40) c2(NP_001193963) c3(9692) c4(35806, 48863, 61920, 22749, 74977) c5(fe, f, cz, A, B, cB); #c1(RNF41) c2(NP_001229755) c3(9693) c4(35807, 48864, 61921, 22750, 74978) c5(hW, V, bj, ak, ih, cT, cA, U, u, y); #c1(RNF43) c2(NP_060233) c3(9694) c4(35808, 48865, 61922, 22751, 74979) c5(bck, ar, V, b, X, gG, q, bu, cU, T, cs, iA, bw, U, ad, av); #c1(RNF44) c2(XP_005265902) c3(9695) c4(35809, 48866, 61923, 22752, 74980) c5(ho); #c1(RNF4) c2(NP_001171939) c3(9696) c4(35810, 48867, 61924, 22753, 74981) c5(oy, lb, jV, afn, rv, pB); #c1(RNF5) c2(NP_008844) c3(9697) c4(35811, 48868, 61925, 22754, 74982) c5(da, m, aX, cY, f, ll, y, u, aE, aW, ff); #c1(RNF6) c2(NP_005968) c3(9698) c4(35812, 48869, 61926, 22755, 74983) c5(jh, A, B, bel, ik, cpH); #c1(RNF7) c2(NP_001188299) c3(9699) c4(35813, 48870, 61927, 22756, 74984) c5(qJ, Mj, f, ud, DC, bgm, aE, Io, cs, bFv, Mn, dh, ap); #c1(RNF8) c2(NP_003949) c3(9700) c4(35814, 48871, 61928, 22757, 74985) c5(bb, cV, cz, kY, oM, pt); #c1(RNGTT) c2(NP_001273355) c3(9701) c4(35815, 48872, 61929, 22758, 74986) c5(jE, bm, q, b); #c1(RNH1) c2(XP_011518565) c3(9702) c4(35816, 48873, 61930, 22759, 74987) c5(QD, co, aX, i, b, ck, Lv, hV, J, bu, P, cT, nV, tl, fx, by, u, y, zD); #c1(RNLS) c2(NP_001026879) c3(9703) c4(35817, 48874, 61931, 22760, 74988) c5(qs, bb, HD, di, cO, vo, et, aE, aO, gO); #c1(RNMT) c2(NP_003790) c3(9704) c4(35818, 48875, 61932, 22761, 74989) c5(KS, B, aw, Io, IJ, w, Mn, e, O, jR, kJ, cl, Qx, g, og, bp, ft, jT, av, sg, ag, bk, i, dB, bP, X, iP, jz, eu, jf, iG, cA, bw, U, y, co, pp, f, bu, gX, cs, aup, fy, bm, V, Qz, afz, VP, jC, iA, iY, aum, nJ, Le, ji, kD, Dr, b, oi, fD, d, jh, hV, q, ar, ff, Xp, iR, aNN, aEf, aza, ad, iD, Vw, et, aCq, rQ, u, py, SJ, he, Sk, QP, bln, A, IO, SS, k, fr, pR, lv, gE, fs, buk, jQ, aX, h, F, cU, n, PT, fU, bXf, Fs, W, jo, QI, T, fO, cz, qp, js, QN, adu, by, XH, jN, eG); #c1(RNPEP) c2(NP_064601) c3(9705) c4(35819, 48876, 61933, 22762, 74990) c5(k, lb, hV, dB, jV, WO, fr, ahV, di, Af, cV, bw, iE); #c1(RNPEPL1) c2(NP_060696) c3(9706) c4(35820, 48877, 61934, 22763, 74991) c5(l, aC, ak, di, at, aE); #c1(RNPS1) c2(NP_001273555) c3(9707) c4(35821, 48878, 61935, 22764, 74992) c5(pM, dj, b, SS, Jh, nU, P, j, ahu, fy, u, bS); #c1(ROBO1) c2(NP_001139317) c3(9708) c4(35822, 48879, 61936, 22765, 74993) c5(by, A, uy, b, Mr, ahS, eu, Hr, jc, O, HJ, U, y, co, aX, yQ, ip, kJ, bdL, ml, B, q, bu, alW, ar, aW, asa, fy, u, ff, fU, V, dB, bp, Wh, ahO, cy, cz, to, jE, bm, jR, jN, bq, aA, re); #c1(ROBO2) c2(NP_001122401) c3(9709) c4(35823, 48880, 61937, 22766, 74994) c5(bck, oy, uM, V, b, cV, Ks, re, gG, cz, czU, uz, eO, sV, bf, auz, bq); #c1(ROBO3) c2(NP_071765) c3(9710) c4(35824, 48881, 61938, 22767, 74995) c5(dx, en, gE, b, rT, X, aiW, dB, w, bb, kJ, re, e, d, m, dv, aX, DG, Lq, AX, f, F, beP, bu, dQ, zb, aE, iT, awq, apx, aC, Dg, du, BL, cz, dt, P, IG, Il, Nh, cC, czV, by, ajd, aeq, bez, aCp, Oa, czW, UE, anz, fl, at, DM); #c1(R0804) c2(NP_001288017) c3(9711) c4(35825, 48882, 61939, 22768, 74996) c5(ao, A, kJ, q, cz, di, zb, gg, fy); #c1(ROCK1) c2(NP_005397) c3(9712) c4(35826, 48883, 61940, 22769, 74997) c5(by, en, bW, b, k, X, EB, pR, LM, O, dB, w, di, lW, bf, U, sx, ey, y, dv, I, aq, vn, h, f, N, q, bu, fr, kz, fx, B, A, cs, bw, oD, av, fy, u, n, cl, fs, V, nQ, cV, el, QB, bp, ad, IR, IX, P, eX, xt, x, cK, mQ, ft, aM, acL, eQ, er, gd, ix, IS, i, ji, aA, at, eG, ap); #c1(ROCK2) c2(NP_004841) c3(9713) c4(35827, 48884, 61941, 22770, 74998) c5(b, ix, di, lW, y, BO, qs, f, q, O, cs, xt, u, sH, IR, IX, P, et, xd, eQ, cT, w, IS, bh, at, ap); #c1(ROGD1) c2(NP_078865) c3(9714) c4(35828, 48885, 61942, 22771, 74999) c5(czX); #c1(ROM1) c2(NP_000318) c3(9715) c4(35829, 48886, 61943, 22772, 75000) c5(bxm, aDu, b, nQ, aD, mI, nW, dt, ea, Ce, cas, SF, y, yn, rQ, nE, nR, u, czY, aW); #c1(ROPN1B) c2(XP_005247195) c3(9716) c4(35830, 48887, 61944, 22773, 75001) c5(aX, asO); #c1(ROPN1) c2(XP_011511238) c3(9717) c4(35831, 48888, 61945, 22774, 75002) c5(Eo, di, bb, aO, fh); #c1(ROPN1L) c2(NP_114122) c3(9718) c4(35832, 48889, 61946, 22775, 75003) c5(ao, ax, aw, dA, X, t, aB, G, aE, az, aC, P, au, ay, av, at, aA); #c1(ROR1) c2(XP_011539828) c3(9719) c4(35833, 48890, 61947, 22776, 75004) c5(HE, G, eX, aX, b, t, ja, ak, J, QI, by, jo, cT, fe, ji, ff, cO, bf, fy, u, bq); #c1(ROR2) c2(NP_004551) c3(9720) c4(35834, 48891, 61948, 22777, 75005) c5(A, b, fr, dB, Ak, cmo, rH, iK, cp, aX, sm, B, cY, czZ, fM, BC, fO, ft, dt, QI, T, bb, et, YU, acw, jR, rJ, zM); #c1(RORA) c2(NP_002934) c3(9721) c4(35835, 48892, 61949, 22778, 75006) c5(dx, fr, ak, sm, cY, UA, dB, aGq, Ak, mk, A, iL, z, GV, rH, cM, cp, zM, aX, b, t, ja, f, q, bu, aQf, aW, fM, HE, fy, u, jZ, tQ, ff, em, fe, I, B, ac, du, BC, J, fO, cz, dt, jo, QI, T, eX, ji, cy, by, ft, dL, czZ, iK, Ey, aY, bm, YA, G, jR, rJ, YU, acw, cT, cmo, dh, jU, dc, od, y); #c1(RORB) c2(NP_008845) c3(9722) c4(35836, 48893, 61950, 22779, 75007) c5(aQf, ak, eG); #c1(RORC) c2(NP_001001523) c3(9723) c4(35837, 48894, 61951, 22780, 75008) c5(A, aw, V, b, py, ze, cK, B, OV, dt, I, aA, eM, Km, hep, VJ, u, U, y, xa); #c1(ROS1) c2(NP_002935) c3(9724) c4(35838, 48895, 61952, 22781, 75009) c5(aw, b, X, gG, w, di, jC, U, azO, y, co, bb, jd, eX, bu, Mr, ar, U, VM, av, fy, u, fh, V, bp, by, T, bq, aX, JY, lc, fw, i, I, ji, at, fD, ap); #c1(RP1) c2(NP_006260) c3(9725) c4(35839, 48896, 61953, 22782, 75010) c5(V, nQ, cV, RT, mI, dK, yn, nE, U, nW); #c1(RP1L1) c2(NP_849188) c3(9726) c4(35840, 48897, 61954, 22783, 75011) c5(mI, SF, nW, aW, csv); #c1(RP2) c2(NP_008846) c3(9727) c4(35841, 48898, 61955, 22784, 75012) c5(aeQ, Bu, kF, fC, nQ, ayr, cAa, cAb, nW, yn, nR, mI, lk); #c1(RP9) c2(NP_976033) c3(9728) c4(35842, 48899, 61956, 22785, 75013) c5(cAc, b, an, re, mI, yn, as, Hh, aoK, nW, iT); #c1(RPA1) c2(NP_002936) c3(9729) c4(35843, 48900, 61957, 22786, 75014) c5(wU, aV, bb, Kx, b, aeG, i, ip, xX, ny, fl, NB, at, u, BX); #c1(RPA2) c2(NP_001284487) c3(9730) c4(35844, 48901, 61958, 22787, 75015) c5(b, qL, fE, f, dT, BY, aiL, i, aV, u, y); #c1(RPA3) c2(NP_002938) c3(9731) c4(35845, 48902, 61959, 22788, 75016) c5(bq, aV, u, i); #c1(RPA4) c2(NP_037479) c3(9732) c4(35846, 48903, 61960, 22789, 75017) c5(ao, i); #c1(RPAIN) c2(NP_001028174) c3(9733) c4(35847, 48904, 61961, 22790, 75018) c5(ER, aC, cf, eu, gd, bf, yW, fy, u, y, aM); #c1(RPAP1) c2(NP_056355) c3(9734) c4(35848, 48905, 61962, 22791, 75019) c5(u, y); #c1(RPE) c2(NP_001265214) c3(9735) c4(35849, 48906, 61963, 22792, 75020) c5(fl, b, nQ, arg, aQE, f, HJ, nv, Hr, bGj, aVB, ard, dX, Bj, et, ahc, Uy, ml, aW); #c1(RPGR) c2(NP_000319) c3(9736) c4(35850, 48907, 61964, 22793, 75021) c5(bgA, Ir, Pa, cAa, cnm, ea, yn, SD, aW, aeQ, cAf, mI, f, nv, nR, nW, Pu, nQ, gH, cAd, v, MW, aVB, Nx, Ur, cAe, pk, aei, ayr, Bu, bgr, lk); #c1(RPGRIP1) c2(NP_065099) c3(9737) c4(35851, 48908, 61965, 22794, 75022) c5(r, ez, nQ, ml, er, v, vU, fC, ea, cAh, Nx, nR, cAg, nW, KU); #c1(RPGRIP1L) c2(NP_001121369) c3(9738) c4(35852, 48909, 61966, 22795, 75023) c5(pk, r, I, nQ, aIM, Nw, ak, q, vU, aA, Pu, cAj, cO, aCd, cAi, et, SO); #c1(RPH3A) c2(NP_001137326) c3(9739) c4(35853, 48910, 61967, 22796, 75024) c5(si, V, bg, ar, td, U); #c1(RPH3AL) c2(XP_011545302) c3(9740) c4(35854, 48911, 61968, 22797, 75025) c5(gK, cy, V, X, jR, ra, av, bj, U); #c1(RPIA) c2(NP_653164) c3(9741) c4(35855, 48912, 61969, 22798, 75026) c5(em, f, bxC, zP, cAk, fO, og, nV, nP, ac); #c1(RPL10A) c2(NP_009035) c3(9742) c4(35856, 48913, 61970, 22799, 75027) c5(en); #c1(RPL10) c2(NP_001243506) c3(9743) c4(35857, 48914, 61971, 22800, 75028) c5(fx, A, b, cAl, B, Le, ag, fe, ar, O, i, bOO, cz, u, av, y); #c1(RPL10L) c2(NP_542784) c3(9744) c4(35858, 48915, 61972, 22801, 75029) c5(X, av, at); #c1(RPL12) c2(NP_000967) c3(9745) c4(35859, 48916, 61973, 22802, 75030) c5(asL, Ns, A, Nq); #c1(RPL13) c2(NP_001230060) c3(9746) c4(35860, 48917, 61974, 22803, 75031) c5(A, u, B, y, bu); #c1(RPL14) c2(NP_001030168) c3(9747) c4(35861, 48918, 61975, 22804, 75032) c5(co, I, F, dB, bp, bf, fy, bj, O, aM); #c1(RPL15) c2(NP_001240313) c3(9748) c4(35862, 48919, 61976, 22805, 75033) c5(cAm, cz, CZ, bu); #c1 (RPL17-C18orf32) c2(NP_001186284) c3(9749) c4(35863, 48920, 61977, 22806, 75034) c5(m, aX, b, im, aC, gE, jz, P, bu, vc, jQ, ll, eM, by, u, aE, y, lv); #c1(RPL17) c2(NP_001030178) c3(9750) c4(35864, 48921, 61978, 22807, 75035) c5(m, by, aX, b, im, aC, jz, P, bu, vc, jQ, ll, gE, at, u, aE, y, lv); #c1(RPL18) c2(NP_000970) c3(9751) c4(35865, 48922, 61979, 22808, 75036) c5(bu); #c1 (RPL19) c2(NP_000972) c3(9752) c4(35866, 48923, 61980, 22809, 75037) c5(co, lr, V, B, A, T, ji, bw, U, fy, u, y); #c1(RPL21) c2(NP_000973) c3(9753) c4(35867, 48924, 61981, 22810, 75038) c5(fl); #c1(RPL23A) c2(NP_000975) c3(9754) c4(35868, 48925, 61982, 22811, 75039) c5(aX, bj, u, re); #c1(RPL23) c2(NP_000969) c3(9755) c4(35869, 48926, 61983, 22812, 75040) c5(azt, Pv, by, b, bu); #c1 (RPL24) c2(NP_000977) c3(9756) c4(35870, 48927, 61984, 22813, 75041) c5(SJ); #c1(RPL27A) c2(NP_000981) c3(9757) c4(35871, 48928, 61985, 22814, 75042) c5(pr, kS); #c1(RPL29) c2(NP_000983) c3(9758) c4(35872, 48929, 61986, 22815, 75043) c5(by, I, b, f, bu, fl, T, cs, x, bf, U, ad, bm, aA, aM); #c1(RPL30) c2(NP_000980) c3(9759) c4(35873, 48930, 61987, 22816, 75044) c5(jR, cs, q, b, ad); #c1(RPL31) c2(NP_000984) c3(9760) c4(35874, 48931, 61988, 22817, 75045) c5(u); #c1(RPL34) c2(NP_001306164) c3(9761) c4(35875, 48932, 61989, 22818, 75046) c5(J, cB, jx); #c1(RPL35) C2(NP_009140) c3(9762) c4(35876, 48933, 61990, 22819, 75047) c5(u); #c1(RPL36A) c2(NP_066357) c3(9763) c4(35877, 48934, 61991, 22820, 75048) c5(aEg, jB, hV, aw, b, f, q, QI, B, bQ, og, w, ar, co, A, fy, nV, y); #c1(RPL36AL) c2(NP_000992) c3(9764) c4(35878, 48935, 61992, 22821, 75049) c5(g); #c1(RPL37A) c2(NP_000989) c3(9765) c4(35879, 48936, 61993, 22822, 75050) c5(kF); #c1 (RPL38) c2(NP_000990) c3(9766) c4(35880, 48937, 61994, 22823, 75051) c5(aCb, zE, aZY); #c1(RPL39) c2(NP_000991) c3(9767) c4(35881, 48938, 61995, 22824, 75052) c5(ag); #c1(RPL39L) c2(NP_443201) c3(9768) c4(35882, 48939, 61996, 22825, 75053) c5(X, av, g); #c1 (RPL3) c2(NP_000958) c3(9769) c4(35883, 48940, 61997, 22826, 75054) c5(Ag, bQA, aX, fM, uj, aq, ui, sE, AG, T, Af, aYf, u, bev, y); #c1(RPL41) c2(NP_066927) c3(9770) c4(35884, 48941, 61998, 22827, 75055) c5(cAn, fl); #c1 (RPL4) c2(NP_000959) c3(9771) c4(35885, 48942, 61999, 22828, 75056) c5(bt); #c1(RPL6) C2(NP_001307069) c3(9772) c4(35886, 48943, 62000, 22829, 75057) c5(Ag, zi, bu, T, Af, fR, by, bj); #c1(RPL7A) c2(NP_000963) c3(9773) c4(35887, 48944, 62001, 22830, 75058) c5(V, fr, f, q, ft, U, u, y); #c1(RPL7) c2(NP_000962) c3(9774) c4(35888, 48945, 62002, 22831, 75059) c5(cAo); #c1(RPLP0) c2(NP_000993) c3(9775) c4(35889, 48946, 62003, 22832, 75060) c5(cy, V, J, q, fP, cs, U, fy); #c1(RPLP1) c2(NP_000994) c3(9776) c4(35890, 48947, 62004, 22833, 75061) c5(hT, b, aC, sX, gG, ad, cT, cs); #c1(RPN1) c2(NP_002941) c3(9777) c4(35891, 48948, 62005, 22834, 75062) c5(cj, A, h, J, n, at, ci); #c1(RPN2) c2(NP_001129243) c3(9778) c4(35892, 48949, 62006, 22835, 75063) c5(d, A, b, I, u, e, y, ez); #c1(RPP14) c2(NP_001092253) c3(9779) c4(35893, 48950, 62007, 22836, 75064) c5(aEq, fU, aX, V, b, f, Fo, q, jR, by, cT, A, T, i, ar, U, jT, u, st, y, dB); #c1(RPP21) c2(NP_001186049) c3(9780) c4(35894, 48951, 62008, 22837, 75065) c5(m); #c1(RPP25) c2(NP_060263) c3(9781) c4(35895, 48952, 62009, 22838, 75066) c5(hT, cz); #c1(RPP38) c2(NP_001252530) c3(9782) c4(35896, 48953, 62010, 22839, 75067) c5(aX); #c1(RPP40) c2(NP_006629) c3(9783) c4(35897, 48954, 62011, 22840, 75068) c5(bq); #c1(RPRD1A) c2(NP_001290340) c3(9784) c4(35898, 48955, 62012, 22841, 75069) c5(fl); #c1(RPRD1B) c2(NP_067038) c3(9785) c4(35899, 48956, 62013, 22842, 75070) c5(ak); #c1(RPRD2) c2(NP_001284602) c3(9786) c4(35900, 48957, 62014, 22843, 75071) c5(cV); #c1 (RPRM) c2(NP_062819) c3(9787) c4(35901, 48958, 62015, 22844, 75072) c5(aKi, ik, V, Fg, bu); #c1(RPS10) c2(NP_001191020) c3(9788) c4(35902, 48959, 62016, 22845, 75073) c5(cAp, q, vQ, CZ); #c1(RPS14) C2(NP_001020242) c3(9789) c4(35903, 48960, 62017, 22846, 75074) c5(Ag, JI, CZ, Xt, n, GG, pr, T, Af, JE, kX, aA, u, ci, y, pq); #c1(RPS15A) c2(NP_001025180) c3(9790) c4(35904, 48961, 62018, 22847, 75075) c5(q, vQ); #c1 (RPS16) c2(XP_005259194) c3(9791) c4(35905, 48962, 62019, 22848, 75076) c5(bw, CZ); #c1(RPS18) c2(NP_072045) c3(9792) c4(35906, 48963, 62020, 22849, 75077) c5(m, cs, ad); #c1(RPS19BP1) c2(NP_919307) c3(9793) c4(35907, 48964, 62021, 22850, 75078) c5(b, arp); #c1(RPS20) c2(NP_00113969g) c3(9794) c4(35908, 48965, 62022, 22851, 75079) c5(U, cs, bY, jR, ad); #c1 (RPS24) c2(NP_001135754) c3(9795) c4(35909, 48966, 62023, 22852, 75080) c5(CZ, cAq, aoF, GF, bq, qE, Fg); #c1(RPS27A) c2(NP_001170884) c3(9796) c4(35910, 48967, 62024, 22853, 75081) c5(Ke, wV, A, si, XZ, f, wP, ak, i, cs, fx, jT, u, y); #c1(RPS27) c2(NP_001021) c3(9797) c4(35911, 48968, 62025, 22854, 75082) c5(bNm, b, sl, w, y, aX, kJ, F, q, vQ, bu, u, o, aLt, em, IU, LG, by, hT, aaS, kA, atg); #c1(RPS27L) c2(NP_057004) c3(9798) c4(35912, 48969, 62026, 22855, 75083) c5(U, V); #c1(RPS29) C2(NP_001023) c3(9799) c4(35913, 48970, 62027, 22856, 75084) c5(bp); #c1(RPS2) c2(NP_002943) c3(9800) c4(35914, 48971, 62028, 22857, 75085) c5(MT, A, b, wp, B, eu, afL); #c1(RPS3A) c2(NP_000997) c3(9801) c4(35915, 48972, 62029, 22858, 75086) c5(bp, f, gk, q, o); #c1(RPS3) c2(NP_000996) c3(9802) c4(35916, 48973, 62030, 22859, 75087) c5(d, aX, caT, dh, nM, e); #c1(RPS4X) c2(NP_000998) c3(9803) c4(35917, 48974, 62031, 22860, 75088) c5(yi, wp, V, b, aC, sE, azx, U, ajf, u, y, afL); #c1(RPS4Y1) c2(NP_000999) c3(9804) c4(35918, 48975, 62032, 22861, 75089) c5(wp); #c1(RPS6KA2) c2(NP_001006933) c3(9805) c4(35919, 48976, 62033, 22862, 75090) c5(d, A, aX, b, X, B, cs, ad, ag, Oi, T, ll, cO, x, bf, av, Oh, u, e, y, cl); #c1(RPS6KA3) c2(NP_004577) c3(9806) c4(35920, 48977, 62034, 22863, 75091) c5(f, b, X, F, A, lv, kY, fR, e, y, d, aX, SS, ip, nU, N, q, M, fr, B, cs, av, cq, u, yJ, I, dA, nx, nz, aIU, J, fU, ad, P, T, ll, ny, ft, dg, cAr, BX, aWd, he, ape, fg, cV, od, aA); #c1(RPS6KA4) c2(NP_001006945) c3(9807) c4(35921, 48978, 62035, 22864, 75092) c5(aC, Bm, bT); #c1(RPS6KA5) c2(NP_004746) c3(9808) c4(35922, 48979, 62036, 22865, 75093) c5(d, da, aC, f, dd, i, cs, T, u, e, y); #c1(RPS6KA6) c2(NP_055311) c3(9809) c4(35923, 48980, 62037, 22866, 75094) c5(P, cU, aX, Y, nx, nz, f, dB, W, jo, T, cs, iA, u, jD); #c1(RPS6KB1) c2(NP_001258971) c3(9810) c4(35924, 48981, 62038, 22867, 75095) c5(A, aw, b, X, jj, rd, w, di, kY, O, Oh, fx, y, iy, il, ip, fy, jd, f, q, ik, B, cB, cs, mR, av, aV, u, o, cc, mz, bm, I, bp, ad, T, ny, x, gF, jG, buB, yG, KK, BX, py, iR, mA, ag, sp, i, bq, aA, bT); #c1(RPS6KB2)

c2(NP_003943) c3(9811) c4(35925, 48982, 62039, 22868, 75096) c5(fy, BX, b, nJ, ip, ny, x, Oh, u, y); #c1(RPS9) c2(XP_006726028) c3(9812) c4(35926, 48983, 62040, 22869, 75097) c5(f, b); #c1(RPSA) c2(NP_002286) c3(9813) c4(35927, 48984, 62041, 22870, 75098) c5(da, by, JH, b, X, aF, gG, jz, aE, eH, m, dV, U, Co, G, y, Zz, BO, co, aX, t, h, f, jQ, bu, cU, aC, dZ, dQ, ff, iv, aD, ar, av, aV, u, dh, o, yJ, fU, V, ae, cV, cAs, cs, v, bp, xs, IX, jo, T, fU, HE, x, cy, J, ad, bq, jT, fy, fc, ckm, P, aeS, aeR, aq, fP, fq, QP, ji, at, lv); #c1(RPTOR) c2(NP_001156506) c3(9814) c4(35928, 48985, 62042, 22871, 75099) c5(oy, jh, iy, kW, fO, gL, da, P, ll, zM); #c1(RQCD1) c2(NP_001258563) c3(9815) c4(35929, 48986, 62043, 22872, 75100) c5(ck, u, y, nQ); #c1(RRAD) c2(NP_001122322) c3(9816) c4(35930, 48987, 62044, 22873, 75101) c5(ao, A, I, b, X, f, nJ, cc, ar, B, cB, fy, bf, av, hR, u, dh, y, aM); #c1(RRAGA) c2(NP_006561) c3(9817) c4(35931, 48988, 62045, 22874, 75102) c5(aKO, aqg, aiE, b, oS); #c1(RRAS2) c2(NP_001096139) c3(9818) c4(35932, 48989, 62046, 22875, 75103) c5(gt, dA, X, bj, q, T, iK, av, jT, u, yA, y, amq); #c1(RRAS) c2(NP_006261) c3(9819) c4(35933, 48990, 62047, 22876, 75104) c5(A, avb, alY, b, Pv, el, f, v, alW, B, cB, fs, alX, u); #c1(RRBP1) c2(NP_001036041) c3(9820) c4(35934, 48991, 62048, 22877, 75105) c5(aKO, jT, aw, b, oS); #c1(RREB1) c2(NP_001003700) c3(9821) c4(35935, 48992, 62049, 22878, 75106) c5(fn, B, b, k, eu, bq, w, iL, U, xw, A, fx, aW, aoa, aX, bj, h, hV, q, M, Xi, Cp, Qx, jB, wB, v, j, J, P, T, ll, ar, nP, avY, eq, ao, f, PY, Dj, ag, i, fl); #c1(RRH) c2(NP_006574) c3(9822) c4(35936, 48993, 62050, 22879, 75107) c5(nW, nQ); #c1(RRM1) c2(NP_001024) c3(9823) c4(35937, 48994, 62051, 22880, 75108) c5(aw, b, X, jj, atK, iG, bw, U, fD, y, d, co, lO, ip, jk, h, e, q, bu, hN, ar, cs, fy, u, jB, fe, V, bp, ad, T, ll, ny, by, ac, gt, iw, BX, QN, Qk, os, ag, amb, I, apT); #c1(RRM2B) c2(NP_001165948) c3(9824) c4(35938, 48995, 62052, 22881, 75109) c5(A, b, aoJ, SS, U, y, d, jh, ala, aX, cAt, ip, f, cAv, e, ar, B, cs, u, fi, V, cAu, ad, awT, T, ny, by, BX, jH, GQ, kW, hT); #c1(RRM2) c2(NP_001025) c3(9825) c4(35939, 48996, 62053, 22882, 75110) c5(ml, aw, b, X, A, C, lO, U, hP, ai, y, aX, ip, kJ, h, B, F, q, bu, Vr, ar, fx, fv, av, fy, u, iT, n, kF, V, qL, v, by, Fo, aj, iA, ao, iR, ag, fl, i, ji, re); #c1(RRN3) c2(NP_001287993) c3(9826) c4(35940, 48997, 62054, 22883, 75111) c5(Dq); #c1(RRNAD1) c2(NP_001136032) c3(9827) c4(35941, 48998, 62055, 22884, 75112) c5(o); #c1(RRP1B) c2(NP_055871) c3(9828) c4(35942, 48999, 62056, 22885, 75113) c5(u, y, b); #c1(RRP1) c2(NP_003674) c3(9829) c4(35943, 49000, 62057, 22886, 75114) c5(o, b); #c1(RRP9) c2(NP_004695) c3(9830) c4(35944, 49001, 62058, 22887, 75115) c5(bu); #c1(RRS1) c2(NP_055984) c3(9831) c4(35945, 49002, 62059, 22888, 75116) c5(D0, A, b, B, yy, aA, u, y); #c1(RS1) c2(NP_000321) c3(9832) c4(35946, 49003, 62060, 22889, 75117) c5(bgA, cAw, nQ, ml, nv, aex, wf, aW); #c1(RSAD2) c2(XP_011508716) c3(9833) c4(35947, 49004, 62061, 22890, 75118) c5(aiW, dx, en, X, du, UE, at, be); #c1(RSF1) c2(NP_057662) c3(9834) c4(35948, 49005, 62062, 22891, 75119) c5(d, co, aw, E, b, iR, X, u, q, ad, T, iL, cs, av, avg, e, y, agQ); #c1(RSL1D1) c2(NP_056474) c3(9835) c4(35949, 49006, 62063, 22892, 75120) c5(cAo); #c1(RSL24D1) c2(NP_057388) c3(9836) c4(35950, 49007, 62064, 22893, 75121) c5(oy); #c1(RSPH1) C2(NP_543136) c3(9837) c4(35951, 49008, 62065, 22894, 75122) c5(MW, bq, Pu, aMw, cAx); #c1(RSPH4A) c2(NP_001010892) c3(9838) c4(35952, 49009, 62066, 22895, 75123) c5(MW, cAy, Pu, hT); #c1(RSPH9) c2(NP_001180270) c3(9839) c4(35953, 49010, 62067, 22896, 75124) c5(MW, cAz, Pu, Cl); #c1(RSPO2) c2(NP_001269792) c3(9840) c4(35954, 49011, 62068, 22897, 75125) c5(x, aC, u, iD); #c1(RSPO3) c2(NP_116173) c3(9841) c4(35955, 49012, 62069, 22898, 75126) c5(x, bq, u, cp); #c1(RSPO4) C2(NP_001025042) c3(9842) c4(35956, 49013, 62070, 22899, 75127) c5(cAA, byr); #c1(RSRC1) c2(NP_001258763) c3(9843) c4(35957, 49014, 62071, 22900, 75128) c5(aA, cV); #c1(RSRC2) c2(NP_075388) c3(9844) c4(35958, 49015, 62072, 22901, 75129) c5(jh, ik, il, b); #c1(RSRP1) c2(XP_011540100) c3(9845) c4(35959, 49016, 62073, 22902, 75130) c5(bq); #c1(RSU1) c2(NP_036557) c3(9846) c4(35960, 49017, 62074, 22903, 75131) c5(bb, w, O, et, NB, u, y, cp); #c1(RTCB) c2(NP_055121) c3(9847) c4(35961, 49018, 62075, 22904, 75132) c5(co); #c1(RTEL1) c2(NP_001269938) c3(9848) c4(35962, 49019, 62076, 22905, 75133) c5(api, jI, gE, Kt, b, asx, cAB, gw, iX, pD, Zs, w, Dj, eM, sl, al, zL, y, aX, aJB, aoR, Lq, t, h, k, f J, bdl, O, iv, oO, fH, jG, u, g, kG, im, sn, apa, fO, gm, pr, P, T, ll, cy, J, jT, ss, if, nk, BX, dP, G, dY, cT, qP, apD, IA); #c1(RTKN2) c2(NP_001269870) c3(9849) c4(35963, 49020, 62077, 22906, 75134) c5(aC); #c1(RTKN) c2(NP_001015055) c3(9850) c4(35964, 49021, 62078, 22907, 75135) c5(b, Le, w, T, fx, u, y, JY); #c1(RTL1) c2(NP_001128360) c3(9851) c4(35965, 49022, 62079, 22908, 75136) c5(en, pV, kE, b, cY, eu, ck, bOa, HQ, aX, re, qB, fs, I, cV, Xu, cd, T, ll, jC, asn, aFX, kD); #c1(RTN1) c2(NP_066959) c3(9852) c4(35966, 49023, 62080, 22909, 75137) c5(en, bN, aoe, o, aZ, fM, U, uH, u, y, at); #c1(RTN2) c2(NP_005610) c3(9853) c4(35967, 49024, 62081, 22910, 75138) c5(sQ, cAC, v, bkk, Ny, awq); #c1(RTN3) c2(NP_001252518) c3(9854) c4(35968, 49025, 62082, 22911, 75139) c5(RG, oC, en, ae, he, eW, jv, o, pq); #c1(RTN4) c2(NP_008939) c3(9855) c4(35969, 49026, 62083, 22912, 75140) c5(en, b, jz, di, aoe, bW, U, e, O, jQ, d, vr, ak, q, iZ, mR, y, aV, u, o, fU, Fs, aZ, jT, ao, uH); #c1(RTN4IP1) c2(NP_116119) c3(9856) c4(35970, 49027, 62084, 22913, 75141) c5(og, hV, nV, b); #c1(RTN4R) c2(NP_075380) c3(9857) c4(35971, 49028, 62085, 22914, 75142) c5(o, aV, Eu, b, cV, byU, he, dO, dZ, dV, afb, O, aX, U, GJ, hW, K, aeZ); #c1(RTP3) c2(NP_113628) c3(9858) c4(35972, 49029, 62086, 22915, 75143) c5(bm, q, aeh); #c1(RTP4) c2(NP_071430) c3(9859) c4(35973, 49030, 62087, 22916, 75144) c5(en); #c1(RTTN) c2(NP_775901) c3(9860) c4(35974, 48031, 62088, 22917, 75145) c5(cAD); #c1(RUFY1) c2(NP_001035542) c3(9861) c4(35975, 49032, 62089, 22918, 75146) c5(ao); #c1(ROFY3) c2(NP_001032519) c3(9862) c4(35976, 49033, 62090, 22919, 75147) c5(mk, bj, Pz, ap); #c1(RUNDC3B) c2(NP_001127877) c3(9863) c4(35977, 49034, 62091, 22920, 75148) c5(u, y); #c1(RUNX1) C2(NP_001001890) c3(9864) c4(35978, 49035, 62092, 22921, 75149) c5(lY, jK, DH, aw, zh, EM, lr, ps, e, O, M, cy, kT, t, dl, ik, gl, n, fe, lb, fO, Q, jT, pq, hx, ie, pt, ael, X, pB, ix, bw, U, y, Ei, Wn, f, N, bu, B, iv, av, cj, iF, cAE, V, FK, jh, hf, afc, pr, iA, pJ, xd, py, Cy, gR, oM, ci, An, b, jq, jL, ic, jy, d, ec, bnS, bb, aBP, nU, jV, lY, pn, Yr, jG, u, aE, da, I, by, oO, G, lG, aZ, oV, jH, pS, hX, cC, xK, fg, A, k, pz, eM, Bz, yw, m, cr, h, gT, cU, aC, Gs, ans, aq, an, me, J, T, aX, pF, qe, aJa, acp, bh, at, eG, as); #c1(RONX1T1) c2(NP_001185560) c3(9865) c4(35979, 49036, 62093, 22922, 75150) c5(jK, aw, b, zh, aN, fe, bb, tF, Bz, y, rY, DE, aBP, t, h, N, jV, M, lb, PV, n, iv, oO, jG, u, cj, fU, an, gm, fO, J, MW, pB, P, ll, aX, pF, pi, aq, ie, G, cT, fg, gR, aC, bq, as, ci, pv); #c1(RUNX2) c2(NP_001015051) c3(9866) c4(35980, 49037, 62094, 22923, 75151) c5(B, aw, w, O, cp, arl, kJ, Qx, og, cB, Qf, iv, fO, ft, jT, ag, cAG, arC, Dr, Al, arB, X, kB, pK, U, FA, y, f, bu, cs, WE, oD, av, fy, bm, iF, V, sP, bDW, ji, Tp, b, yU, jy, ey, zJ, hV, cAH, q, jV, ar, ff, hb, Tr, Jm, u, o, wR, I, as, G, IG, nV, cC, Ns, cgs, adq, A, sO, fr, asZ, akL, yw, cAF, aX, h, n, KM, an, adh, be, J, dt, jo, AP, ast, cAl, Nq, zM, Bi); #c1(RONX3) c2(XP_011540653) c3(9867) c4(35981, 49038, 62095, 22924, 75152) c5(jp, ml, aw, bx, amF, dB, w, JH, e, do, aeM, cs, bp, gY, x, fx, jT, kN, DO, os, ag, Lo, i, GD, cY, wy, iq, dV, bw, U, y, co, pw, pp, f, vQ, bu, dZ, B, iv, bv, av, fy, bm, V, nl, aCE, bt, Qt, iA, py, xe, tl, ji, b, cAJ, d, jh, re, q, bVj, es, X, ar, u, da, kF, il, qL, gL, by, Ca, et, aeC, jU, jH, ash, Mp, A, rj, zK, hP, aX, h, cU, iZ, ik, rR, jZ, cV, Be, W, T, ad, fP, rb); #c1(RUVBL1) c2(NP_003698) c3(9868) c4(35982, 49039, 62096, 22925, 75153) c5(BO, A, b, X, re, ad, ag, iT, cs, x, av, u, y); #c1(RUVBL2) c2(NP_006657) c3(9869) c4(35983, 49040, 62097, 22926, 75154) c5(bb, pp, b, q, J, cs, ad, aO, fh); #c1(RXFP1) c2(NP_001240658) c3(9870) c4(35984, 49041, 62098, 22927, 75155) c5(wh, A, b, hV, gv, cU, ra, B, bh, nP, eG, oJ); #c1(RXFP2) c2(NP_001159530) c3(9871) c4(35985, 49042, 62099, 22928, 75156) c5(wh, ck, Lv, B, gv, yy, UT, oJ, bh, nP, cp); #c1(RXFP3) c2(NP_057652) c3(9872) c4(35986, 49043, 62100, 22929, 75157) c5(ih, cU, aA, f); #c1(RXRA) c2(NP_001278849) c3(9873) c4(35987, 49044, 62101, 22930, 75158) c5(da, A, aw, b, aF, lW, dB, au, iL, cO, MZ, U, ha, e, y, d, az, co, ip, h, hV, wN, q, jV, dl, gt, B, cs, vX, fy, u, o, oJ, is, V, I, m, Dg, J, bp, MO, W, jm, T, ff, ny, x, Fr, Mw, ad, IN, BX, wh, nV, Vb, bm, PY, ag, Af, i, I, od, aA, at, fz, Bi); #c1(RXRB) c2(NP_001257330) c3(9874) c4(35988, 49045, 62102, 22931, 75159) c5(da, A, au, y, m, jl, Bi, hV, bu, az, u, aE, o, is, i, cV, bp, im, vM, bIV, IN, I); #c1(RXRG) c2(NP_008848) c3(9875) c4(35989, 49046, 62103, 22932, 75160) c5(nV, b, I, nu, dB, ad, at, Fy, di, cs, bf, aA, cp, jD, o, aM); #c1(RYBP) c2(NP_036366) c3(9876) c4(35990, 49047, 62104, 22933, 75161) c5(b, dA, ak, jz, ix, jQ); #c1(RYK) c2(NP_001005861) c3(9877) c4(35991, 49048, 62105, 22934, 75162) c5(X, Nq, bxC, Ns, av, AP); #c1(RYR1) c2(NP_000531) c3(9878) c4(35992, 49049, 62106, 22935, 75163) c5(A, bDO, aTt, gw, dB, cmJ, AA, di, VI, cO, ayQ, Wi, IZ, bb, b, f, cAM, Aq, kk, oD, bNb, xy, vR, B, aC, nl, el, gL, IR, IX, P, aPk, xS, Ol, Jm, jT, cAK, ayP, AB, aWz, cAL, At, AG, xP, cAN, IS, akL, BK, ap); #c1(RYR2) c2(XP_006711865) c3(9879) c4(35993, 49050, 62107, 22936, 75164) c5(bUK, bf, bDO, xj, akL, lW, sv, di, cO, mL, arL, atV, cAR, oy, cdn, Fp, Mw, bhQ, Wk, cK, f, cAQ, cAQ, mR, cr, oD, hj, aV, Fg, sz, vR, sX, cAP, P, rw, Jm, aX, hR, et, mO, aM, at, sK, acw, ch, ie, o, cAS, dR, bVi, ap); #c1(RYR3) c2(NP_001027) c3(9880) c4(35994, 49051, 62108, 22937, 75165) c5(dx, f, bb, ju, du, eO, cz, dv, P, vR, di, cO, qu, bq, rV, at, ap); #c1(S100A10) c2(NP_002957) c3(9881) c4(35995, 49052, 62109, 22938, 75166) c5(Dr, ak, aw, b, sE, dB, hS, w, cA, U, cM, jh, jd, fq, h, f, bu, u, aFZ, iF, hW, V, v, by, P, T, zK, hU, Ey, aY, jR, ih, kC, fP, dc, rr); #c1(S100A11) c2(NP_005611) c3(9882) c4(35996, 49053, 62110, 22939, 75167) c5(A, b, X, U, y, d, BO, fq, B, q, bu, ZB, ar, oJ, av, u, og, jh, bp, T, fx, wh, nG, i); #c1(S100A12) c2(NP_005612) c3(9883) c4(35997, 49054, 62111, 22940, 75168) c5(dx, QU, hV, Zx, jq, pR, aw, dv, NH, dV, bW, bf, azn, aK, y, cp, ed, qs, co, cy, dy, sG, h, f, Aq, fr, dZ, mg, Gw, D, aD, fP, aM, u, dr, o, aE, dj, im, aC, du, cAT, ft, nV, oE, lo, fy, aqR, nP, wl, dH, jH, at, NG, lc, iV, xe, gd, kC, pH, cV, di, aA, uE, bV); #c1(S100A13) c2(XP_011508166) c3(9884) c4(35998, 49055, 62112, 22941, 75169) c5(co, aX, k, DO, kC, O); #c1(S100A14) c2(XP_005245419) c3(9885) c4(35999, 49056, 62113, 22942, 75170) c5(d, jh, co, il, b, fq, da, mk, T, Xx, ik, fy, u, e, y); #c1(S100A16) c2(NP_525127) c3(9886) c4(36000, 49057, 62114, 22943, 75171) c5(O, b); #c1(S100A1) c2(NP_006262) c3(9887) c4(36001, 49058, 62115, 22944, 75172) c5(dx, aw, dN, sd, EM, sE, jt, aqt, aN, ns, nm, nt, nq, nr, nn, bf, no, np, aK, O, jR, dv, cy, kJ, mR, jq, aC, du, Wc, ft, cV, Lw, fx, ata, Qk, DO, OJ, ag, i, dc, bq, Dr, cY, afY, jz, aNH, atd, bf, auV, U, xw, cAU, chf, agn, yE, rr, B, bu, sh, Tk, av, fy, bm, iT, YV, v, Dp, cK, anG, aY, P, iV, ji, iu, ap, b, apC, d, jh, bb, jd, re, q, es, WO, aug, apB, ar, RF, Xx, Tv, u, ff, QL, aaQ, qC, by, da, avL, iD, jH, iR, aiJ, iq, agb, gd, kC, fl, y, bL, A, MZ, fr, avB, BY, di, lv, gE, cAV, jQ, LS, LI, Tq, fq, Uq, cU, cM, qB, aV, aq, aPQ, acu, adh, be, jo, T, lI, aX, fM, aM, kD, adu, fP, X, rb, rZ); #c1(S100A2) c2(NP_005969) c3(9888) c4(36002, 49059, 62116, 22945, 75173) c5(ml, aw, b, jq, BY, A, ha, e, y, d, jh, co, aX, ip, fq, B, F, bu, do, ar, fy, u, bp, by, T, jC, js, Qk, jR, ag, agm, ji); #c1(S100A3) c2(NP_002951) c3(9889) c4(36003, 49060, 62117, 22946, 75174) c5(fq, by, bu); #c1(S100A4) c2(NP_002952) c3(9890) c4(36004, 49061, 62118, 22947, 75175) c5(B, aw, w, hC, adr, e, O, VC, t, FN, jq, Hs, oJ, g, og, aC, ft, cV, x, fx, jT, ajj, gg, wh, DO, ag, qP, i, Dr, sa, fi, X, iP, jz, 1W, bw, U, cM, co, Ml, yE, f, bu, cs, av, fy, yJ, iF, V, Fr, iA, xd, dP, SR, jR, ji, An, b, QB, ic, z, ha, apg, d, jh, jd, hV, q, zx, fv, ff, ar, u, dh, da, il, LR, ad, G, nV, hX, iR, agf, bL, A, k, fr, lk, BY, iL, jQ, aX, ajn, fq, h, F, cU, ik, y, cB, Jk, acu, J, W, T, by, VF, st, VD, bh, eG); #c1(S100A5) c2(NP_002953) c3(9891) c4(36005, 49062, 62119, 22948, 75176) c5(jd, fq); #c1(S100A6) c2(NP_055439) c3(9892) c4(36006, 49063, 62120, 22949, 75177) c5(A, iL, b, X, boP, eu, w, hC, acu, O, bw, U, jq, e, y, d, Ag, qs, aX, aeM, jd, t, h, f, qF, q, oc, bu, cU, fr, ar, B, Xx, fB, av, u, o, oP, bm, I, BO, Fw, jE, ft, G, T, cV, Fr, iA, by, jG, DP, ao, nV, Bm, ch, YA, jR, og, Af, fq, di, eQ); #c1(S100A7A) c2(NP_789793) c3(9893) c4(36007, 49064, 62121, 22950, 75178) c5(d, da, co, kF, b, mk, Xx, fy, u, e); #c1(S100A7) c2(NP_002954) c3(9894) c4(36008, 49065, 62122, 22951, 75179) c5(aEX, A, aw, b, X, Kc, mk, BY, afo, e, y, jh, d, fq, f, F, bu, eE, B, Xx, u, da, tl, j, by, fx, aeo, azW, aen, i, yA, ic); #c1(S100A8) c2(NP_002955) c3(9895) c4(36009, 49066, 62123, 22952, 75180) c5(dx, B, lg, dN, bx, F, aN, lp, sJ, en, bf, aK, e, lB, dv, cy, iT, eE, R, g, UQ, lb, du, lj, ft, x, fx, jT, kN, dH, lq, lh, akn, fc, bY, ag, cT, w, uO, i, mD, aA, bT, GD, id, Wp, ig, ali, vl, y, ed, co, yE, eD, rr, f, bu, bv, UM, FG, fy, pW, bk, is, SA, le, V, ae, jh, v, bd, bt, bq, li, iA, qH, pi, JY, GB, eA, dY, xe, Im, iu, ap, b, aF, ic, BH, eV, HQ, d, Ag, bb, aiT, jd, re, q, jV, mL, ar, pY, dh, da, ld, lk, kF, I, im, UG, j, by, lo, et, jU, iw, ao, u, aE, gd, ix, dn, I, TP, hd, bL, A, PJ, fr, ln, jc, U, lr, lc, m, aX, fq, h, ox, M, aC, UN, rR, aV, mF, jH, ax, cV, Be, be, J, W, P, T, lI, aM, vu, hq, fP, jN, Ez, at, eG, gf, gl); #c1(S100A9) c2(NP_002956) c3(9896) c4(36010, 49067, 62124, 22953, 75181) c5(dx, B, aw, dN, bx, bao, dB, aN, sJ, w, bf, aK, e, O, gO, dv, Vx, t, lg, iT, eE, zR, g, mz, UQ, aC, du, x, fx, jT, dH, fc, bY, rS, cT, uO, i, bq, aA, bT, id, ig, fU, U, y, ed, pw, ag, eD, rr, f, bu, k, yE, UM, FG, fy, bm, pW, bk, aEq, V, ae, v, bd, bt, cl, aen, jR, xe, ji, iu, ap, bn, b, aF, eV, HQ, d, bb, jd, re, sO, q, yp, vu, ar, Xx, pY, dh, o, da, PJ, kF, il, im, UG, j, by, Fo, ln, jU, jH, ao, fD, u, mA, aE, gd, ix, I, hd, bL, A, qd, BY, al, m, aX, I, wG, UN, ik, n, aV, ax, cV, Be, be, J, W, P, T, lI, aM, st, Y, hq, G, fP, fq, at, eG, gf, gl); #c1(S100B) c2(NP_006263) c3(9897) c4(36011, 49068, 62125, 22954, 75182) c5(dx, f, aw, dN, sd, EM, sE, jt, aqt, aN, ns, nm, nt, nq, nr, nn, bf, no, np, aK, O, jR, dv, cy, acL, iR, hG, jq, aBs, aC, sH, du, Wc, ft, auf, cV, Lw, fx, jT, Qk, DO, mE, OJ, ag, w, i, dc, bq, ku, mZ, aid, Kt, aaL, aPm, cY, afY, cO, jz, aNH, atd, hS, cA, U, xw, cM, chf, agn, yE, ak, bu, B, Tk, fy, bm, YV, SV, Bs, qC, v, Dp, cK, anG, aY, kJ, P, iV, ape, ji, aEN, kD, b, apC, jJ, QL, jD, jh, bb, yQ, jd, q, es, aug, apB, ar, RF, Xx, Tv, u, dh, o, ff, aAf, aaQ, aHZ, Kx, qA, ht, gL, by, da, xk, agl, iD, bhT, jH, iq, ch, eQ, hT, iq, agb, ih, gd, kC, OI, fl, fh, y, bL, A, MZ, k, fr, avB, BY, lv, gE, cAV, jQ, m, aX, LI, Tq, auV, cAU, aV, aq, dj, ma, hW, aPQ, acu, adh, be, jo, T, lI, fM, aM, iu, adu, fP, avL, al rb, rZ); #c1(S100P) c2(NP_005971) c3(9898) c4(36012, 49069, 62126, 22955, 75183) c5(A, b, X, gG, dB, aES, bw, U, y, jh, kJ, re, B, yh, q, bu, ar, ff, cs, fv, av, fy, u, bm, kF, V, ad, W, T, x, by, jH, jE, iR, Qk, ag, fP, bM, eG); #c1(S100Z) c2(NP_570128) c3(9899) c4(36013, 49070, 62127, 22956, 75184) c5(jH); #c1(S1PR2) c2(NP_004221) c3(9900) c4(36014, 49071, 62128, 22957, 75185) c5(dx, bL, du, ed, aC, ch, f, cT, O, hR, u, eG, y); #c1(S1PR3) c2(NP_005217) c3(9901) c4(36015, 49072, 62129, 22958, 75186) c5(aw, b, aC, aF, gf, jq, bny, u, dh, y); #c1(S1PR4) c2(NP_003766) c3(9902) c4(36016, 49073, 62130, 22959, 75187) c5(ch, u, y, b); #c1(S1PR5) c2(NP_001159687) c3(9903) c4(36017, 49074, 62131, 22960, 75188) c5(A, ch, f, J, w, B, aA); #c1(SAA1) c2(NP_001171477) c3(9904) c4(36018, 49075, 62132, 22961, 75189) c5(dx, da, b, eH, di, Ku, nI, gE, aK, LP, dv, f, q, tF, dQ, n, cs, jM, o, qD, ax, ob, qb, aC, du, wE, gL, ad, Q, cV, x, pi, aA, be, dH, jH, at, fN, er, ZI, iV, aGQ, pt, aT, gl, ap); #c1(SAA2) c2(NP_001120852) c3(9905) c4(36019, 49076, 62133, 22962, 75190) c5(hW, aC, er, iV, Ku, al LP, o, ap); #c1(SAA4) c2(NP_006503) c3(9906) c4(36020, 49077, 62134, 22963, 75191) c5(gT, fr, ft, Ku, at, LP); #c1(SAAL1) c2(NP_612430) c3(9907) c4(36021, 49078, 62135, 22964, 75192) c5(aC, zH, xU); #c1(SAC3D1) c2(NP_037431) c3(9908) c4(36022, 49079, 62136, 22965, 75193) c5(cs, aX, ad); #c1(SACM1L) c2(NP_054735) c3(9909) c4(36023, 49080, 62137, 22966, 75194) c5(wK, Ps, bb, I, aC, t, jz, J, G, Ru, vY, ur, lv, et, bf, jQ, u, y, aM); #c1(SACS) c2(NP_001264984) c3(9910) c4(36024, 49081, 62138, 22967, 75195) c5(Y, adD, bK, adz, v, kV, zk, hM, bk, KX, kS, ac, zp); #c1(SAE1) c2(NP_001139185) c3(9911) c4(36025, 49082, 62139, 22968, 75196) c5(aV, u); #c1(SAFB2) c2(NP_055464) c3(9912) c4(36026, 49083, 62140, 22969, 75197) c5(f, u, b); #c1(SAFB) c2(NP_001188267) c3(9913) c4(36027, 49084, 62141, 22970, 75198) c5(oC, en, b, aPI, gG, e, y, d, re, f, fa, ar, u, iT, RG, jv, py, he, akm, fY, dn, Mp); #c1(SAGE1) c2(NP_061136) c3(9914) c4(36028, 49085, 62142, 22971, 75199) c5(B, aw, b, GL, HG, mk, BY, w, sF, bj, e, y, d, co, cy, ml, hV, bu, O, A, fy, u, I, wV, bp, by, T, aX, fx, ao, nV, bey, jR, wP, Oi, aA); #c1(SAG) c2(NP_000532) c3(9915) c4(36029, 49086, 62143, 22972, 75200) c5(en, Mj, ud, bgm, ix, Mn, ml, f, DC, cs, dh, ax, chu, nW, qJ, ln, dH, bgn, ayr, cAW, aE, fP, agS, nE, rn, ap); #c1(SALL1) c2(NP_001121364) c3(9916) c4(36030, 49087, 62144, 22973, 75201) c5(wh, atj, b, cAX, et, fl, aNb, fe, Ni, bkt, bkJ, afA, zg, u, y, oJ); #c1(SALL2) c2(NP_005398) c3(9917) c4(36031, 49088, 62145, 22974, 75202) c5(fe, pp, kH, X, w, av, jx); #c1(SALL3) c2(NP_741996) c3(9918) c4(36032, 49089, 62146, 22975, 75203) c5(aC, pD, AP, q, b); #c1(SALL4) C2(NP_065169) c3(9919) c4(36033, 49090, 62147, 22976, 75204) c5(ats, b, aCb, cAZ, jw, U, xw, oU, y, aNF, jT, cr, am, pp, t, h, q, bu, O, iv, oO, cAY, u, n, arP, V, J, by, G, Ap, AP, avY, acw, hT, bq, ci); #c1(SAMD14) c2(NP_777580) c3(9920) c4(36034, 49091, 62148, 22977, 75205) c5(ji, zY, ar); #c1(SAMD1) c2(NP_612361) c3(9921) c4(36035, 49092, 62149, 22978, 75206) c5(dx, dv, du); #c1(SAMD4A) c2(NP_001155048) c3(9922) c4(36036, 49093, 62150, 22979, 75207) c5(IV); #c1(SAMD5) c2(NP_001025231) c3(9923) c4(36037, 49094, 62151, 22980, 75208) c5(o); #c1(SAMD9) c2(NP_060124) c3(9924) c4(36038, 49095, 62152, 22981, 75209) c5(dx, en, b, du, ad, dv, cs, bsO, mm, cBa); #c1(SAMD9L) c2(NP_001290426) c3(9925) c4(36039, 49096, 62153, 22982, 75210) c5(b); #c1(SAMHD1) c2(NP_056289) c3(9926) c4(36040, 49097, 62154, 22983, 75211) c5(EO, m, cBb, bb, aeq, P, hq, J, cT, fl, agl, EQ, ZM, fl, hT, cBc, O, ll); #c1(SAMM50) c2(NP_056195) c3(9927) c4(36041, 49098, 62155, 22984, 75212) c5(at); #c1(SAMSN1) c2(NP_001243299) c3(9928) c4(36042, 49099, 62156, 22985, 75213) c5(oy, jH, fl, dA, hX, bp, w, aq, O); #c1(SAP3OBP) c2(NP_001288768) c3(9929) c4(36043, 49100, 62157, 22986, 75214) c5(aA, O); #c1(SAP3OL) c2(NP_001124534) c3(9930) c4(36044, 49101, 62158, 22987, 75215) c5(bf, kF); #c1(SAPCD1) c2(NP_001034740) c3(9931) c4(36045, 49102, 62159, 22988, 75216) c5(aC, m, aW); #c1(SAPCD2) c2(NP_848543) c3(9932) c4(36046, 49103, 62160, 22989, 75217) c5(by, U, cs, V, bu); #c1(SAR1A) c2(NP_001136120) c3(9933) c4(36047, 49104, 62161, 22990, 75218) c5(qt, aC, fS, sB, gm, akB, o); #c1(SAR1B) C2(NP_001028675) c3(9934) c4(36048, 49105, 62162, 22991, 75219) c5(aah, aF, aag, cr, fS); #c1(SARDH) c2(NP_001128179) c3(9935) c4(36049, 49106, 62163, 22992, 75220) c5(IJ, en, b, EM, dB, A, di, O, wf, ey, ho, ca, y, ec, kW, f, B, u, oJ, I, aC, J, jo, agl, ff, VP, cK, fx, fM, wh, anG, P, cBd, we, yE, i, T, wq); #c1(SARM1) c2(NP_055892) c3(9936) c4(36050, 49107, 62164, 22993, 75221) c5(cck, en, DM, f, gm, dQ, jT); #c1(SARNP) c2(NP_149073) c3(9937) c4(36051, 49108, 62165, 22994, 75222) c5(co, fD, b, q, gv, fv, iL, iv, bh, fy); #c1(SARS2) c2(NP_001139373) c3(9938) c4(36052, 49109, 62166, 22995, 75223) c5(en, Ny, TQ, vB, Ey, C, y, ob, yX, cco, Eg, q, cs, qj, gg, u, aNN, sQ, apx, cBe, Dg, sy, P, II, aZ, ajd, aeq, aei, bm, hT, fW, gd, auy, bq, eg, gf); #c1(SART1) c2(NP_005137) c3(9939) c4(36053, 49110, 62167, 22996, 75224) c5(d, A, V, b, w, U, u, e, y); #c1(SART3) c2(NP_055521) c3(9940) c4(36054, 49111, 62168, 22997, 75225) c5(A, b, X, ahM, jz, lv, y, jQ, cy, re, B, dZ, av, cV, LR, agR, fU, ad, fx, jT, aQv, wV, wP, zO, dV); #c1(SASH1) c2(NP_056093) c3(9941) c4(36055, 49112, 62169, 22998, 75226) c5(co, aw, b, afW, ad, o, cs, x, u, y); #c1(SASH3) c2(NP_061863) c3(9942) c4(36056, 49113, 62170, 22999, 75227) c5(hR, cs, ad); #c1(SAT1) c2(NP_002961) c3(9943) c4(36057, 49114, 62171, 23000, 75228) c5(dx, ak, b, X, anb, iU, JJ, ma, cO, cA, U, bUr, A, cM, co, aX, bkk, f, q, bu, jT, y, cs, av, fy, u, dj, fU, hW, V, I, B, aC, NZ, fO, fl, ad, W, dv, eX, x, Hh, fx, by, jH, du, aY, bm, bgr, ih, akO, wq, MR, dc, gj, Oi, aA, at, bp); #c1(SAT2) c2(NP_597998) c3(9944) c4(36058, 49115, 62172, 23001, 75229) c5(aX, b, LQ, DP, q, gL, bu, W, T, i, Qt, I, ar, u, y); #c1(SATB1) c2(NP_001182399) c3(9945) c4(36059, 49116, 62173, 23002, 75230) c5(A, b, dB, w, Bo, U, fx, y, d, co, h, B, e, q, bu, O, cB, cs, as, fH, bm, da, V, an, Qf, by, T, fT, jT, f J, jE, u, fP, i, I, Oi); #c1(SATB2) c2(XP_005246453) c3(9946) c4(36060, 49117, 62174, 23003, 75231) c5(b, fr, cBi, zK, U, oy, QV, nU, F, cBf, cU, rR, fU, V, ft, cBh, T, cBg, iA, AP, jH, rQ, Nq, Ez); #c1(SATL1) c2(NP_001012998) c3(9947) c4(36061, 49118, 62175, 23004, 75232) c5(ao); #c1(SAV1) c2(NP_068590) c3(9948) c4(36062, 49119, 62176, 23005, 75233) c5(pR, b, cO); #c1(SBDS) c2(NP_057122) c3(9949) c4(36063, 49120, 62177, 23006, 75234) c5(WH, en, eq, b, eM, aE, aN, aZF, ig, A, di, z, asl, gZ, aK, e, cM, cp, yt, BO, jT, aX, wp, AG, ps, h, f, iT, re, aC, hN, ar, B, cs, as, Ry, o, n, cj, d, arQ, CZ, I, m, an, hZ, qC, fO, EC, VX, v, alf, CM, j, bt, aGa, J, ad, aA, qK, iw, aKy, aVR, Jh, bCb, Yb, xe, aY, cT, ss, bk, dc, mD, ael, at, ci, oT); #c1(SBF1) c2(NP_002963) c3(9950) c4(36064, 49121, 62178, 23007, 75235) c5(bbO, NT, aX, am, cG, dt, wn, ac, bb, cBj, cgL); #c1(SBF2) c2(NP_112224) c3(9951) c4(36065, 49122, 62179, 23008, 75236) c5(bbO, cG, DR, er, xP, b, ahe, vY, cBk, ac, cgM, cgL); #c1(SBNO1) c2(NP_001161328) c3(9952) c4(36066, 49123, 62180, 23009, 75237) c5(T, hT, OH, fy); #c1(SBNO2) c2(NP_001093592) c3(9953) c4(36067, 49124, 62181, 23010, 75238) c5(MS, jH, fy, T, fP); #c1 (SBSN) c2(NP_001159506) c3(9954) c4(36068, 49125, 62182, 23011, 75239) c5(co, rb); #c1(SC5D) c2(NP_008849) c3(9955) c4(36069, 49126, 62183, 23012, 75240) c5(B, bb, aC, nU, Nq, bfd, A, z); #c1(SCAF11) C2(NP_004710) c3(9956) c4(36070, 49127, 62184, 23013, 75241) c5(b, ahS, dB, iG, e, U, d, F, q, bu, kz, cs, av, fy, Tu, by, P, ahO, T, ad, OA, bm, aq, aAp); #c1(SCAF1) c2(NP_067051) c3(9957) c4(36071, 49128, 62185, 23014, 75242) c5(aNl, aNk, lb, bK, gE, J, jV, gv, acO, X, axl, pK, cs, bh, av, ad, u, y); #c1(SCAF4) c2(NP_001138916) c3(9958) c4(36072, 49129, 62186, 23015, 75243) c5(wf, bf, td, aM); #c1(SCAF8) c2(NP_001273118) c3(9959) c4(36073, 49130, 62187, 23016, 75244) c5(ak, cy); #c1 (SCAI) c2(NP_001138349) c3(9960) c4(36074, 49131, 62188, 23017, 75245) c5(Hs, u, y, b); #c1(SCAMP2) c2(NP_005688) c3(9961) c4(36075, 49132, 62189, 23018, 75246) c5(JJ, FU); #c1(SCAMP5) c2(XP_006720483) c3(9962) c4(36076, 49133, 62190, 23019, 75247) c5(cz); #c1(SCAPER) c2(NP_001139395) c3(9963) c4(36077, 49134, 62191, 23020, 75248) c5(HI, zL, nU, jI, aW); #c1(SCAP) c2(NP_036367) c3(9964) c4(36078, 49135, 62192, 23021, 75249) c5(dx, du, ch, dD, f, q, ex, eH, dv, o, bq, aA, hR, ZH, at); #c1(SCARA3) c2(NP_057324) c3(9965) c4(36079, 49136, 62193, 23022, 75250) c5(dx, du, co, aw, Ov, b, X, iP, f, fO, fI, iH, Be, A, T, B, Ou, av, u, y); #c1(SCARA5) c2(NP_776194) c3(9966) c4(36080, 49137, 62194, 23023, 75251) c5(q, b); #c1(SCARB1) C2(NP_001076428) c3(9967) c4(36081, 49138, 62195, 23024, 75252) c5(dx, b, dD, jj, ZG, eH, dv, dd, gE, bf, bbz, anW, aW, d, Ag, aXe, oB, f, e, do, y, hb, cBI, PH, u, o, ff, fD, I, jN, du, dB, gL, eu, W, P, BM, T, hR, kS, ac, aM, acT, Af, i, I, bq, aA, at, ap); #c1(SCARB2) c2(NP_001191184) c3(9968) c4(36082, 49139, 62196, 23025, 75253) c5(bP, A, cy, ahd, k, aYi, B, gJ, v, wz, bd, hS, zk, di, ll, yH, cO, cK, bj, ahe, zp); #c1(SCARF2) c2(NP_699165) c3(9969) c4(36083, 49140, 62197, 23026, 75254) c5(cBm, ac); #c1 (SCCPDH) c2(NP_057086) c3(9970) c4(36084, 49141, 62198, 23027, 75255) c5(bq); #c1(SCD5) c2(NP_001032671) c3(9971) c4(36085, 49142, 62199, 23028, 75256) c5(m, aC, nl, P, T, bq, o, oT); #c1(SCD) c2(NP_005054) c3(9972) c4(36086, 49143, 62200, 23029, 75257) c5(dx, A, aw, b, fN, X, le, aE, rd, ds, bf, fx, cM, Ag, co, f, q, bu, Ex, y, ar, hj, sK, u, nj, o, ah, em, bm, I, du, ao, hep, Fy, dv, T, eX, Fr, gF, by, av, mO, aM, pk, qt, aY, pP, B, ep, Af, i, dc, rw, aA, at, fj, ap); #c1(SCFD1) c2(NP_001244305) c3(9973) c4(36087, 49144, 62201, 23030, 75258) c5(ma, b); #c1(SCFD2) c2(NP_689753) c3(9974) c4(36088, 49145, 62202, 23031, 75259) c5(Eo, ajZ, pk, dA); #c1(SCG2) c2(NP_003460) c3(9975) c4(36089, 49146, 62203, 23032, 75260) c5(b, jt, ig, di, cO, bf, LS, f, es, ar, aV, dh, cV, aC, aX, bb, aM, ao, qp, re, jR, rv, bq, at); #c1(SCG3) c2(NP_001158729) c3(9976) c4(36090, 49147, 62204, 23033, 75261) c5(cy, b, cV, q, Uq, W, aA, o); #c1(SCG5) c2(NP_001138229) c3(9977) c4(36091, 49148, 62205, 23034, 75262) c5(oy, mz, fU, V, k, X, jR, Jq, cBn, qP, w, co, U, AR, av, O); #c1(SCGB1A1) c2(NP_003348) c3(9978) c4(36092, 49149, 62206, 23035, 75263) c5(aEg, A, nk, vg, b, X, gG, DT, Ka, Kc, mk, sJ, aDu, di, tG, VG, vp, eD, y, fh, bwh, co, bb, Be, DM, B, vy, dl, aC, do, vu, ar, aD, av, u, ri, NO, g, cBo, I, m, bam, Al, Kd, gL, BZ, vc, ti, T, aFo, aZ, cy, iA, et, gg, W, aH, aoC, hU, zE, dP, Ey, Ic, JQ, gd, Dl, fl, fD, I, ji, at, bp, gf); #c1(SCGB1D1) c2(NP_006543) c3(9979) c4(36093, 49150, 62207, 23036, 75264) c5(d, aKN, dN, eY, aEU, P, ar, iL, bq, aA, at, e, aW, ap); #c1(SCGB1D2) c2(NP_006542) c3(9980) c4(36094, 49151, 62208, 23037, 75265) c5(iF, b, X, DP, yE, T, di, av, u, y); #c1(SCGB2A1) c2(NP_002398) c3(9981) c4(36095, 49152, 62209, 23038, 75266) c5(b, X, gG, bXG, U, y, Ne, aX, q, bu, cU, ar, cs, av, bm, avs, V, by, T, iA, ad, u); #c1(SCGB2A2) c2(NP_002402) c3(9982) c4(36096, 49153, 62210, 23039, 75267) c5(aw, b, X, re, bp, iT, T, y, ar, av, u, aW); #c1(SCGB2B2) c2(NP_001020762) c3(9983) c4(36097, 49154, 62211, 23040, 75268) c5(oy); #c1 (SCGB3A1) c2(NP_443095) c3(9984) c4(36098, 49155, 62212, 23041, 75269) c5(en, b, Lv, ck, kY, A, e, y, d, co, h, ar, cI, cB, fy, u, fU, Xp, cV, J, bp, W, T, et, jT, eG); #c1(SCGB3A2) c2(NP_473364) c3(9985) c4(36099, 49156, 62213, 23042, 75270) c5(cy, gd, ti, aCE, aD, Al, gg, iu, ge, bk); #c1(SCGN) c2(NP_008929) c3(9986) c4(36100, 49157, 62214, 23043, 75271) c5(iF, U, nH, V, yE); #c1 (SCHIP1) c2(NP_001184036) c3(9987) c4(36101, 49158, 62215, 23044, 75272) c5(ig, pR, sh, et, sg); #c1(SCIN) c2(NP_001106177) c3(9988) c4(36102, 49159, 62216, 23045, 75273) c5(jK, A, B, cO); #c1(SCLT1) c2(NP_001287826) c3(9989) c4(36103, 49160, 62217, 23046, 75274) c5(Zm, Ba, V, ae, ahN, aF, sE, Dp, Zr, vU, beG, sj, pB, U); #c1(SCLY) c2(NP_057594) c3(9990) c4(36104, 49161, 62218, 23047, 75275) c5(b, qz, jz, eu, pz, lv, eM, jy, zL, gZ, adr, oU, cM, jQ, d, aX, bYc, t, h, f, q, e, M, bdv, iv, si, aqQ, aC, gm, j, J, bcL, G, Ql, T, jl, Ew, aY, ie, aQM, xe, ih, dc, aA, cbl, apT); #c1(SCML2) c2(NP_006080) c3(9991) c4(36105, 49162, 62219, 23048, 75276) c5(jR); #c1(SCML4) c2(NP_932347) c3(9992) c4(36106, 49163, 62220, 23049, 75277) c5(dA); #c1 (SCN10A) c2(NP_006505) c3(9993) c4(36107, 49164, 62221, 23050, 75278) c5(cy, cBp, b, Y, aZX, u, h, cV, ajW, y, MO, mL, atb, dV, xX, sX, cmn, dR, dZ, Fg, akn); #c1(SCN11A) c2(XP_011531622) c3(9994) c4(36108, 49165, 62222, 23051, 75279) c5(A, aX, Y, B, cBq, ac, cBr, eG, cmn); #c1(SCN1A) c2(NP_001159435) c3(9995) c4(36109, 49166, 62223, 23052, 75280) c5(vf, ckF, aw, bFi, X, aF, cBt, cBs, Id, hS, Ty, cBu, pu, cBx, U, xw, e, dl, oy, avQ, jr, or, kW, byZ, Wk, re, In, cBy, hY, iZ, ar, bK, IL, av, CG, Fg, cBw, d, V, cV, cBv, Iq, cz, akq, akw, sD, hw, bed, b, sG, Nl, dk, lC, xM, hT, akA, Gh, SK, iT, yH, agQ, XX, T, dR, zn); #c1(SCN1B) c2(NP_001028) c3(9996) c4(36110, 49167, 62224, 23053, 75281) c5(cBz, I, byZ, sX, cBB, Id, akA, hS, iZ, ajW, hY, cBA, yH, Fp, u, y); #c1 (SCN2A) c2(XP_005246807) c3(9997) c4(36111, 49168, 62225, 23054, 75282) c5(WW, cBD, cBF, hS, cBE, bj, avQ, cBC, byZ, re, nU, hY, iZ, IL, cBG, CG, iT, yH, cz, rw, akB, ac, akA, Gh, lC, at); #c1(SCN2B) c2(NP_004579) c3(9998) c4(36112, 49169, 62226, 23055, 75283) c5(avQ, zE, sX, ajW, hS, cBH); #c1(SCN3A) c2(NP_001075145) c3(9999) c4(36113, 49170, 62227, 23056, 75284) c5(cBI, nU, cz, hS, atb, IL, acg); #c1(SCN3B) c2(XP_011541199) c3(10000) c4(36114, 49171, 62228, 23057, 75285) c5(cBJ, sX, uC, arL, ajW); #c1(SCN4A) c2(NP_000325) c3(10001) c4(36115, 49172, 62229, 23058, 75286) c5(bNI, b, cG, bmJ, AA, aFe, cBM, re, aW, IZ, h, Iw, ayQ, blu, mL, n, iT, oD, aPs, nl, el, cBL, cBK, Ij, Jm, ac, xQ, huh, ayP, Io, aMf, dR, aUE, aOI); #c1(SCN4B) c2(NP_001135820) c3(10002) c4(36116, 49173, 62230, 23059, 75287) c5(sX, le, mO, cBN); #c1(SCN5A) c2(NP_000326) c3(10003) c4(36117, 49174, 62231, 23060, 75288) c5(bUK, fh, f, aw, cBY, b, u, fj, uC, le, rr, xj, aE, id, dV, atV, cO, cBT, sx, y, Jy, aoa, ec, Fp, arL, I, cBU, cBQ, cCa, bdC, Iw, ajW, akf, cBX, dl, mL, mR, mO, cBZ, cs, hj, cBW, ap, Fg, bNb, cCc, cCb, wp, bUz, cBB, fO, ad, dt, QU, bHo, cBS, dZ, bNI, sX, cK, hR, adx, cBR, bgc, dR, cBP, cBV, aY, bin, JA, dh, vW, bmJ, MA, rw, bq, at, bVi, bHp, cBO); #c1(SCN7A) c2(NP_002967) c3(10004) c4(36118, 49175, 62232, 23061, 75289) c5(ao, awl, lU, hS, auz, cV, jt, ajW, tR, es, Lm, iZ, di, jR, p, wX, cz, aAr, Yp, n); #c1(SCN8A) c2(NP_001171455) c3(10005) c4(36119, 49176, 62233, 23062, 75290) c5(ak, em, eR, hS, IL, jR, cO, Fh, xw, bj, cM, xT, cCd, adc, nU, vu, O, cCe, zR, aV, iT, AS, aPI, qw, hW, rP, bK, dk, v, yH, P, wq, kS, lD, IC, xM, Ck, iV, bM, aT, GJ, re); #c1(SCN9A) c2(NP_002968) c3(10006) c4(36120, 49177, 62234, 23063, 75291) c5(aUa, A, hS, aFh, dV, bAt, wk, cmn, cCh, xT, aZX, bj, In, yp, dZ, y, fy, u, ccW, aqP, bND, nu, dt, cCi, bNI, cCg, aPt, Y, vu, hn, B, vW, atb, Gu, bNz, dR, cCf); #c1(SCNM1) c2(NP_001191785) c3(10007) c4(36121, 49178, 62235, 23064, 75292) c5(bK, bM); #c1(SCNNIA) c2(NP_001029) c3(10008) c4(36122, 49179, 62236, 23065, 75293) c5(dx, vg, b, nl, vB, mk, di, clT, tG, aic, Lr, bj, pi, oy, qs, cy, eX, MV, dl, u, vR, kF, I, cV, sH, du, bd, gL, vc, aZ, cr, et, cCj, ao, Ic, bk, sU); #c1(SCNN1B) c2(NP_000327) c3(10009) c4(36123, 49180, 62237, 23066, 75294) c5(oy, dx, vR, I, jH, sH, du, bd, vw, dB, MV, aem, di, clT, aZ, aic, aMg, bk); #c1(SCNN1D) c2(XP_011540201) c3(10010) c4(36124, 49181, 62238, 23067, 75295) c5(aX, dn, O); #c1(SCNN1G) c2(NP_001030) c3(10011) c4(36125, 49182, 62239, 23068, 75296) c5(oy, d, aem, bk, b, dx, du, MV, ag, di, clT, aZ, aic, D, e, jH, cCk); #c1(SCO1) c2(NP_004580) c3(10012) c4(36126, 49183, 62240, 23069, 75297) c5(ae, cCn, kW, hT, alx, acU, z, cCm, cCl, sK); #c1(SCO2) c2(NP_001162582) c3(10013) c4(36127, 49184, 62241, 23070, 75298) c5(ake, en, SS, asf, cCp, bdo, kW, xJ, q, kz, cc, hT, bm, cCo, acU, cK, sK, pQ, apR, Y, Bu, apA); #c1(SCP2DI) c2(NP_848578) c3(10014) c4(36128, 49185, 62242, 23071, 75299) c5(cV, cO); #c1(SCPEPI) c2(NP_067639) c3(10015) c4(36129, 49186, 62243, 23072, 75300) c5(ck, b, fO, M, di, WP, jG, u, y); #c1(SCR1B) c2(NP_056171) c3(10016) c4(36130, 49187, 62244, 23073, 75301) c5(BO, IJ, b, Ip, x, et, u, y); #c1(SCRN1) c2(NP_001138986) c3(10017) c4(36131, 49188, 62245, 23074, 75302) c5(by, V, b, f, ad, bV, cs, U, bu); #c1(SCT) C2(XP_011518583) c3(10018) c4(36132, 49189, 62246, 23075, 75303) c5(bP, b, bvu, aiW, jz, CS, Bh, hw, jy, kF, pz, gG, jQ, M, co, Ml, t, h, jT, q, ayi, az, ar, n, aMg, iv, bv, fH, jG, bm, aAf, asd, le, hW, xc, cV, qL, be, gJ, v, J, qt, G, T, ll, aff, aX, cz, pi, f J, jE, oQ, OR, Ck, aNp, ag, cT, ah, fl, rw, oM, pt, ci); #c1(SCTR) c2(NP_002971) c3(10019) c4(36133, 49190, 62247, 23076, 75304) c5(gG, jE, A, DE, b, fv, B, q, W, ag, Bh, T, IN, ar, et, bw, bm); #c1(SCUBE1) c2(NP_766638) c3(10020) c4(36134, 49191, 62248, 23077, 75305) c5(eu); #c1 (SCUBE2) c2(NP_001164161) c3(10021) c4(36135, 49192, 62249, 23078, 75306) c5(aw, b, i, I, u, y); #c1(SCUBE3) c2(NP_689966) c3(10022) c4(36136, 49193, 62250, 23079, 75307) c5(dB, b); #c1(SCYL1) c2(NP_001041683) c3(10023) c4(36137, 49194, 62251, 23080, 75308) c5(A, zw, b, zH, X, apC, iP, dB, w, e, bu, eV, O, zr, d, co, jl, zu, t, h, B, F, zx, M, zB, cB, fU, ae, zA, v, J, P, T, vM, by, jH, jT, zE, alt, ie, G, ag, re, IA); #c1(SCYL3) c2(NP_065156) c3(10024) c4(36138, 49195, 62252, 23081, 75309) c5(cp); #c1(SDC1) c2(NP_001006947) c3(10025) c4(36139, 49196, 62253, 23082, 75310) c5(B, aw, oz, eH, Ir, e, O, BO, nL, fH, Zv, aC, gm, bp, ft, fx, jT, av, Ip, fc, ag, cT, i, bq, aA, sU, X, iP, iG, bw, U, y, co, px, pp, f, bu, gg, fy, bm, iT, V, MW, iA, f J, jR, gR, WH, ach, b, aOQ, ic, aiR, Mr, d, eA, apG, re, q, ar, u, da, Dg, LR, jU, jH, nV, iR, rg, yA, A, kY, aov, fr, apY, BY, blu, hP, m, aX, h, cU, aV, fU, cV, J, T, fO, DG, zM, fP, E, al eG, rb); #c1(SDC2) c2(NP_002989) c3(10026) c4(36140, 49197, 62254, 23083, 75311) c5(dx, Dr, b, fr, eH, kB, cO, U, ps, yw, y, wB, bb, XZ, Bi, f, q, Cc, Um, fv, cs, vo, gg, u, fi, du, fs, V, I, dA, aC, LR, aB, j, ad, P, T, aX, ft, et, be, nV, Eu, DO, Ng, Ns, ag, cT, aA, aaA, rb); #c1(SDC3) c2(XP_011540764) c3(10027) c4(36141, 49198, 62255, 23084, 75312) c5(c, aC, PA, vF, y, aA, O);

c1(SDC4) c2(NP_002990) c3(10028) c4(36142, 49199, 62256, 23085, 75313) c5(dx, id, b, fr, mk, cO, aX, aiT, h, f, cs, fy, da, du, aB, ad, T, cy, ft, pi, Eu, eF, hX, fG, bq); #c1(SDCBP2) c2(NP_001186713) c3(10029) c4(36143, 49200, 62257, 23086, 75314) c5(bQQ); #c1(SDCBP) c2(NP_001007069) c3(10030) c4(36144, 49201, 62258, 23087, 75315) c5(aX, b, cY, eu, bu, y, jC, bQQ, by, u, aw); #c1(SDCCAG3) c2(NP_001034796) c3(10031) c4(36145, 49202, 62259, 23088, 75316) c5(ad); #c1(SDCCAG8) c2(NP_006633) c3(10032) c4(36146, 49203, 62260, 23089, 75317) c5(cCg, ml, TD, P, aA, aV); #c1(SDF2) c2(NP_008854) c3(10033) c4(36147, 49204, 62261, 23090, 75318) c5(cy, u, I, y); #c1(SDF2L1) c2(NP_071327) c3(10034) c4(36148, 49205, 62262, 23091, 75319) c5(A, cO); #c1(SDF4) c2(XP_011539858) c3(10035) c4(36149, 49206, 62263, 23092, 75320) c5(B, b, DO, lk, apC, dB, aN, mk, A, U, y, VC, co, aX, bn, fq, h, hV, bu, eE, Xx, aD, u, da, fi, gG, V, cs, v, ad, T, cy, fx, by, er, HN, ag, i, iu); #c1(SDHAF1) c2(NP_001036096) c3(10036) c4(36150, 49207, 62264, 23093, 75321) c5(bFg, cCs, cCr); #c1(SD-HAF2) c2(NP_060311) c3(10037) c4(36151, 49208, 62265, 23094, 75322) c5(cCt, BS, anG, qp, DE, b, anP, YR, B, HC, co, T, VP); #c1(SDHAF4) c2(NP_660310) c3(10038) c4(36152, 49209, 62266, 23095, 75323) c5(1); #c1(SDHA) c2(NP_001281261) c3(10039) c4(36153, 49210, 62267, 23096, 75324) c5(ake, cCv, A, cCw, anG, cCu, cJ, re, hT, dB, cV, cCr, yE, mR, fM, i, VP, cK, fx, cCs, iT); #c1(SDHC) c2(NP_001030588) c3(10040) c4(36154, 49211, 62268, 23097, 75325) c5(QU, A, b, iF, fr, dB, oi, di, hh, Hq, or, ip, hV, q, dQ, B, fy, bm, ff, cCx, ft, jo, T, VP, Jw, nP, fM, aNm, anG, mA, Le); #c1(SDHD) c2(NP_002993) c3(10041) c4(36155, 49212, 62269, 23098, 75326) c5(QU, aw, b, iF, Zy, gw, dB, Hq, ale, bu, cCs, Ld, bWO, aX, or, ip, cCy, re, hV, bPv, jV, cCr, pn, Gw, EM, ff, aAF, ca, aub, lb, dt, jo, cCz, T, cV, VP, nP, fM, pb, W, qp, aNm, chm, anG, Le, bLx, Bm, abs); #c1(SDK1) c2(NP_689957) c3(10042) c4(36156, 49213, 62270, 23099, 75327) c5(A, bb, cV, B, P, di, iG, cO, hW, bq, te); #c1(SDK2) c2(NP_001138424) c3(10043) c4(36157, 49214, 62271, 23100, 75328) c5(bf, wX); #c1 (SDPR) c2(NP_004648) c3(10044) c4(36158, 49215, 62272, 23101, 75329) c5(m, mW, baz, cO, u, gl, y); #c1 (SDR42E1) c2(XP_011521772) c3(10045) c4(36159, 49216, 62273, 23102, 75330) c5(ais); #c1(SDR9C7) c2(NP_683695) c3(10046) c4(36160, 49217, 62274, 23103, 75331) c5(jh); #c1(SDS) c2(NP_006834) c3(10047) c4(36161, 49218, 62275, 23104, 75332) c5(en, b, EM, arQ, dB, aE, aN, aZF, ig, m, A, di, wf, asl, ey, gZ, aK, ca, cM, d, BO, jT, aX, wp, kW, yE, VX, h, f, e, iT, aC, ar, B, cs, as, Ry, o, oJ, I, ec, an, hZ, qC, fO, FC, j, v, alf, jo, T, ff, eg, aGa, VP, cK, fx, ad, fM, qK, wh, anG, aY, Jh, bCb, Yb, xe, we, AG, cT, bk, i, dc, mD, aA, at, re, wg); #c1(SECIIA) c2(NP_001258847) c3(10048) c4(36162, 49219, 62276, 23105, 75333) c5(by, bu); #c1(SECI1C) c2(NP_150596) c3(10049) c4(36163, 49220, 62277, 23106, 75334) c5(bw); #c1(SECI3) c2(NP_001129498) c3(10050) c4(36164, 49221, 62278, 23107, 75335) c5(VP); #c1(SECI4LI) c2(NP_001137470) c3(10051) c4(36165, 49222, 62279, 23108, 75336) c5(X, nW, A, B); #c1(SECI4L2) c2(NP_001191133) c3(10052) c4(36166, 49223, 62280, 23109, 75337) c5(B, aw, aiW, iU, Ip, sJ, w, JH, e, cy, aAo, AX, aDx, Li, aD, aC, Xn, bp, dB, aCP, dH, i, cY, ig, ix, Ku, U, y, co, DM, f, vQ, bu, cs, fy, bm, iT, bvB, V, nl, ar, pi, fU, aCK, iu, b, z, d, aem, re, q, dQ, atT, cel, u, aE, ri, da, il, im, j, ad, aZ, jr, jH, eQ, Bm, xX, fl, I, A, ka, XI, iL, gE, al, zY, m, aX, aCU, fq, Bi, F, aV, ax, ez, bvC, P, T, ll, by, bvx, Rd); #c1(SECI4L3) c2(NP_001244307) c3(10053) c4(36167, 49224, 62281, 23110, 75338) c5(azt, gE, Xl, ig, sJ, ix, Ku, iL, z, U, re, oy, m, aem, aX, aCU, fq, AX, ak, vQ, aV, aE, iT, da, nl, V, il, aC, be, Xn, j, dB, P, ll, cy, JY, py, bvx, eQ, hn, cT, fl, iB, jl, iu, Dg); #c1(SEC16B) c2(NPJ49H8) c3(10054) c4(36168, 49225, 62282, 23111, 75339) c5(cy, I, nQ, dA, q, aA, bm, Ik); #c1(SEC23A) c2(NP_006355) c3(10055) c4(36169, 49226, 62283, 23112, 75340) c5(B, fl, cCA); #c1(SEC23B) C2(NP_001166217) c3(10056) c4(36170, 49227, 62284, 23113, 75341) c5(az, it, bso, byG, ps, adH, Oj, bzl, dt, au, gO, ej, pP, pg); #c1(SEC23IP) c2(NP_009121) c3(10057) c4(36171, 49228, 62285, 23114, 75342) c5(qf, fl, dA, bm, f, q, sy, ar, cs, eO, av, ad, u, Fg); #c1(SEC24A) c2(NP_001239160) c3(10058) c4(36172, 49229, 62286, 23115, 75343) c5(bb); #c1(SEC24B) c2(NP_001036199) c3(10059) c4(36173, 49230, 62287, 23116, 75344) c5(cCB); #c1(SEC24C) c2(NP_940999) c3(10060) c4(36174, 49231, 62288, 23117, 75345) c5(dj, ak, o); #c1(SEC31A) c2(NP_001070674) c3(10061) c4(36175, 49232, 62289, 23118, 75346) c5(jT); #c1(SEC61A1) c2(NP_037468) c3(10062) c4(36176, 49233, 62290, 23119, 75347) c5(bf, f, AP, aM); #c1(SEC6IG) c2(NP_055117) c3(10063) c4(36177, 49234, 62291, 23120, 75348) c5(f0, 0); #c1(SEC62) c2(NP_003253) c3(10064) c4(36178, 49235, 62292, 23121, 75349) c5(f, aw, b, hV, q, co, B, A, fy, nV); #c1(SEC63) c2(NP_009145) c3(10065) c4(36179, 49236, 62293, 23122, 75350) c5(z, xc, f, b, Xf); #c1(SECISBP2) c2(NP_076982) c3(10066) c4(36180, 49237, 62294, 23123, 75351) c5(cCC, i1, V, xr, mg, sc, oD, U); #c1(SECISBP2L) c2(NP_001180418) c3(10067) c4(36181, 49238, 62295, 23124, 75352) c5(co, b); #c1(SECTM1) c2(NP_002995) c3(10068) c4(36182, 49239, 62296, 23125, 75353) c5(aOB, bXs); #c1(SEL1L) c2(NP_001231913) c3(10069) c4(36183, 49240, 62297, 23126, 75354) c5(mv, f, iq, b, eH, A, bw, O, e, y, baR, jh, co, I, kJ, adD, hV, ik, B, ar, fy, u, aE, d, ali, il, jH, bp, T, ll, aUG, jT, fv, mC, UE, ag, fP, iu); #c1(SELE) c2(NP_000441) c3(10070) c4(36184, 49241, 62298, 23127, 75355) c5(dx, B, dN, bx, dD, sE, dB, Ka, eW, cCD, bf, e, cp, dv, cy, bqa, AX, dl, asA, gl, TP, mz, og, aAL, cCE, sH, du, bp, x, jT, FG, dH, qt, dS, fN, sJ, tO, ag, pv, agS, bq, aA, asL, fl, i, ig, ma, IW, bw, vl, y, yV, pp, f, bPv, bu, cs, gg, fi, V, ae, byO, eX, qH, dO, zS, iu, ap, aFl, bP, bn, b, eR, z, ey, pi, aO, d, bb, Iz, vj, hV, q, ar, oO, u, dh, o, fh, P J, I, sX, qC, hv, gL, ad, CM, IJ, dy, rw, Jl, jU, iw, ao, eV, fO, vT, aE, aG, ri, fl, af, bL, A, iC, mW, di, qX, iL, eO, wf, U, aW, oy, m, qs, aX, Qm, aQk, fq, h, aC, hN, a V, jZ, Yb, MT, HI, wF, ax, J, dU, T, j, jl, Bb, by, ac, aM, Ic, fP, gj, at, LQ, gf); #c1(SELENBP1) c2(NP_001245217) c3(10071) c4(36185, 49242, 62299, 23128, 75356) c5(gK, f, b, X, Gl, A, NH, bf, U, y, ak, q, bu, ar, B, aD, av, u, V, I, fO, bp, wq, eX, axk, aM, Ew, NG, py, he, aeP, pH, di, aA, at, ap); #c1(SELL) c2(NP_000646) c3(10072) c4(36186, 49243, 62300, 23129, 75357) c5(dx, aoV, cCF, dN, bx, vH, bf, fR, cp, dv, cy, aEa, yh, g, og, aC, sH, du, jT, qt, ag, cT, fD, dc, bq, asL, fl, jz, eu, ig, ix, cM, pp, DM, f, bu, cs, cd, qH, dy, aY, xe, fG, zS, iu, ap, bn, b, aF, bb, ff, jG, aE, I, ER, gL, et, jU, jH, ao, hU, dh, I, di, Iv, wf, jQ, m, jl, aQk, h, aV, Gd, Yb, ma, be, J, dt, P, T, aX, aM, aGc, Dl, fP, at, eG); #c1(SELP) c2(NP_002996) c3(10073) c4(36187, 49244, 62301, 23130, 75358) c5(dx, gK, dD, Ka, eH, w, cO, bf, eP, pz, O, cp, dv, cy, dl, wY, kX, aC, sH, du, bp, hR, dH, qt, tO, cT, fD, bq, aA, id, td, bRz, mk, ax, IW, xw, y, f, Em, cs, akk, V, zA, Fy, wA, dy, ji, pv, bn, b, aF, gz, bGG, eR, fl, bRt, z, aO, bb, ap, mL, jG, u, dh, o, fh, I, j, rw, Fk, jU, nV, hU, vT, aE, gd, aFi, fl, af, bL, MZ, di, eO, wf, m, gs, bSv, fq, aV, ma, sj, sB, J, dU, P, ti, T, fO, Bb, ac, aM, nk, Bs, auy, bh, at, MU); #c1(SELPLG) c2(NP_001193538) c3(10074) c4(36188, 49245, 62302, 23131, 75359) c5(dx, id, axx, b, qz, GF, bf, aO, dv, bb, fm, fq, f, yh, aV, dh, Yb, da, aDM, du, J, fO, II, jl, Pk, jU, aM, fc, ql, PY, fG, cT, fl, bq, aA, at); #c1(SEMA3A) c2(XP_006715902) c3(10075) c4(36189, 49246, 62303, 23132, 75360) c5(da, A, b, sE, yD, ds, iG, bw, wf, bf, y, oy, aX, B, O, OA, aV, u, o, yJ, Wc, bp, dU, P, T, fO, cCG, aM, ahT, ao, cCH, ID, en, rw, UT, ap); #c1(SEMA3B) c2(NP_001276989) c3(10076) c4(36190, 49247, 62304, 23133, 75361) c5(A, b, X, gG, jc, w, iG, O, jh, co, B, q, ar, cB, av, fy, bm, fU, cV, Qz, bp, aZ, iA); #c1(SEMA3C) c2(NP_006370) c3(10077) c4(36191, 49248, 62305, 23134, 75362) c5(yJ, d, A, b, Hl, aC, B, ahS, q, bu, ahO, bq, ji, by, u, e, O); #c1(SEMA3D) c2(NP_689967) c3(10078) c4(36192, 49249, 62306, 23135, 75363) c5(ahS, ahO, ix, aW, ho, O); #c1(SEMA3E) c2(NP_001171600) c3(10079) c4(36193, 49250, 62307, 23136, 75364) c5(A, aX, b, cY, sX, B, avY); #c1(SEMA3F) c2(NP_004177) c3(10080) c4(36194, 49251, 62308, 23137, 75365) c5(fU, bb, V, b, cCl, B, Wc, bp, ad, cn, A, cs, bq, U, u, iA, y, Ll); #c1(SEMA3G) c2(NP_064548) c3(10081) c4(36195, 49252, 62309, 23138, 75366) c5(O, iG); #c1 (SEMA4A) c2(NP_001180231) c3(10082) c4(36196, 49253, 62310, 23139, 75367) c5(pk, aV, cy, Kt, nQ, fc, fq, ml, v, gd, Ku, aD, fy, cCK, nW, cCJ); #c1(SEMA4B) c2(NP_064595) c3(10083) c4(36197, 49254, 62311, 23140, 75368) c5(ji, cn); #c1(SEMA4D) c2(XP_005251711) c3(10084) c4(36198, 49255, 62312, 23141, 75369) c5(d, A, aX, dP, b, kJ, B, F, bf, cy, ag, cT, Em, T, cO, yU, e, o, aM); #c1(SEMA4F) c2(NP_001258590) c3(10085) c4(36199, 49256, 62313, 23142, 75370) c5(A, aw, B); #c1(SEMA4G) c2(NP_001190173) c3(10086) c4(36200, 49257, 62314, 23143, 75371) c5(ff, dB); #c1(SEMA5A) c2(NP_003957) c3(10087) c4(36201, 49258, 62315, 23144, 75372) c5(oy, BO, by, b, k, nU, bu, ag, eO, aYQ, bw, cz, bj, bq, O); #c1(SEMA5B) c2(NP_001026872) c3(10088) c4(36202, 49259, 62316, 23145, 75373) c5(ik, dB); #c1(SEMA6A) c2(NP_001287709) c3(10089) c4(36203, 49260, 62317, 23146, 75374) c5(dx, B, aw, dB, vB, cO, bf, fR, ajf, aTI, O, dv, cy, t, e, wv, jU, ik, rR, fe, aC, nW, du, gm, fO, vc, aE, vM, HR, cCN, ag, bk, pt, X, jj, eu, hS, kY, bn, U, cM, cn, ml, f, arE, bu, Em, cs, av, fy, iT, if, be, V, gv, iA, fw, gA, oM, ij, b, qz, aYA, aO, d, jh, yQ, re, q, cCL, u, dh, o, da, sQ, il, j, ad, G, JH, cW, ao, nV, he, Sk, fl, I, di, A, eM, SV, IE, ds, gE, m, Ez, aX, aGp, h, F, cU, Ex, y, sH, hW, ez, cV, me, J, dt, dU, P, Wj, bM, by, aM, cCM, mb, agw, bh, eN); #c1(SEMA6B) c2(NP_115484) c3(10090) c4(36204, 49261, 62318, 23147, 75375) c5(ja, w); #c1(SEMA6D) c2(NP_001185928) c3(10091) c4(36205, 49262, 62319, 23148, 75376) c5(bP, dA, oi, fP, fO, IV, bj); #c1(SEMA7A) c2(NP_001139501) c3(10092) c4(36206, 49263, 62320, 23149, 75377) c5(aX, b, cCO, Jh, j, yD, UT, cl, DK, gg, yG); #c1(SEMGI) c2(NP_002998) c3(10093) c4(36207, 49264, 62321, 23150, 75378) c5(MT, ck, V, b, kJ, h, cT, fO, dB, wn, Mu, U, ke, jG); #c1(SEMG2) c2(NP_002999) c3(10094) c4(36208, 49265, 62322, 23151, 75379) c5(b); #c1(SENPI) c2(NP_001254524) c3(10095) c4(36209, 49266, 62323, 23152, 75380) c5(fl, cn, lb, Qf, B, J, ad, aC, nV, A, cs, pB, wy, u, y); #c1(SENP2) c2(NP_067640) c3(10096) c4(36210, 49267, 62324, 23153, 75381) c5(acw, fx, cr, i); #c1(SENP3) c2(NP_056485) c3(10097) c4(36211, 49268, 62325, 23154, 75382) c5(lb, fi, f, dh, b); #c1(SENP5) c2(NP_689912) c3(10098) c4(36212, 49269, 62326, 23155, 75383) c5(d, e); #c1(SENP6) C2(NP_001093879) c3(10099) c4(36213, 49270, 62327, 23156, 75384) c5(aF, f, b); #c1(SENP8) c2(NP_001165580) c3(10100) c4(36214, 49271, 62328, 23157, 75385) c5(aiU, co, cCP, AX); #c1 (SEPHSI) c2(NP_001182531) c3(10101) c4(36215, 49272, 62329, 23158, 75386) c5(ji, f, he, dA); #c1(SEPSECS) c2(NP_058651) c3(10102) c4(36216, 49273, 62330, 23159, 75387) c5(cCQ, qH, bY); #c1(SERACI) c2(NPJI6250) c3(10103) c4(36217, 49274, 62331, 23160, 75388) c5(cCR, oo, alN, cmK, cO, bM); #c1(SERF1A) c2(NP_068802) c3(10104) c4(36218, 49275, 62332, 23161, 75389) c5(apR, aA, kz, asf, bSL); #c1(SERGEF) c2(NP_036271) c3(10105) c4(36219, 49276, 62333, 23162, 75390) c5(gf); #c1(SER-INC1) c2(NP_065806) c3(10106) c4(36220, 49277, 62334, 23163, 75391) c5(ck, fy, bp); #c1(SERINC3) c2(NP_006802) c3(10107) c4(36221, 49278, 62335, 23164, 75392) c5(ck, A); #c1(SERINC5) c2(NP_001167542) c3(10108) c4(36222, 49279, 62336, 23165, 75393) c5(anw); #c1(SERPI) c2(NP_055260) c3(10109) c4(36223, 49280, 62337, 23166, 75394) c5(mz, f); #c1(SERP2) c2(NP_001010897) c3(10110) c4(36224, 49281, 62338, 23167, 75395) c5(ed, J); #c1(SERPINA10) c2(NP_001094077) c3(10111) c4(36225, 49282, 62339, 23168, 75396) c5(bq, gA, be); #c1(SERPINA11) c2(NP_001073920) c3(10112) c4(36226, 49283, 62340, 23169, 75397) c5(jE, bm); #c1(SERPINA12) C2(NP_001291390) c3(10113) c4(36227, 49284, 62341, 23170, 75398) c5(aA, at, kF, f, I); #c1(SERPINA1) c2(NP_001121179) c3(10114) c4(36228, 49285, 62342, 23171, 75399) c5(dx, f, aZ, eC, Iu, bf, cCT, aK, vr, dv, cy, gB, nv, aKH, aim, ju, hi, fH, TP, gD, JP, og, aC, du, yO, tz, Ce, vM, cCS, cCX, jT, EG, jE, qt, fc, fN, aBy, axA, ag, bBL, fD, mD, aA, wz, bT, rn, EO, cbU, kN, Df, Kc, ig, sF, iG, IW, vl, cC, azq, yr, co, hi, pp, amo, rr, ak, vQ, bu, tv, ky, bqz, auD, gg, fy, bm, fY, bk, em, cCW, V, nl, v, cd, gv, alM, eq, ar, qH, bjQ, f J, Fz, gt, cf, IP, aeA, UT, bp, fW, ap, fn, WH, bn, bW, b, Dr, bg, sU, z, ey, re, aYA, yK, aem, Iz, kW, bX, q, aya, dQ, as, DZ, Gj, qT, u, aE, o, da, aP, UK, gL, by, jG, IG, rB, auA, yW, jH, mk, xU, ih, gd, bq, I, fj, cCY, bL, A, iL, TQ, Oe, aFg, IE, di, C, pu, gE, caX, al, cCV, U, aW, oy, kn, im, ayi, Jf, Ek, aV, aq, dj, cCU, an, be, dt, P, T, ll, aM, bpG, eN, aDy, zM, ni, j, bh, at, gf, oT); #c1(SERPINA3) c2(NP_001076) c3(10115) c4(36229, 49286, 62343, 23172, 75400) c5(bL, gk, b, rn, X, dD, z, GS, aN, A, IE, id, di, sF, cO, wf, bf, O, aK, eV, aO, oy, hi, bb, ae, tF, Bl, bj, re, ak, q, gX, I, aaZ, aW, aJ, qY, i J, aM, u, aE, o, jB, jj, aP, pN, I, B, aUV, p, dc, v, bg, KL, hi, im, ti, T, bp, aZ, vM, cy, cCZ, uf, aL, ao, Lc, alt, bm, HN, PY, eo, ep, aD, xb, Bm, fD, abs, crY, bq, at, gf, y, eN); #c1(SERPINA4) c2(NP_001275961) c3(10116) c4(36230, 49287, 62344, 23173, 75401) c5(hW, LS, nx, nU, q, RY, sV, yD, UT, dn, bq, x, btv, aA, u, be); #c1(SERPINA5) c2(NP_000615) c3(10117) c4(36231, 49288, 62345, 23174, 75402) c5(b, X, eu, wn, jc, IW, y, hi, am, F, q, ff, fH, av, bm, aP, be, cd, dB, xq, T, fO, vM, jl, jT, fJ, u, os, ag, cT, bq, iE, zD); #c1(SERPINA6) c2(NP_001747) c3(10118) c4(36232, 49289, 62346, 23175, 75403) c5(eX, b, X, di, wZ, aVT, hi, f, q, cU, tg, av, bm, aVS, jB, J, dt, vM, cDa, jl, gF, dH, ii, cts, ie, aA); #c1 (SERPINA7) c2(NP_000345) c3(10119) c4(36233, 49290, 62347, 23176, 75404) c5(RZ, ii, Zg, cDb, cDd, q, bzf, Ru, ni, hM, C, jB, cDc, auA, bm, ov, qT); #c1(SERPINA9) C2(NP_001035983) c3(10120) c4(36234, 49291, 62348, 23177, 75405) c5(jE, jT, bb, gm, pD, ap, bq, at, bm, fh); #c1(SERPINBIO) C2(NP_005015) c3(10121) c4(36235, 49292, 62349, 23178, 75406) c5(cqO, A); #c1(SERPINBI3) c2(NP_036529) c3(10122) c4(36236, 49293, 62350, 23179, 75407) c5(d, e); #c1(SERPINB1) c2(NP_109591) c3(10123) c4(36237, 49294, 62351, 23180, 75408) c5(dx, vR, du, vu, II, aZ, gf); #c1(SERPINB2) c2(NP_001137290) c3(10124) c4(36238, 49295, 62352, 23181, 75409) c5(vq, A, bMc, ape, b, bx, X, Dv, DT, coi, Rd, eH, m, wf, bf, U, bu, pl, y, cy, d, jh, jl, co, aX, fm, eA, ml, f, N, q, JK, M, zL, vu, ar, B, bv, av, aV, u, e, SA, fU, fs, V, I, qH, be, J, fO, by, Fo, bQ, eX, bt, tj, bb, iA, Pk, aCH, ac, aM, P, Ip, wV, fy, akn, dP, bay, F, Fy, wP, Gw, bq, aA, at, adl, wT); #c1(SERPINB3) c2(NP_008850) c3(10125) c4(36239, 49296, 62353, 23182, 75410) c5(da, aw, b, X, C, iL, z, e, y, d, jh, co, cy, fq, f, F, q, vQ, ik, ar, av, fy, u, ccz, jB, ccA, m, LR, gv, T, gg, jE, bm, bh); #c1(SERPINB4) c2(NP_778206) c3(10126) c4(36240, 49297, 62354, 23183, 75411) c5(da, aw, b, ic, iL, z, adr, e, y, d, co, cy, fq, re, f, F, q, ar, rR, fy, bm, iT, ccz, ccA, u, in, yA, C); #c1(SERPINB5) c2(NP_002630) c3(10127) c4(36241, 49298, 62355, 23184, 75412) c5(B, b, X, Dv, A, bw, U, fx, y, d, co, aX, kJ, hV, e, bu, qL, ar, fy, cs, av, QJ, u, V, Be, bp, ad, W, T, x, iA, by, nV, ag, i); #c1(SERPINB6) c2(NP_001182220) c3(10128) c4(36242, 49299, 62356, 23185, 75413) c5(cDe, b, Ku, gE, al, U, y, awa, bb, aej, asy, uj, f, q, cs, Tr, u, bm, si, V, ui, fl, ad, P, asz, cy, dP, Zn, fw, bHj, na, awb, avZ); #c1(SERPINB7) c2(NP_001248760) c3(10129) c4(36243, 49300, 62357, 23186, 75414) c5(fl, cDf, X, cn, fD, bf, vp); #c1(SERPINB8) C2(NP_001027018) c3(10130) c4(36244, 49301, 62358, 23187, 75415) c5(da, fh, bb, sE, q, bq, JH, at, ap); #c1 (SERPINB9) c2(XP_005249241) c3(10131) c4(36245, 49302, 62359, 23188, 75416) c5(vo, NB, aX, YA, ll); #c1(SERPINCI) c2(NP_000479) c3(10132) c4(36246, 49303, 62360, 23189, 75417) c5(dx, KC, A, aw, b, cG, amm, iX, mW, aiM, di, eM, bf, vh, aK, fR, aO, m, qs, bqs, bb, RD, aqn, ml, jT, q, bpL, sZ, eN, DZ, tE, YT, bm, ik, cDg, cDh, bpM, o, wY, aE, bc, kF, il, aC, sH, du, aSG, bd, Ej, vK, G, dv, aR, wH, tj, Yu, cfH, et, gl, aM, jE, at, gs, aq, fw, tO, fu, Vp, amo, bq, al bpp, gf, Nn); #c1(SERPINDI) c2(NP_000176) c3(10133) c4(36247, 49304, G2361, 23190, 75418) c5(dx, aQv, be, qt, b, jg, eDi, sH, du, q, add, dv, rw, iT, Ra, z, bq, bm, re, bpV); #c1(SERPINE1) c2(NP_000593) c3(10134) c4(36248, 49305, 62362, 23191, 75419) c5(ml, dD, aZm, dB, vB, OH, e, aqn, hu, dl, om, mR, cl, xl, mz, aC, ao, YT, ie, tO, ag, bk, fD, bq, aA, ug, X, sF, iG, bw, vl, ex, bi, fm, eX, av, fy, pW, V, cd, Fy, tj, jC, fJ, xd, aY, iV, bwi, aG, ck, tV, vY, pl, fv, tg, wM, dh, wY, fs, sX, be, gL, ad, aHG, aWN, aFa, mA, xf, uE, cDI, wc, pR, QV, iL, gE, jw, aDW, m, or, wG, ox, oJ, Jk, aCH, Ea, mc, bd, Pk, ajn, bnn, Jh, Ic, fP, dx, eH, qP, vp, O, at, HY, bQ, gB, jm, uL, bJ, nl, du, Ej, x, wh, qt, dS, mE, bP, fl, iP, rd, mk, pX, aFm, cA, U, amx, co, f, bu, tv, aBU, be, aog, aDM, bNY, YS, ny, Hh, qH, qD, aUZ, Gw, wT, vq, qz, z, d, bb, eA, jd, q, ra, o, fh, tw, kF, qL, Fw, LR, wV, bPF, aZ, et, wd, jU, eh, gd, bpB, bRq, bl, MZ, k, bPx, bpE, ajv, iK, ho, bn, Gw, tK, sj, sB, dU, UT, ll, bgw, wU, eN, ii, hq, Vp, gf, cDn, aw, Fk, dN, Kg, aD, fH, g, ha, NM, bK, hP, fO, vc, vM, fx, hR, xx, gg, bvH, akn, Df, cdM, cDm, crO, yJ, bf, NW, pp, ml, B, xl, bv, hj, pP, iT, QD, SA, fY, aR, bt, Fr, iA, fw, vH, bH, uy, apo, b, zH, aF, tG, re, gz, vu, ajJ, bgl, Zz, wp, UK, cz, IX, Fo, et, Ha, hU, hT, fu, vP, gU, bW, mW, og, ds, vg, wf, DK, qs, sx, cUO, tF, aW, yd, Be, W, ti, aM, agl, atJ, tA, cDj, ap, eG, axx, bx, eC, w, bV, cO, gO, dv, cy, qc, t, sZ, tE, JF, Hs, gl, aDk, sH, gs, CO, re, fN, wi, we, vK, i, id, td, Co, y, ed, un, cc, cs, bm, em, jB, fz, ok, Ng, pi, Eh, dP, aUW, gA, T, ia, Mz, eR, yU, FG, anY, ey, aO, Iz, bX, ar, VM, u, TI, I, by, BZ, G, Io, Nh, cfp, aUN, eQ, aE, wP, ix, aFk, I, bL, A, Lv, coi, di, Xv, aX, adl, qr, aV, cDk, fU, si, cV, P, j, XO, gF, zE, ql, bh, al iE); #c1 (SERPINE2) c2(NP_001130000) c3(10135) c4(36249, 49306, 62363, 23192, 75420) c5(bL, b, k, LD, ig, w, di, Ku, IW, bw, U, e, y, d, cy, tv, u, o, ma, V, cV, j, W, bp, hi, qe, xd, Zs, Jh, Fr, mE, fw, ag, afD, I, bV); #c1(SERPINE3) c2(NP_001094790) c3(10136) c4(36250, 49307, 62364, 23193, 75421) c5(c0); #c1(SERPINF1) c2(NP_002606) c3(10137) c4(36251, 49308, 62365, 23194, 75422) c5(ml, aw, jt, bvH, dM, bf, e, O, vr, hR, kJ, nv, g, bK, ft, Kb, fN, we, ag, w, ace, aA, rn, wa, X, afY, mk, bNs, GV, y, co, ml, f, dZ, B, cs, av, bm, jB, V, v, gv, eX, jC, pk, aUW, jR, ap, uh, b, Ed, z, ey, d, q, es, ar, sR, fv, u, dh, o, fh, I, qL, ad, iD, et, Ha, jH, ao, Eu, ch, Bu, zX, dV, A, bOm, fr, zF, UA, ea, wf, cDo, AO, aX, Tq, auV, aW, cB, nQ, fT, aM, Ic, avl, bh, eG, rb); #c1(SERPINF2) c2(NP_001159392) c3(10138) c4(36252, 49309, 62366, 23195, 75423) c5(eX, b, EM, eH, Eh, e, d, cDg, cU, wY, av, o, aC, cDp, Fk, oh, cDr, csj, ql, fL, bq, eN); #c1(SERPINGI) c2(NP_000053) c3(10139) c4(36253, 49310, 62367, 23196, 75424) c5(KC, en, X, aF, UA, aN, axA, Pn, Oy, GV, aK, aW, m, cy, im, q, nv, uB, dl, as, QJ, bm, bWV, pW, baH, Ea, dt, bWT, II, Fk, jl, aoO, RY, zE, Y, Ic, o, cV, ace, bq, cDu, cDt, cDs); #c1(SERPINHI) c2(XP_011543629) c3(10140) c4(36254, 49311, 62368, 23197, 75425) c5(gK, en, tG, b, zF, jz, aN, mk, D, lv, vg, aTF, aK, O, aDW, ajn, fq, f, aDQ, jQ, bu, sR, oJ, bJd, uL, dh, cV, aC, LR, J, gL, by, vc, T, aYw, aRS, cW, jH, wh, cDv, rS, bh, at, Nu, ap); #c1(SERPINII) c2(NP_005016) c3(10141) c4(36255, 49312, 62369, 23198, 75426) c5(g, cbU, o, A, bb, b, by, hT, v, fw, bu, w, dk, aya, ky, B, zk, aV, aO, zp); #c1(SERPINI2) c2(NP_001012303) c3(10142) c4(36256, 49313, 62370, 23199, 75427) c5(Bu, Bt, cDw, b); #c1(SERTADI) c2(NP_037508) c3(10143) c4(36257, 49314, 62371, 23200, 75428) c5(d, jh, dj, b, X, ad, cs, x, av, u, e, y); #c1(SERTAD2) c2(XP_011531506) c3(10144) c4(36258, 49315, 62372, 23201, 75429) c5(U, g, b); #c1(SESNI) c2(NP_001186862) c3(10145) c4(36259, 49316, 62373, 23202, 75430) c5(CI, wZ, f, I); #c1(SESN3) c2(NP_001258523) c3(10146) c4(36260, 49317, 62374, 23203, 75431) c5(ali, b, I, fN, aV, Wo, dL); #c1(SETBPI) c2(NP_001123582) c3(10147) c4(36261, 49318, 62375, 23204, 75432) c5(fn, aua, b, Mj, pz, A, C, bf, Mn, aW, Fp, fq, h, nU, M, n, iv, jG, bir, I, dA, J, cz, G, KE, AP, aQT, pJ, brL, ci); #c1(SETDIA) c2(NP_055527) c3(10148) c4(36262, 49319, 62376, 23205, 75433) c5(b, X, e, d, ec, co, ip, ar, cs, av, fy, aC, iv, Dp, J, ad, Ge, ny, Im, BV, BX, P, tl, ji, GJ); #c1(SETDIB) c2(NP_055863) c3(10149) c4(36263, 49320, 62377, 23206, 75434) c5(d, e, V, pF); #c1(SETD2) c2(NP_054878) c3(10150) c4(36264, 49321, 62378, 23207, 75435) c5(dx, B, aw, dB, w, cO, e, O, dv, kJ, bEx, og, aC, du, fO, Ge, jT, gg, pq, jE, sg, Nv, ag, mx, qP, fN, bq, Dr, aDf, cY, kY, IW, U, y, uD, co, f, cs, bu, iv, av, fy, bm, iT, V, YS, rT, VP, jC, pi, qW, cf, P, fw, yM, ji, pv, b, uu, vY, oi, ey, Kt, d, ec, bb, re, hV, q, X, pn, ar, ff, fv, u, dh, il, j, ad, et, jU, jH, fg, bL, A, IO, k, pR, JC, aX, F, nQ, cV, J, W, dU, jo, T, Im, by, fP, rb, Oi, at, iE); #c1(SETD3) c2(XP_011535533) c3(10151) c4(36265, 49322, 62379, 23208, 75436) c5(jT); #c1(SETD5) c2(NP_001073986) c3(10152) c4(36266, 49323, 62380, 23209, 75437) c5(cDx, nU); #c1(SETD7) c2(NP_085151) c3(10153) c4(36267, 49324, 62381, 23210, 75438) c5(A, b, B, q, IM, aE, bf, O, ey, aM); #c1(SETD8) c2(NP_065115) c3(10154) c4(36268, 49325, 62382, 23211, 75439) c5(b, f, q, fy, u, y); #c1(SETDB2) c2(NP_001153780) c3(10155) c4(36269, 49326, 62383, 23212, 75440) c5(cT, nk, cy, V, buZ); #c1(SET) c2(NP_001234929) c3(10156) c4(36270, 49327, 62384, 23213, 75441) c5(B, b, dB, A, U, oU, y, aX, h, ak, F, jV, axK, hf, aW, jG, pq, u, o, fe, kF, V, lb, J, bp, P, fO, cDy, jT, hue, rQ, iR, ag, hd); #c1(SETMAR) c2(NP_001263254) c3(10157) c4(36271, 49328, 62385, 23214, 75442) c5(h); #c1(SETX) c2(NP_055861) c3(10158) c4(36272, 49329, 62386, 23215, 75443) c5(adB, qP, KQ, kV, m, addD, kS, f, cDz, kz, cc, OA, EX, KV, DU, bK, Ua, adC, v, dt, Lk, KX, bMk, ac, cq, ao, Y, adz, bM); #c1(SEZ6) c2(NP_001092105) c3(10159) c4(36273, 49330, 62387, 23216, 75444) c5(hS, aw); #c1(SEZ6L2) c2(NP_001107572) c3(10160) c4(36274, 49331, 62388, 23217, 75445) c5(by, co, rQ, UK, f, Bg, aN, cz, fU, UT, cbK, bu, o); #c1(SEZ6L) c2(NP_001171702) c3(10161) c4(36275, 49332, 62389, 23218, 75446) c5(at, ak, bp, co, fy, aE, fU); #c1(SF1) c2(NP_001171501) c3(10162) c4(36276, 49333, 62390, 23219, 75447) c5(nX, jj, aX, V, b, X, qq, U, dh); #c1(SF3AI) c2(NP_005868) c3(10163) c4(36277, 49334, 62391, 23220, 75448) c5(u); #c1(SF3BI) c2(NP_001005526) c3(10164) c4(36278, 49335, 62392, 23221, 75449) c5(afE, aw, b, jB, pz, A, NH, pK, eM, JE, aiF, U, ps, y, yt, jT, aX, kT, t, h, N, jV, gT, M, n, iv, kX, jG, hD, pH, cj, aiH, Jl, V, G, J, fO, pF, P, Q, bM, Vm, jC, oV, wd, pc, pq, iw, NG, hX, u, MP, pj, aEa, cT, qP, fg, a ex, acb, pJ, ci, pv); #c1(SF3B2) c2(NP_006833) c3(10165) c4(36279, 49336, 62393, 23222, 75450) c5(cj, A, aX, b, kT, h, pj, hX, cT, aex, aEa, kX, jC, jT, ci, n); #c1(SF3B6) c2(NP_057131) c3(10166) c4(36280, 49337, 62394, 23223, 75451) c5(A, b, dB, U, y, aX, f, q, ar, u, aEg, fU, V, by, Fo, T, et, jT, st, jR, cT, fP, i); #c1(SFII) c2(NP_001007468) c3(10167) c4(36281, 49338, 62395, 23224, 75452) c5(bP, fO); #c1(SFMBTI) c2(NP_057413) c3(10168) c4(36282, 49339, 62396, 23225, 75453) c5(g, di, dB, b, dA); #c1(SFMBT2) c2(NP_001018049) c3(10169) c4(36283, 49340, 62397, 23226, 75454) c5(m, bb); #c1(SFRI) c2(NP_001002759) c3(10170) c4(36284, 49341, 62398, 23227, 75455) c5(u, y, b); #c1(SFRPI) c2(NP_003003) c3(10171) c4(36285, 49342, 62399, 23228, 75456) c5(ml, aw, gG, dB, w, e, O, cp, cy, Hs, fe, lb, bp, fx, wh, ag, cT, i, pt, aA, Bu, X, rd, kY, bw, U, y, jb, co, B, vQ, bu, cs, av, fy, bm, iT, d, V, eX, py, er, jR, apG, ji, b, zH, aF, anb, hh, jh, jd, re, q, jV, ar, ff, jG, u, j, by, Nh, ct, et, jH, iR, Bt, Mp, hd, A, k, pR, BY, iL, gE, iK, bJz, cDA, h, cU, aC, oJ, fU, cV, Be, W, jo, ti, T, fO, oM, od, fP, eG); #c1(SFRP2) c2(NP_003004) c3(10172) c4(36286, 49343, 62400, 23229, 75457) c5(A, axg, b, X, dB, O, w, bw, td, U, hP, zY, y, d, cy, apG, h, B, e, bu, ar, ff, YR, u, Fg, R, iF, V, dA, Bs, nW, Zg, fO, by, W, jo, jH, bkV, bm, jR, zM, cT, fP, iT, i, bq, re); #c1(SFRP4) c2(NP_003005) c3(10173) c4(36287, 49344, 62401, 23230, 75458) c5(A, Al, b, X, dB, Tw, bw, U, re, e, y, cp, d, h, B, q, ff, hb, av, bm, iT, iF, V, I, YR, j, W, T, aec, azy, i, Oi, at, eG, amK); #c1(SFRP5) c2(NP_003006) c3(10174) c4(36288, 49345, 62402, 23231, 75459) c5(A, aw, b, bx, X, anb, dB, oi, iL, bw, bf, U, bu, e, y, d, cy, apG, h, B, g, es, cU, ar, ff, Xp, iv, av, fy, u, iT, mz, V, I, aC, J, fO, by, jo, ct, dL, aM, bm, tl, i, fN, aA, re, pv); #c1(SFSWAP) c2(NP_001248340) c3(10175) c4(36289, 49346, 62403, 23232, 75460) c5(Wk cO); #c1(SFT2D2) c2(NP_955376) c3(10176) c4(36290, 49347, 62404, 23233, 75461) c5(di, cp); #c1(SFT2D3) c2(NP_116129) c3(10177) c4(36291, 49348, 62405, 23234, 75462) c5(U, V); #c1(SFTA2) c2(NP_995326) c3(10178) c4(36292, 49349, 62406, 23235, 75463) c5(m, fU, ix); #c1(SFTA3) C2(NP_001094811) c3(10179) c4(36293, 49350, 62407, 23236, 75464) c5(cV); #c1(SFTPA1) c2(NP_001158117) c3(10180) c4(36294, 49351, 62408, 23237, 75465) c5(aMu, b, NA, ga, e, d, Fp, Ba, eK, bOm, DM, cy, vu, dQ, n, hi, ajJ, jG, fy, pW, aBv, wF, fU, fs, tP, LR, bp, co, aZ, ar, aGJ, cl, gF, pq, aeg, Qk, SR, ci, abf, bk, I, ji, wz, gf); #c1(SFTPA2) c2(XP_005270185) c3(10181) c4(3G295, 49352, 62409, 23238, 75466) c5(B, aMu, b, NA, ga, A, nl, Fp, co, LL, bOm, gd, DM, f, cy, vu, ajJ, bl, dQ, gg, fy, pW, aBv, fU, fs, tP, aC, LR, bp, I, Ba, aZ, ar, cl, gF, aeq, Qk, SR, xe, abf, atR, ji, aA, wz, gf); #c1(SFTPB) c2(XP_005264544) c3(10182) c4(36296, 49353, 62410, 23239, 75467) c5(A, b, aF, vB, ga, gc, IW, gF, bi, co, LL, cDB, TX, DM, B, wN, cy, tv, ra, vu, Gs, bl, ar, gg, QJ, bIG, LR, gL, dt, I, j, aZ, cl, ge, agn, eK, fy, fX, cX, aWZ, SR, gf, gd, DI, bk, atR, ji, aA, bp, fW); #c1(SFTPC) c2(NP_001165828) c3(10183) c4(36297, 49354, 62411, 23240, 75468) c5(eK, b, Zx, IW, crK, gi, kB, ga, fZ, Ja, gc, DM, adT, gF, Ne, LL, ajn, vB, f, wN, vu, cy, aya, dQ, fy, hi, ar, gg, aDW, brr, ma, kF, LR, gL, IR, IX, T, II, aZ, cl, ge, fU, buS, fX, aWZ, cDC, I, gf, gd, DI, IS, atR, ji, bp, fW); #c1(SFTPD) c2(NP_003010) c3(10184) c4(36298, 49355, 62412, 23241, 75469) c5(dx, vq, en, b, TQ, Zx, aF, sE, dv, cl, vl, cCV, jD, oy, m, Fp, cn, LL, bOm, gd, DM, f, e, cy, Uw, dQ, sd, aD, ar, gg, fy, pW, NO, d, wF, du, fz, I, aC, LR, sy, gL, be, I, P, ti, bp, aZ, aDA, qV, qe, jH, eK, nk, fX, dP, ep, abf, IN, DI, fP, bk, i, atR, at, gf, rZ); #c1(SFXN1) c2(NP_073591) c3(10185) c4(36299, 49356, 62413, 23242, 75470) c5(nU, aw, BY, A, iL, z, Fh, e, y, d, bi, hV, aJS, ar, B, kN, u, da, qw, aP, I, bcY, oK, T, fx, qT, mP, iR, i, bh); #c1(SFXN2) c2(NP_849189) c3(10186) c4(36300, 49357, 62414, 23243, 75471) c5(bj); #c1(SFXN4) c2(NP_998814) c3(10187) c4(36301, 49358, 62415, 23244, 75472) c5(GG, Vd, kW, cDD); #c1(SGCA) c2(NP_000014) c3(10188) c4(36302, 49359, 62416, 23245, 75473) c5(c, kG, b, aaz, oB, gw, bgt, cDE, arh, ac, bFC, bgo, oD, QG, xl, azS); #c1(SGCB) c2(NP_000223) c3(10189) c4(36303, 49360, 62417, 23246, 75474) c5(is, bL, jp, kG, b, cV, bgz, cK, f, bu, jc, cDE, Au, arh, oD, ava, by, rb, xl, JY); #c1(SGCD) c2(NP_758447) c3(10190) c4(36304, 49361, 62418, 23247, 75475) c5(IK, Rx, di, ahg, cO, kG, e, aW, aoa, c, bb, f, cDH, ik, xl, arh, mR, sK, oy, cDG, cK, mQ, d); #c1(SGCE) c2(NP_001092870) c3(10191) c4(36305, 49362, 62419, 23248, 75476) c5(hS, WA, ayY, ckg, kG, cM, Me, xl, qu, n, Wy, zb, bU, hW, afx, dc, dt, QI, Q, rV, mF, Ww, aY, xM, bDS, bM); #c1(SGCG) c2(XP_005266562) c3(10192) c4(36306, 49363, 62420, 23249, 75477) c5(en, aw, Rx, gG, yz, w, cO, xl, cy, b, QB, adQ, g, nW, yO, azo, arh, bYD, Ta, wh, ag, dc, aA, WB, bgn, cG, X, wy, hS, ix, yn, Fh, U, cM, co, yE, amo, f, bqC, O, cs, av, fy, V, ae, Bx, BV, adM, cK, Rz, aoy, aY, PY, kc, bLh, aF, Dm, bg, z, yK, q, jV, vu, dQ, pB, ar, u, ov, o, da, Kx, I, oJ, ju, ad, as, pF, ew, Jm, rO, ao, adz, aoA, Bg, CV, akL, fr, xj, di, hP, iM, c, aX, bj, h, F, bgm, y, cB, nA, Ps, fU, kG, cV, an, J, W, P, T, ft, fM, sK, wU, Y, TU, adb, auy, bgn, bM, at, ja, alw); #c1(SGCZ) c2(NP_631906) c3(10193) c4(36307, 49364, 62421, 23250, 75478) c5(A, kG, h, hT, xq, KM, bg, bf, at, bj); #c1(SGIP1) c2(XP_011540595) c3(10194) c4(36308, 49365, 62422, 23251, 75479) c5(bb, ap, eO, bq, aA, at, fh); #c1(SGK1) c2(NP_001137148) c3(10195) c4(36309, 49366, 62423, 23252, 75480) c5(bP, ig, A, aw, b, nX, X, pR, vD, O, hS, di, cO, cA, bf, ey, e, y, oy, Ag, qs, aX, h, f, IW, q, vZ, B, ff, cs, aic, av, fy, u, dh, bk, d, jj, si, I, ec, Nc, Dt, v, fO, W, jo, T, eX, cV, Qt, et, gF, hR, et, aM, ao, cIS, bm, Fu, gA, Af, fD, bq, zS, aA, wR, re); #c1(SGK223) c2(XP_005272427) c3(10196) c4(36310, 49367, 62424, 23253, 75481) c5(e0); #c1(SGK2) c2(NP_001186193) c3(10197) c4(36311, 49368, 62425, 23254, 75482) c5(f); #c1(SGK3) c2(NP_001028750) c3(10198) c4(36312, 49369, 62426, 23255, 75483) c5(A, f, q, B, u, y); #c1(SGMS1) c2(XP_011537885) c3(10199) c4(36313, 49370, 62427, 23256, 75484) c5(co, V, b, J, vB, T, bp, bw, aA, fy); #c1(SGMS2) c2(NP_001129730) c3(10200) c4(36314, 49371, 62428, 23257, 75485) c5(dx, dv, I, fN, du, T, aA, dL, gF); #c1(SG0L1) c2(NP_001012409) c3(10201) c4(36315, 49372, 62429, 23258, 75486) c5(by, cn, V, b, h, gz, J, bu, bY, ak, fy, NS, U, at, bj, be); #c1(SGPL1) c2(XP_011538619) c3(10202) c4(36316, 49373, 62430, 23259, 75487) c5(gd, P, o, b, Dc); #c1(SGPP1) c2(NP_110418) c3(10203) c4(36317, 49374, 62431, 23260, 75488) c5(fl, b, fr, oi, jy, U, e, xl, cp, d, c, aX, re, f, q, QE, O, fM, aV, dr, iT, cl, baH, og, V, m, Qz, Xr, P, T, fy, ft, ac, dy, TJ, aE, fP, ji, eG); #c1(SGPP2) c2(NP_68959g) c3(10204) c4(36318, 49375, 62432, 23261, 75489) c5(da, eG); #c1(SGSH) c2(NP_000190) c3(10205) c4(36319, 49376, 62433, 23262, 75490) c5(cbD, IU, ahf, v, LG, cDI, DZ, kA, ajb); #c1(SGSM2) c2(NP_001091979) c3(10206) c4(36320, 49377, 62434, 23263, 75491) c5(aA, I); #c1(SGSM3) c2(NP_056520) c3(10207) c4(36321, 49378, 62435, 23264, 75492) c5(dx, en, pV, EM, jt, HG, w, et, e, O, M, dv, cy, kJ, asA, cc, fe, aC, wo, gm, fO, Ce, od, cV, fx, HR, wh, f, os, OJ, ag, amu, bk, fD, aA, bP, id, cY, eu, cA, U, cM, co, pp, ak, bu, B, cs, fy, iT, V, ae, yY, v, BV, zi, gC, iA, du, tm, py, jR, ji, Xe, b, Pv, MS, Qv, ey, d, jh, re, hV, q, jV, dQ, iR, aE, o, I, ad, pF, rO, et, Ut, Ha, jH, nV, u, hT, HN, he, af, A, k, pR, og, aW, iy, m, aX, h, cU, y, cB, qB, aq, fU, hW, Ea, GS, J, dt, P, T, by, fM, qp, MP, Oi, at); #c1(SGTA) c2(XP_011526480) c3(10208) c4(36322, 49379, 62436, 23265, 75493) c5(jh, bQ, kF, B, QI, A, cO); #c1(SH2B1) c2(NP_001139267) c3(10209) c4(36323, 49380, 62437, 23266, 75494) c5(clo, aw, cB, I, dA, B, co, hA, bq, cy, aA, bwp, A, gF, at); #c1(SH2B2) c2(NP_066189) c3(10210) c4(36324, 49381, 62438, 23267, 75495) c5(m, Ph, fm, b, be, jw, eN, gf); #c1(SH2B3) c2(NP_001278353) c3(10211) c4(36325, 49382, 62439, 23268, 75496) c5(bL, iq, b, ig, hM, pz, oy, m, qf, bb, fm, t, f, N, qB, fg, yW, aV, aE, ax, aC, J, pF, G, bq, cy, pi, dH, ao, IE, iz, bY, pv, di, at, ap); #c1(SH2D1A) c2(NP_001108409) c3(10212) c4(36326, 49383, 62440, 23269, 75497) c5(Zm, jK, en, b, cDJ, aF, eu, pD, aN, Zs, id, Iv, iL, eM, bf, al, aK, bNS, xT, jl, RD, pp, Zk, f J, aCM, fH, zQ, cq, Zn, aE, Zr, Dp, a GY, WH, m, aC, bK, gm, gL, J, dt, P, II, jT, aA, aM, if, pS, amJ, yX, ne, CL, bq, aT, iu, Zq, Zp); #c1(SH2D2A) c2(NP_001154913) c3(10213) c4(36327, 49384, 62441, 23270, 75498) c5(ax, aC, aV, zm, aFY, bq, at, dH); #c1 (SH2D3A) c2(NP_005481) c3(10214) c4(36328, 49385, 62442, 23271, 75499) c5(sQ, u, II, awg); #c1(SH2D3C) c2(NP_001136005) c3(10215) c4(36329, 49386, 62443, 23272, 75500) c5(Am, sQ, cV, BT, Nq, xQ, Ns, Aj, u, y); #c1(SH2D4A) c2(NP_001167630) c3(10216) c4(36330, 49387, 62444, 23273, 75501) c5(at, g); #c1(SH2D4B) c2(NP_001139191) c3(10217) c4(36331, 49388, 62445, 23274, 75502) c5(bra); #c1(SH3BGR) c2(NP_001001713) c3(10218) c4(36332, 49389, 62446, 23275, 75503) c5(aA, at, ag); #c1(SH3BGRL2) c2(NP_113657) c3(10219) c4(36333, 49390, 62447, 23276, 75504) c5(IL, or); #c1 (SH3BGRL) c2(NP_003013) c3(10220) c4(36334, 49391, 62448, 23277, 75505) c5(aA, at, ag); #c1(SH3BP1) c2(NP_061830) c3(10221) c4(36335, 49392, 62449, 23278, 75506) c5(bf, cf); #c1(SH3BP2) c2(NP_001139327) c3(10222) c4(36336, 49393, 62450, 23279, 75507) c5(cDK, dB, J, dt, zK, aq); #c1(SH3BP4) c2(XP_011509196) c3(10223) c4(36337, 49394, 62451, 23280, 75508) c5(b, Eh, y, oy, Ec, eX, F, q, jV, cM, bm, DU, fi, I, Ea, Ib, be, J, Ej, W, P, qD, jE, u, Nq, fD, aA); #c1(SH3BP5) c2(NP_001018009) c3(10224) c4(36338, 49395, 62452, 23281, 75509) c5(bq, hT, o, azp); #c1(SH3D19) c2(NP_001009555) c3(10225) c4(36339, 49396, 62453, 23282, 75510) c5(by, B, b, aeB, arF, w, di, iL, U, A, fx, y, qs, co, aX, ae, pp, t, h, f, q, jV, M, ky, cc, cs, hV, jG, u, n, Ps, og, fs, V, I, cV, aC, J, aAA, P, QI, od, cy, gF, ad, dL, jT, bm, hq, ie, G, fw, i, fN, QP, aA, ci); #c1(SH3GL1) c2(NP_001186872) c3(10226) c4(36340, 49397, 62454, 23283, 75511) c5(t, h, J, G, n, iv, fT, u, O); #c1(SH3GL2) c2(NP_003017) c3(10227) c4(36341, 49398, 62455, 23284, 75512) c5(o, b, iR, bj, f, F, vY, w, Bm, cO, fy, Ez, aV, u, y); #c1(SH3GL3) c2(NP_001288038) c3(10228) c4(36342, 49399, 62456, 23285, 75513) c5(0); #c1(SH3KBP1) c2(NP_001019837) c3(10229) c4(36343, 49400, 62457, 23286, 75514) c5(d, b, jj, gL, fl, X, u, e, y); #c1 (SH3PXD2A) c2(NP_055446) c3(10230) c4(36344, 49401, 62458, 23287, 75515) c5(BO, eQ, o, ji); #c1(SH3PXD2B) c2(NP_001017995) c3(10231) c4(36345, 49402, 62459, 23288, 75516) c5(cr, zE, cDM, aCb, cDL, ad, xr, cs, aA, AP); #c1(SH3RF1) c2(NP_065921) c3(10232) c4(36346, 49403, 62460, 23289, 75517) c5(bj, co, u); #c1(SH3RF3) c2(NP_001092759) c3(10233) c4(36347, 49404, 62461, 23290, 75518) c5(xq); #c1(SH3TC2) c2(NP_078853) c3(10234) c4(36348, 49405, 62462, 23291, 75519) c5(JI, aFY, cG, cDN, cDO, cz, Y, IG, JE, cC, ahe); #c1(SH3YL1) c2(NP_001153069) c3(10235) c4(36349, 49406, 62463, 23292, 75520) c5(cV); #c1(SHANK1) c2(XP_006723296) c3(10236) c4(36350, 49407, 62464, 23293, 75521) c5(Px, rQ, nU, dB, he, cz, ih, aQj); #c1(SHANK2) c2(NP_036441) c3(10237) c4(36351, 49408, 62465, 23294, 75522) c5(oy, d, rQ, jh, WW, bK, nU, Wh, Eo, cDP, aHD, cz, e); #c1(SHANK3) c2(NP_277052) c3(10238) c4(36352, 49409, 62466, 23295, 75523) c5(cDR, aQT, cDQ, rQ, ahq, WW, Wk, nU, Wh, cz, A, bcx, acr, cny, bSn, hW, aHD, KE, akp); #c1(SHARPIN) c2(NP_11223G) c3(10239) c4(36353, 49410, 62467, 23296, 75524) c5(u, B, eE, fq, cbO, Xz, zg, O); #c1(SHBG) c2(NP_001139751) c3(10240) c4(36354, 49411, 62468, 23297, 75525) c5(dx, f, auJ, ck, hM, PM, bf, cp, yg, bQ, b, Kg, bty, sZ, aD, RW, oJ, gD, aC, du, yO, GI, fx, hR, dL, wh, pP, aTZ, aq, pH, i, dc, aA, pO, yJ, X, NH, U, cM, tp, eX, bu, afH, B, av, bm, is, em, jB, V, dv, tj, iA, afv, xd, aY, nc, Ru, Be, gO, UT, ap, An, am, fN, jJ, aeP, yU, ey, jh, aga, re, PA, q, ar, tg, u, o, NT, kF, I, UK, cz, wq, US, KK, tW, mA, I, A, Lv, jc, di, jw, m, jl, wp, cU, y, UR, vF, T, gF, by, aM, jT, ii, agl, NG, PS, bh, at, iE); #c1(SHB) c2(NP_003019) c3(10241) c4(36355, 49412, 62469, 23298, 75526) c5(ao, hT, bb, o, cO); #c1(SHC1) c2(NP_001123512) c3(10242) c4(36356, 49413, 62470, 23299, 75527) c5(B, b, Pv, eH, W, bf, A, y, co, aX, f, g, vQ, u, I, P, T, x, aM, bm, aLQ, PY, fD, eG, ap); #c1(SHC2) c2(NP_036567) c3(10243) c4(36357, 49414, 62471, 23300, 75528) c5(GS, ahk, yQ, Mr); #c1(SHC3) c2(NP_058544) c3(10244) c4(36358, 49415, 62472, 23301, 75529) c5(Yk, co, nV, b, k, ck, Lv, hV, cV, cT, w, T, O, tl, jq, bny, u, y, zD); #c1(SHC4) c2(NP_976224) c3(10245) c4(36359, 49416, 62473, 23302, 75530) c5(aX, cO); #c1(SHCBP1) c2(NP_079021) c3(10246) c4(36360, 49417, 62474, 23303, 75531) c5(aX, aGt, Fw, nl, aZB, qL, JC, aZD, yC); #c1(SHF) c2(NP_001288097) c3(10247) c4(36361, 49418, 62475, 23304, 75532) c5(bb, cV); #c1(SHFM1) c2(NP_006295) c3(10248) c4(36362, 49419, 62476, 23305, 75533) c5(A, b, X, ic, PE, bw, adr, e, y, d, arl, re, B, bu, ar, O, av, u, iT, g, cz, by, ac, aPc, agm, iB, yA, iu); #c1(SHH) c2(NP_000184) c3(10249) c4(36363, 49420, 62477, 23306, 75534) c5(fA, f, aw, bx, gG, jt, x, w, hM, bkJ, baB, bf, bu, adr, e, O, XE, kJ, t, azu, cl, Gs, PH, zW, g, asQ, aC, cDV, po, fO, QZ, fx, jT, kN, cuz, aai, fc, mE, K, cDS, ag, i, auS, avX, Kt, fi, Dv, vD, Ak, hS, ate, bw, U, y, atj, Ml, kH, ak, cDW, B, cs, bYE, gg, fy, iF, jB, V, FR, Bs, v, bt, fv, YU, iP, fw, tl, Nx, bn, ahU, aUC, b, jj, ic, vn, d, bb, aJB, eA, hV, q, es, bkm, ar, u, aE, oa, LR, j, ad, CL, ct, ao, nV, bBt, iR, bZH, Dj, TD, Ns, yA, agG, A, aiF, azm, aoG, di, jR, cDU, bj, Ld, aDW, bbE, bxr, aX, ajn, jk, h, wN, fa, aOT, iZ, ik, oJ, cB, aV, aq, Gd, hW, cV, Fs, MT, W, P, cDT, T, ji, cdg, by, AP, fM, aM, Nq, at); #c1(SHISA2) c2(NP_001007539) c3(10250) c4(36364, 49421, 62478, 23307, 75535) c5(ao, o); #c1(SHISA3) c2(NP_001073974) c3(10251) c4(36365, 49422, 62479, 23308, 75536) c5(co, fy, b); #c1(SHISA6) c2(NP_001166932) c3(10252) c4(36366, 49423, 62480, 23309, 75537) c5(Bu, Bt, dA); #c1(SHISA9) c2(NP_001138676) c3(10253) c4(36367, 49424, 62481, 23310, 75538) c5(l); #c1(SHMT1) c2(NP_001268715) c3(10254) c4(36368, 49425, 62482, 23311, 75539) c5(IJ, A, b, X, hS, xf, jy, U, Oh, ps, yw, y, gM, jh, co, bb, sG, t, h, B, F, Ns, e, fr, aG, gP, cs, av, fy, u, fh, PJ, aO, hW, V, aC, bK, Xc, gm, bp, ad, W, G, cd, x, cr, fx, cz, et, d, jT, Nq, mx, i, Di, jl, ap); #c1(SHMT2) c2(NP_001159828) c3(10255) c4(36369, 49426, 62483, 23312, 75540) c5(PJ, co, jl, b, jh, Nq, Ns); #c1(SHOC2) c2(NP_001255968) c3(10256) c4(36370, 49427, 62484, 23313, 75541) c5(BO, zi, b, m, aey, cDY, J, cDX, cxv); #c1(SHOX2) c2(NP_001157150) c3(10257) c4(36371, 49428, 62485, 23314, 75542) c5(aNS, co, aw, bdB, VY, q, bp, bqc, dt, ak, aZ); #c1(SHOX) c2(NP_000442) c3(10258) c4(36372, 49429, 62486, 23315, 75543) c5(fr, VY, bqc, rU, VJ, jw, xl, cDZ, c, S, bfV, f, ND, aoe, bxK, UR, wp, zv, ft, dt, IG, aoT, Ap, aDJ, bdB, cC, bBQ, xr); #c1(SHPK) c2(NP_037408) c3(10259) c4(36373, 49430, 62487, 23316, 75544) c5(vY); #c1(SHPRH) c2(NP_001036148) c3(10260) c4(36374, 49431, 62488, 23317, 75545) c5(f); #c1(SHQ1) c2(NP_060600) c3(10261) c4(36375, 49432, 62489, 23318, 75546) c5(bfM, ss); #c1(SHROOM2) c2(NP_001640) c3(10262) c4(36376, 49433, 62490, 23319, 75547) c5(U, V); #c1(SHROOM3) c2(NP_065910) c3(10263) c4(36377, 49434, 62491, 23320, 75548) c5(ao, ali, aX, cK, at, et); #c1(SHROOM4) c2(NP_065768) c3(10264) c4(36378, 49435, 62492, 23321, 75549) c5(cEa, nz, nU); #c1(SIAE) c2(NP_001186851) c3(10265) c4(36379, 49436, 62493, 23322, 75550) c5(aC, ak, cEb, bT, aE); #c1(SIAH1) c2(NP_001006611) c3(10266) c4(36380, 49437, 62494, 23323, 75551) c5(by, GQ, b, bj, f, q, et, bu, cs, bw, ad, u, y); #c1(SIAH2) c2(NP_005058) c3(10267) c4(36381, 49438, 62495, 23324, 75552) c5(co, aX, b, Be, B, q, J, A, ZM, bq, Fr, u, y); #c1(SIDT1) c2(NP_060169) c3(10268) c4(36382, 49439, 62496, 23325, 75553) c5(asx); #c1(SIGIRR) c2(NP_001128526) c3(10269) c4(36383, 49440, 62497, 23326, 75554) c5(cy, In, aFy, aDL, II, gE); #c1(SIGLEC11) c2(NP_001128635) c3(10270) c4(36384, 49441, 62498, 23327, 75555) c5(aPR); #c1(SIGLEC14) c2(NP_001092082) c3(10271) c4(36385, 49442, 62499, 23328, 75556) c5(kn, I, cEc); #c1(SIGLEC1) c2(XP_011527630) c3(10272) c4(36386, 49443, 62500, 23329, 75557) c5(m, en, cy, b, aC, j, P, gL); #c1(SIGLEC5) c2(NP_003821) c3(10273) c4(36387, 49444, 62501, 23330, 75558) c5(kn, h); #c1(SIGLEC7) c2(NP_001264130) c3(10274) c4(36388, 49445, 62502, 23331, 75559) c5(eR, aN, iG, cA, bf, aK, O, jh, LS, LI, fg, h, f, N, Pn, bu, M, bK, iv, fs, agQ, cV, nI, J, gL, ad, Fy, aX, by, anf, ao, jR, RV, zO, aCQ, Xm); #c1(SIGLEC8) c2(NP_055257) c3(10275) c4(36389, 49446, 62503, 23332, 75560) c5(akm, cy); #c1(SIGLEC9) c2(NP_001185487) c3(10276) c4(36390, 49447, 62504, 23333, 75561) c5(aF, J); #c1(SIGMAR1) c2(NP_001269136) c3(10277) c4(36391, 49448, 62505, 23334, 75562) c5(ae, o, Gm, cEd, xJ, eB, v, tF, P, dd, oN, y, gE, cA, ai, u, OA, axZ, Il); #c1(S1) c2(NP_001032) c3(10278) c4(36392, 49449, 62506, 23335, 75563) c5(fi, ma, I, b, ch, Xc, gz, cT, ad, WJ, cEe, ar, cs, bf, U, Ah, jU, aM); #c1(SIK1) c2(NP_775490) c3(10279) c4(36393, 49450, 62507, 23336, 75564) c5(aX, b, f, MS, di, fl, mR, u, alQ, y); #c1(SIK2) c2(NP_056006) c3(10280) c4(36394, 49451, 62508, 23337, 75565) c5(l, X, fN, av, at, dL, aA); #c1(SIK3) c2(NP_001268678) c3(10281) c4(36395, 49452, 62509, 23338, 75566) c5(X, av, afZ, bV, b); #c1(SIL1) c2(NP_071909) c3(10282) c4(36396, 49453, 62510, 23339, 75567) c5(adC, rQ, u, h, nU, aN, alY, A, mg, Nw, oD, cz, aK); #c1(SIM1) c2(XP_005267157) c3(10283) c4(36397, 49454, 62511, 23340, 75568) c5(Wh, rd, aA, n, bw, ey, u, cbp, ac); #c1(SIM2) c2(NP_005060) c3(10284) c4(36398, 49455, 62512, 23341, 75569) c5(A, b, Hk, dD, w, Em, O, nU, B, aJ, cs, u, ans, g, lb, ad, T, x, AP, aai, pS, aq, Nq, cC, ag, at, y); #c1(SIN3A) c2(XP_006720530) c3(10285) c4(36399, 49456, 62513, 23342, 75570) c5(co, b, bxC, aXR, bp, vZ, ji, fy, u, y); #c1(SIN3B) c2(NP_001284524) c3(10286) c4(36400, 49457, 62514, 23343, 75571) c5(b, kJ, f, ag, w, u); #c1(SIPA1) c2(NP_694985) c3(10287) c4(36401, 49458, 62515, 23344, 75572) c5(co, aX, b, re, iT, y, gO, aGJ, n, jG, u, ci, ajz, pq); #c1(SIPAIL2) c2(NP_065859) c3(10288) c4(36402, 49459, 62516, 23345, 75573) c5(ao, cy); #c1(SIPAIL3) c2(NP_055888) c3(10289) c4(36403, 49460, 62517, 23346, 75574) c5(c0); #c1(SIRPA) c2(NP_542970) c3(10290) c4(36404, 49461, 62518, 23347, 75575) c5(aw, b, k, yh, w, aHp, y, zi, cEf, h, f, zh, cM, av, u, g, NT, aeU, T, bq, pS, aY, Eo, dc, aU); #c1(SIRPB1) c2(NP_001077379) c3(10291) c4(36405, 49462, 62519, 23348, 75576) c5(zL, jl); #c1(SIRPG) c2(NP_001034597) c3(10292) c4(36406, 49463, 62520, 23349, 75577) c5(wn, m, NT, aE, bg); #c1(SIRT1) c2(NP_001135970) c3(10293) c4(36407, 49464, 62521, 23350, 75578) c5(dx, by, f, axx, dN, aE, cO, bf, e, O, gO, jR, dv, kJ, EA, fH, Hs, gI, g, mz, aC, du, gm, bp, KK, fy, hR, dL, OA, jE, QJ, fN, ag, bq, aA, rn, mZ, wK, X, jz, rd, hS, ix, dV, IW, cA, U, y, co, pp, ajx, ml, ak, N, bu, dZ, B, cs, av, cp, bm, em, V, cEi, aoz, Bs, v, eX, rT, cK, Zt, pi, f J, buB, aH, fw, aoD, ji, ap, b, aE, cEg, z, ey, d, kW, hV, q, vu, ar, sR, fv, jG, bYO, u, dh, adN, aNu, sz, I, qL, Mi, ad, da, al, Nh, et, jU, Ha, WZ, jH, aWN, nV, Eu, ch, Dj, xU, ih, gd, o, I, bL, A, sO, mW, Iv, iL, wf, adR, jQ, m, aX, h, F, tF, adQ, aV, dj, si, cV, J, W, P, T, fD, jl, gE, cEh, aM, bSB, ao, bsX, atz, at, Dq); #c1(SIRT2) c2(NP_001180215) c3(10294) c4(36408, 49465, 62522, 23351, 75579) c5(da, A, aw, b, X, fE, atU, kB, sJ, hM, D, bf, U, bj, y, m, cy, DE, h, f, q, bu, pC, cM, ff, wM, fH, av, fy, u, aE, apz, is, PJ, dj, nl, si, V, I, bzB, aC, YR, GS, fO, dT, afn, v, j, Nh, J, by, pi, yA, aM, jH, ao, iK, ig, aY, B, ag, fJ, dc, I, Oi, aA, iu, bT); #c1(SIRT3) c2(NP_001017524) c3(10295) c4(36409, 49466, 62523, 23352, 75580) c5(eX, aw, b, cO, e, y, d, ip, dL, f, q, u, o, em, I, ny, et, BX, fN, MP, nJ, fY, bq, aA); #c1(SIRT4) c2(NP_036372) c3(10296) c4(36410, 49467, 62524, 23353, 75581) c5(pD, I, gm, b); #c1(SIRT5) c2(NP_001180196) c3(10297) c4(36411, 49468, 62525, 23354, 75582) c5(bK, ao, jv, hW); #c1(SIRT6) c2(NP_001180214) c3(10298) c4(36412, 49469, 62526, 23355, 75583) c5(wU, co, b, fN, aC, bm, mb, be, Dc, q, adr, xU, vZ, cs, Nh, I, aA, ad, u, yA, y); #c1(SIRT7) c2(NP_057622) c3(10299) c4(36413, 49470, 62527, 23356, 75584) c5(jE, eX, V, b, bm, f, q, J, T, i, fN, U, jT, u, fx, y); #c1(SIT1) c2(NP_055265) c3(10300) c4(36414, 49471, 62528, 23357, 75585) c5(aF, P, BV, o, tF); #c1(SIVA1) c2(NP_006418) c3(10301) c4(36415, 49472, 62529, 23358, 75586) c5(u, aEe, y, ad); #c1(SIX1) c2(NP_005973) c3(10302) c4(36416, 49473, 62530, 23359, 75587) c5(Ig, b, X, eu, K, U, y, ez, tp, Dx, re, q, qr, fr, ar, O, avh, av, fy, u, ajz, cl, fe, V, cEj, ft, T, AP, cEk, vz, nJ, bpk, ag, iT, aMp, Bx, ji, bOO, zg); #c1(SIX2) c2(NP_058628) c3(10303) c4(36417, 49474, 62531, 23360, 75588) c5(fe, u, PY, aJS, dB, T, ff, Uf, at, et, y); #c1(SIX3) c2(NP_005404) c3(10304) c4(36418, 49475, 62532, 23361, 75589) c5(bC, bU, co, js, aai, FR, bPw, bm, acK, aNH, kB, ar, bHI, ji, kD); #c1(SIX4) c2(NP_059116) c3(10305) c4(36419, 49476, 62533, 23362, 75590) c5(aDb); #c1(SIX5) c2(NP_787071) c3(10306) c4(36420, 49477, 62534, 23363, 75591) c5(X, bb, eI, cEI, zg); #c1(SIX6) c2(NP_031400) c3(10307) c4(36421, 49478, 62535, 23364, 75592) c5(er, ez, kH, t, bDj, ie, gr, cEm, G, dZ, dV, agO, Bu, kD, cEn); #c1(SKA1) c2(NP_001034624) c3(10308) c4(36422, 49479, 62536, 23365, 75593) c5(cy, AR); #c1(SKA2) c2(NP_001094065) c3(10309) c4(36423, 49480, 62537, 23366, 75594) c5(f0, u, y); #c1(SKAP1) c2(NP_003717) c3(10310) c4(36424, 49481, 62538, 23367, 75595) c5(X, av, zD); #c1(SKAP2) c2(NP_001290397) c3(10311) c4(36425, 49482, 62539, 23368, 75596) c5(kJ, eu, ei, akR, ar, bdw, jv, aE); #c1(SKIL) c2(NP_001138569) c3(10312) c4(36426, 49483, 62540, 23369, 75597) c5(d, gK, A, Pz, b, e, W, mk, cEo, fy, T, gg, aX, Mp, aw); #c1(SKIV2L) c2(NP_056175) c3(10313) c4(36427, 49484, 62541, 23370, 75598) c5(aC); #c1 (SKIV2L) c2(NP_008860) c3(10314) c4(36428, 49485, 62542, 23371, 75599) c5(dx, cEp, UA, cV, du, ox, bd, nv, m, dv, ZL, Io, ace, aYK, aaw, aW); #c1(SKOR1) c2(NP_001244953) c3(10315) c4(36429, 49486, 62543, 23372, 75600) c5(bP, aGP, zo, Jh, j, awu, do, pC, zb, fD); #c1(SKOR2) c2(NP_001032891) c3(10316) c4(36430, 49487, 62544, 23373, 75601) c5(aA, F); #c1(SKP1) c2(NP_008861) c3(10317) c4(36431, 49488, 62545, 23374, 75602) c5(P, cV, bj, KL, aeo); #c1(SKP2) c2(NP_001230049) c3(10318) c4(36432, 49489, 62546, 23375, 75603) c5(dx, by, A, b, jR, cY, dB, pD, g, w, os, iL, e, U, fx, y, d, jh, co, aX, aJo, kJ, h, f, jf, atx, bu, M, X, ar, B, cB, cs, av, fy, u, if, fU, V, cV, qL, du, J, bp, ad, W, dv, T, fO, iA, Ap, et, jG, aJn, yG, jT, nV, bm, in, Sk, ag, zO, i, eG, rb, jw); #c1(SLA2) c2(NP_115590) c3(10319) c4(36433, 49490, 62547, 23376, 75604) c5(bL); #c1(SLA) c2(NP_001039021) c3(10320) c4(36434, 49491, 62548, 23377, 75605) c5(t, G, qH, gB); #c1(SLAIN2) c2(NP_065897) c3(10321) c4(36435, 49492, 62549, 23378, 75606) c5(P); #c1(SLAMF1) c2(NP_003028) c3(10322) c4(36436, 49493, 62550, 23379, 75607) c5(kE, Zq, aHb, mW, m, Dg, gl, I, aC, bK, fO, gL, P, II, jT, hU, aeq, axl, uH, cT, Bm, i, abs, I, aEN); #c1(SLAMF6) c2(NP_001171643) c3(10323) c4(36437, 49494, 62551, 23380, 75608) c5(m, P, mW, akT, fO, iu, gl); #c1(SLAMF7) c2(NP_001269517) c3(10324) c4(36438, 49495, 62552, 23381, 75609) c5(m, aSW, bX, fO, bR, vI, TP); #c1(SLAMF8) c2(NP_064510) c3(10325) c4(36439, 49496, 62553, 23382, 75610) c5(IN, fl); #c1(SLBP) c2(NP_006518) c3(10326) c4(36440, 49497, 62554, 23383, 75611) c5(A, b, eB, dY, ee, fl); #c1 (SLC10A1) c2(NP_003040) c3(10327) c4(36441, 49498, 62555, 23384, 75612) c5(gK, vR, gB, g, bca, eH, EN, II, iL, bh, al, bm, bT, xd); #c1(SLC10A2) c2(NP_000443) c3(10328) c4(36442, 49499, 62556, 23385, 75613) c5(A, dD, au, xa, cO, bf, U, oy, qf, gB, az, cs, bw, IV, gD, V, cEq, dA, bK, ad, bh, HK, Wp, ac, xd, py, RT, qv, gz); #c1 (SLC10A6) c2(NP_932069) c3(10329) c4(36443, 49500, 62557, 23386, 75614) c5(NT); #c1(SLC10A7) c2(NP_001025169) c3(10330) c4(36444, 49501, 62558, 23387, 75615) c5(0T); #c1(SLC11A1) c2(NP_000569) c3(10331) c4(36445, 49502, 62559, 23388, 75616) c5(azt, asL, by, adJ, aw, Io, b, LX, aDD, gE, aMI, iU, bci, bRV, sJ, au, dx, cl, bf, al, re, y, aCV, az, cEt, IE, Xy, ae, vR, ahc, fq, pq, j, F, fP, bu, acO, ik, CX, cEs, LZ, dH, u, aE, cEr, aoh, ax, adK, i, I, jH, aC, du, ajI, gL, gv, P, II, aZ, aMt, fx, gY, cy, Bm, be, aM, VF, aH, aV, aFc, zE, acN, iT, aQk, ix, bOs, pW, yM, I, bh, NO, Xe, bOo); #c1(SLC11A2) c2(NP_000608) c3(10332) c4(36446, 49503, 62560, 23389, 75617) c5(Rr, bHc, ig, yK, bb, zo, aNA, aNC, bm, dh, fh, sB, yO, cEv, gv, T, cEu, et, pq, jH, Ck, gd, yM, bh); #c1(SLC12A1) c2(NP_000329) c3(10333) c4(36447, 49504, 62561, 23390, 75618) c5(qs, vR, wd, Fu, XQ, cEw, W, aPG, di, TW, et); #c1(SLC12A2) c2(NP_001243390) c3(10334) c4(36448, 49505, 62562, 23391, 75619) c5(A, hS, qP, di, O, Ag, bb, pp, f, q, iZ, bm, dh, g, mz, T, cy, xM, Fu, na, w, Af, bq, ap); #c1(SLC12A3) c2(NP_000330) c3(10335) c4(36449, 49506, 62563, 23392, 75620) c5(bP, bL, XQ, aAM, b, aEg, aKc, ahS, dv, w, di, dx, bWE, wf, cEx, e, y, cgR, d, gs, co, aX, t, f, jo, ze, su, iv, TW, cp, u, amO, ff, g, em, fU, fD, I, aUV, Fw, kZ, dt, aPG, ahO, T, ji, iy, fx, et, cld, Xw, du, fy, iY, Xu, ME, jR, aeP, i, bh, Xt, cgT); #c1(SLC12A4) c2(NP_001139433) c3(10336) c4(36450, 49507, 62564, 23393, 75621) c5(re, qt, iT, tQ); #c1(SLC12A5) c2(NP_001128243) c3(10337) c4(36451, 49508, 62565, 23394, 75622) c5(g, qZ, dj, I, dk, CG, hS, iZ, ale, cs, ad, dh); #c1(SLC12AG) c2(NP_001035960) c3(10338) c4(36452, 49509, 62566, 23395, 75623) c5(qZ, Y, ac, re, ak, v, iT, qS, hS, cjj, y, jr, u, tQ); #c1(SLC12A7) c2(NP_006589) c3(10339) c4(36453, 49510, 62567, 23396, 75624) c5(akd, u, y, Ld); #c1(SLC12A8) c2(NP_001182412) c3(10340) c4(36454, 49511, 62568, 23397, 75625) c5(da, JH); #c1 (SLC12A9) c2(NP_001254741) c3(10341) c4(36455, 49512, 62569, 23398, 75626) c5(B, aw, Vz, IM, w, e, O, M, Hq, kJ, t, DB, ji, tE, pq, gl, R, g, lb, bp, ft, x, fx, jT, eg, ja, jE, hx, ag, cT, i, aC, pt, aA, bT, afd, aJg, X, jz, kB, iG, U, y, co, yE, f, bu, cs, av, fy, bm, iT, fi, V, gv, YS, Qt, py, er, P, nJ, oM, OG, ck, b, xg, ey, Mr, d, jh, Be, re, hV, q, jV, IY, ar, RF, hb, Yr, fv, iR, dh, cl, da, il, qL, LR, ad, G, aZ, Lt, WZ, jH, nV, pS, u, kM, yr, cX, fl, af, A, k, fr, Lv, mW, aFe, xf, Iv, iL, gE, aJi, jx, m, QV, aX, gn, F, atx, cU, aA J, ik, rR, cB, jQ, aq, cV, be, dB, J, W, jo, T, fO, Oi, by, VF, Lc, ale, zM, bh, at, h); #c1(SLC13A1) c2(NP_071889) c3(10342) c4(36456, 49513, 62570, 23399, 75627) c5(rM, em, I, t, cz, adp, bg); #c1(SLC13A2) c2(NP_001139447) c3(10343) c4(36457, 49514, 62571, 23400, 75628) c5(av, u, FU, y); #c1(SLC13A3) c2(NP_001011554) c3(10344) c4(36458, 49515, 62572, 23401, 75629) c5(I); #c1(SLC13A5) c2(NP_001137310) c3(10345) c4(36459, 49516, 62573, 23402, 75630) c5(IC, av, u, y); #c1(SLC14A1) c2(NP_001122060) c3(10346) c4(36460, 49517, 62574, 23403, 75631) c5(vR, JH, Io, ae, qv, pF, aE, i, bf, cy, U, aHp, fx, bq, pv); #c1(SLC14A2) c2(XP_011524518) c3(10347) c4(36461, 49518, 62575, 23404, 75632) c5(dx, by, en, dN, aeB, iU, aE, ns, nm, nt, nq, nr, nn, bf, no, np, hM, cU, bQ, cy, b, t, AX, aDx, bbJ, sL, zb, fw, nB, kX, pq, bk, gl, Fg, aoh, g, Ew, og, agQ, HX, aC, bK, ft, du, yO, gm, fO, azo, fl, Gl, x, fx, fp, mO, dH, pb, wh, fy, qt, aai, Ey, aaz, bm, qN, jh, K, we, iV, cT, w, pv, bpS, aM, cB, btv, aA, jl, cl, bV, bP, fl, zr, cG, nF, bKn, jj, i, oH, mk, ix, bZ, sF, wX, si, ai, A, cM, V, rF, yE, Wn, ml, f, bu, gX, B, cs, Ch, av, CX, pP, iT, dX, ajs, yV, ae, dA, bx, tR, nl, v, kp, byO, Fy, dv, eX, bq, rV, iA, hw, sK, aJc, aaf, TP, bwP, dY, qO, fK, ji, iu, ap, am, aF, ak, eR, AA, wn, m, au, aVb, z, aoi, fD, alb, eE, biX, bb, aga, re, nU, q, ND, X, vu, ar, RF, qu, jG, ctJ, u, nj, o, ff, sQ, jE, I, kt, el, fz, ad, aD, CZ, aUJ, iD, et, kS, jU, P, iw, ao, KK, XI, hS, LQ, tW, py, he, Qx, MR, Bm, amb, HV, R, cK, C, lb, aBt, pF, mz, fr, zF, gE, xj, mW, bci, O, di, s, iL, bw, wf, fs, al, jR, bIT, U, aW, oy, RX, qs, aX, fq, F, PR, yx, do, az, hN, y, cEy, jZ, jH, aAU, oJ, Ps, ax, hW, ez, apx, cV, dB, J, dt, jo, co, ll, aj, cr, mQ, cz, qe, bgD, et, eG, bNr, G, fP, at, bpe); #c1 (SLC15A1) c2(NP_005064) c3(10348) c4(36462, 49519, 62576, 23405, 75633) c5(jH, vR, jU, pR, gG, fP, bba, HK, O); #c1(SLC15A2) c2(NP_001139470) c3(10349) c4(36463, 49520, 62577, 23406, 75634) c5(aV, aX, bk, vR); #c1(SLC15A4) c2(NP_663623) c3(10350) c4(36464, 49521, 62578, 23407, 75635) c5(m, aA, fP, I); #c1 (SLC16AI0) c2(NP_061063) c3(10351) c4(36465, 49522, 62579, 23408, 75636) c5(A, bK, re, f, cEz, P, B, i, fx); #c1(SLC16AI1) c2(NP_699188) c3(10352) c4(36466, 49523, 62580, 23409, 75637) c5(X, av, I); #c1(SLC16AI2) c2(NP_998771) c3(10353) c4(36467, 49524, 62581, 23410, 75638) c5(aWN, dA, by, cEB, cEA, bu); #c1(SLC16AI3) c2(NP_963860) c3(10354) c4(36468, 49525, 62582, 23411, 75639) c5(I); #c1(SLC16A1) c2(XP_011540329) c3(10355) c4(36469, 49526, 62583, 23412, 75640) c5(dx, cEC, B, b, cED, hY, w, A, e, O, d, co, Ec, f, fr, iZ, y, u, cV, du, gm, fO, ft, dv, T, x, gF, jT, hw, fM, jH, cf, oi, fP, mD); #c1(SLC16A2) c2(NP_006508) c3(10356) c4(36470, 49527, 62584, 23413, 75641) c5(akH, ig, ii, cJ, Wk, nz, f, xJ, cEz, ME, ng, hM, nU, Hh, pO); #c1(SLC16A3) c2(XP_011521909) c3(10357) c4(36471, 49528, 62585, 23414, 75642) c5(dx, A, b, pR, dB, oi, IW, nT, e, O, d, dv, f, B, u, cl, du, fO, jo, ff, fM, y); #c1(SLC16A6) c2(NP_004685) c3(10358) c4(36472, 49529, 62586, 23415, 75643) c5(eG); #c1(SLC16A7) c2(XP_005269288) c3(10359) c4(36473, 49530, 62587, 23416, 75644) c5(aA, cf, fM); #c1(SLC16A8) c2(NP_037488) c3(10360) c4(36474, 49531, 62588, 23417, 75645) c5(dx, dv, du, vR, IW); #c1(SLC16A9) c2(NP_919274) c3(10361) c4(36475, 49532, 62589, 23418, 75646) c5(bf, nH, nX); #c1(SLC17A1) c2(NP_005065) c3(10362) c4(36476, 49533, 62590, 23419, 75647) c5(gK, nH, b, nX, AR, AQ, cEE, o); #c1(SLC17A2) c2(NP_001273052) c3(10363) c4(36477, 49534, 62591, 23420, 75648) c5(nX); #c1(SLC17A3) c2(NP_001091956) c3(10364) c4(36478, 49535, 62592, 23421, 75649) c5(nX, awK, ob, cEF, cEG, aO); #c1(SLC17A4) c2(NP_005486) c3(10365) c4(36479, 49536, 62593, 23422, 75650) c5(dx, du); #c1(SLC17A5) c2(NP_036566) c3(10366) c4(36480, 49537, 62594, 23423, 75651) c5(bP, dx, cEI, b, gE, C, iL, z, bf, al, dv, aX, Iz, f, alz, q, vQ, pq, jZ, IG, du, cEH, bBR, aza, v, gv, P, hv, II, bh, cy, dL, aA, aM, fN, fD, bzA, LG, alw); #c1(SLC17AG) c2(NP_065079) c3(10367) c4(36481, 49538, 62595, 23424, 75652) c5(ao, A, xJ, hS, ak, cA, bj, oN); #c1(SLC17A7) c2(NP_064705) c3(10368) c4(36482, 49539, 62596, 23425, 75653) c5(f, ak, xJ, hS, cA, oN); #c1(SLC17A8) c2(NP_001138760) c3(10369) c4(36483, 49540, 62597, 23426, 75654) c5(d, na, cEJ, e, Bx); #c1 (SLC18A1) c2(XP_011542926) c3(10370) c4(36484, 49541, 62598, 23427, 75655) c5(oC, bxC, b, cV, aY, vu, h, ak, v, ih, fB, do, w, y, dc, VP, O, u, cM); #c1(SLC18A2) c2(NP_003045) c3(10371) c4(36485, 49542, 62599, 23428, 75656) c5(QU, oC, f, aw, b, GL, dj, Ey, A, HS, cA, bf, gZ, bj, cM, Wj, WA, ak, je, oE, do, vu, B, Gj, aE, o, ajs, si, alX, bK, dc, KL, GI, VP, Fr, IV, mO, aM, to, anG, aY, ih, lb, jN, HV); #c1(SLC18A3) c2(NP_003046) c3(10372) c4(36486, 49543, 62600, 23429, 75657) c5(HI, aNY, cy, rK, gs, o); #c1(SLC19A1) c2(NP_001192135) c3(10373) c4(36487, 49544, 62601, 23430, 75658) c5(GD, IJ, ak, b, fr, rR, LA, iX, pX, A, di, sF, jy, U, Bz, e, y, gO, gM, bwt, jl, co, bb, am, vR, t, f, F, Ns, bu, cd, gX, ar, tE, cB, nA, fy, u, jH, gP, d, ax, V, dA, aC, bK, ft, gm, fh, J, W, G, T, bp, x, cr, fx, ad, aph, dH, iw, jT, hQ, aq, Nq, by, cz, i, I, xf, at, LB); #c1(SLC19A2) c2(NP_008927) c3(10374) c4(36488, 49545, 62602, 23431, 75659) c5(cEL, I, b, GC, cp, pq, cEK, sZ, di, bf, tj, cCS, Vd, gO, u, jG, y, aM); #c1(SLC19A3) c2(XP_005246931) c3(10375) c4(36489, 49546, 62603, 23432, 75660) c5(ake, by, hT, cEM, b, vn, f, bcK, cCS, bu, u, y, gO); #c1(SLC1A1) c2(NP_004161) c3(10376) c4(36490, 49547, 62604, 23433, 75661) c5(f, cEN, Hp, iU, hS, cA, aho, qc, ak, iZ, qu, aV, dh, hW, bK, GS, Fs, cz, cmF, rV, ao, hT, nU, cEO, eG); #c1(SLC1A2) c2(NP_001182657) c3(10377) c4(36491, 49548, 62605, 23434, 75662) c5(by, ak, aw, b, aPm, mE, hS, dd, HS, cA, si, eD, O, asN, Iz, oj, bj, Dq, f, jV, bu, Vr, vu, k, fH, OA, aV, Fg, hW, cEP, lb, bK, v, bN, P, Gl, zo, bQF, cz, f J, aL, ao, bmV, tW, hT, PY, fw, ih, iZ, zT, o, aCB, GJ); #c1(SLC1A3) c2(NP_001160167) c3(10378) c4(36492, 49549, 62606, 23435, 75663) c5(fl, axl, akB, hS, si, dV, cA, ai, aks, ey, bau, sG, f, dZ, zb, aV, dA, cz, P, cmF, ayw, cEQ, eo, ih); #c1(SLC1A4) c2(NP_001180422) c3(10379) c4(36493, 49550, 62607, 23436, 75664) c5(f, bb, GS, vR); #c1(SLC1A5) c2(NP_001138616) c3(10380) c4(36494, 49551, 62608, 23437, 75665) c5(A, b, si, e, d, co, aX, h, q, oc, ar, fy, bm, bev, iT, sH, cg, cW, gp, dh, bk, re); #c1 (SLC1A6) c2(NP_001259017) c3(10381) c4(36495, 49552, 62609, 23438, 75666) c5(cA, BS, ak, lv, vR); #c1 (SLC20A1) c2(NP_005406) c3(10382) c4(36496, 49553, 62610, 23439, 75667) c5(fl, avX, Sc, iP, VY, hM, OV, y, gO, ja, Dc, mm, u, iF, Be, W, T, Jj, aYj, sP, pq, wU, LO, acK, yE, eG, biS, bBW); #c1(SLC20A2) c2(XP_005273670) c3(10383) c4(36497, 49554, 62611, 23440, 75668) c5(iP, QI, bM, aYj, bj, gO); #c1(SLC22A11) c2(NP_060954) c3(10384) c4(36498, 49555, 62612, 23441, 75669) c5(bP, nX, nH, ob, P, cp); #c1(SLC22A12) c2(NP_001263255) c3(10385) c4(36499, 49556, 62613, 23442, 75670) c5(cgS, aH, nH, ob, nX, cER, eX, ckz, et); #c1(SLC22A13) c2(NP_004247) c3(10386) c4(36500, 49557, 62614, 23443, 75671) c5(f, ff); #c1(SLC22A14) c2(NP_004794) c3(10387) c4(36501, 49558, 62615, 23444, 75672) c5(F0); #c1(SLC22A16) c2(NP_149116) c3(10388) c4(36502, 49559, 62616, 23445, 75673) c5(oC, q, J, iA, u, y); #c1(SLC22A17) c2(NP_057693) c3(10389) c4(36503, 49560, 62617, 23446, 75674) c5(jh, il, q, T, kY, jG, O); #c1(SLC22A18AS) c2(NP_001289791) c3(10390) c4(36504, 49561, 62618, 23447, 75675) c5(mF, cV); #c1(SLC22A18) c2(NP_899056) c3(10391) c4(36505, 49562, 62619, 23448, 75676) c5(b, fa, e, y, d, co, re, q, ar, O, u, iT, cl, aPI, jB, fe, ae, cES, ew, bp, mF, py, akm, fY, dn, Mp, ja); #c1(SLC22A1) c2(NP_003048) c3(10392) c4(36506, 49563, 62620, 23449, 75677) c5(dx, gD, by, A, jT, gG, IM, eW, gB, di, gE, bf, al, bkC, bQ, I, f, q, ik, jG, aMi, u, iT, ae, iF, vR, kF, il, aC, du, gm, J, dv, T, x, qH, fp, aM, aH, fy, gs, ch, DE, ag, fP, aA, bT); #c1(SLC22A23) c2(NP_001273385) c3(10393) c4(36507, 49564, 62621, 23450, 75678) c5(jH, eG, fP); #c1(SLC22A24) c2(NP_001129978) c3(10394) c4(36508, 49565, 62622, 23451, 75679) c5(aH); #c1(SLC22A2) c2(NP_003049) c3(10395) c4(36509, 49566, 62623, 23452, 75680) c5(bP, b, X, IM, di, bf, RR, ob, h, f J, fH, av, aE, gD, I, dA, jG, gJ, gm, fO, jT, et, Ah, aH, gs, ch, fD, at); #c1(SLC22A3) c2(NP_068812) c3(10396) c4(36510, 49567, 62624, 23453, 75681) c5(by, hg, aw, b, X, QB, gG, fy, wy, od, BY, w, di, nJ, kY, O, bw, U, oE, Aee, al, y, gB, co, aX, UZ, kJ, adr, f, q, bu, HY, fr, Mr, ar, B, A, cs, qu, hV, av, Hs, u, aE, fp, afM, V, PX, Be, LR, dB, ad, jo, nV, T, Bg, ji, x, rV, fx, ft, Gj, cW, cU, wV, IV, wP, sS, oi, bm, jh, he, ag, Lo, sf, i, asO, at, os); #c1(SLC22A4) c2(NP_003050) c3(10397) c4(36511, 49568, 62625, 23454, 75682) c5(sE, ig, ix, di, cET, U, xe, Aee, m, Xy, DM, aE, dh, da, V, cV, aC, be, J, gY, aFj, cEU, gU, fM, jH, aNM, sS, xU, xr, DI, fP, Xe, h); #c1(SLC22A5) c2(NP_003051) c3(10398) c4(36512, 49569, 62626, 23455, 75683) c5(b, X, le, ix, di, cO, Aee, y, mR, cy, DM, f, xr, bu, aC, Ex, cM, fM, oD, av, u, aE, n, da, V, ac, sH, gY, rw, oF, cK, cEU, by, hj, mO, sK, jH, qt, sS, pP, cf, xe, ep, gA, DI, fP, ah, aA, at, fj, rr); #c1(SLC22A6) c2(NP_004781) c3(10399) c4(36513, 49570, 62627, 23456, 75684) c5(bP, jH, ak, P, di, mm, et); #c1(SLC22A7) c2(NP_006663) c3(10400) c4(36514, 49571, 62628, 23457, 75685) c5(fy, it, gB, g); #c1(SLC22A8) c2(NP_001171661) c3(10401) c4(36515, 49572, 62629, 23458, 75686) c5(en, zl, di, II, et, ac); #c1(SLC23A1) c2(NP_005838) c3(10402) c4(36516, 49573, 62630, 23459, 75687) c5(W, jT, gB, jl, vg, b, i, f, q, gL, bu, aDL, mk, vc, tG, z, I, by, bm, jH, ez); #c1(SLC23A2) c2(NP_005107) c3(10403) c4(36517, 49574, 62631, 23460, 75688) c5(W, jT, gB, jl, cV, f, bu, aDL, od, i, z, I, by, ap); #c1(SLC24A1) c2(NP_004718) c3(10404) c4(36518, 49575, 62632, 23461, 75689) c5(cEV, dZ, dV, ml); #c1(SLC24A2) c2(XP_005251482) c3(10405) c4(36519, 49576, 62633, 23462, 75690) c5(cy, ml, Wp, bb); #c1(SLC24A3) c2(NP_065740) c3(10406) c4(36520, 49577, 62634, 23463, 75691) c5(oy, cy, cV, bgV, gd, cO, rb); #c1(SLC24A4) c2(NP_705932) c3(10407) c4(36521, 49578, 62635, 23464, 75692) c5(cEW, aX, I, ml, DO, di, ic, Ur); #c1(SLC24A5) c2(NP_995322) c3(10408) c4(36522, 49579, 62636, 23465, 75693) c5(bP, d, cEX, aX, aeM, ic, fD, bq, e, aW); #c1(SLC25A10) c2(NP_001257817) c3(10409) c4(36523, 49580, 62637, 23466, 75694) c5(Ag, aXc, bc, jV, T, Af, z, blp); #c1(SLC25A12) c2(NP_003696) c3(10410) c4(36524, 49581, 62638, 23467, 75695) c5(BO, rQ, aC, cz, cEY, cbH, aiC); #c1(SLC25A13) c2(NP_001153682) c3(10411) c4(36525, 49582, 62639, 23468, 75696) c5(gD, bEQ, bER, cEZ, gB, q, cz, fN, Ns, aiC, cFa, byQ, z, dL, Ng); #c1(SLC25A14) c2(NP_001269124) c3(10412) c4(36526, 49583, 62640, 23469, 75697) c5(aA); #c1(SLC25A15) c2(NP_055067) c3(10413) c4(36527, 49584, 62641, 23470, 75698) c5(aiz, alp, gH, QZ, cmw, avF, aig, bDA); #c1(SLC25A16) c2(XP_006718050) c3(10414) c4(36528, 49585, 62642, 23471, 75699) c5(yg, ao, b, jR, h, J, fO, bu, kB, w, fM, tl, oi, by, u, y, JY); #c1(SLC25A18) c2(NP_001290413) c3(10415) c4(36529, 49586, 62643, 23472, 75700) c5(B, dB); #c1(SLC25A19) c2(XP_006722070) c3(10416) c4(36530, 49587, 62644, 23473, 75701) c5(Y, cV, cFb, cFc, w, QZ, oV); #c1(SLC25A1) c2(NP_001243463) c3(10417) c4(36531, 49588, 62645, 23474, 75702) c5(bm, IJ, en, b, X, aF, Mj, cs, eu, IL, K, Eh, Mn, Fp, Hq, t, h, q, qU, M, jK, si, av, fy, pP, da, qw, ZY, ad, G, QI, T, afb, cz, iv, aq, bdc, Ck, he, ah, pJ, jj); #c1(SLC25A20) c2(NP_000378) c3(10418) c4(36532, 49589, 62646, 23475, 75703) c5(ak, b, gw, jt, bGs, bV, bf, pz, aNQ, yg, dN, f, q, es, cU, qY, pP, aE, e, tP, gY, W, fx, aM, aoO, dO, dS, iR, jR, ajH, i, aA, at, ap); #c1(SLC25A21) c2(NP_001164641) c3(10419) c4(36533, 49590, 62647, 23476, 75704) c5(B, aw, b, MS, hS, A, ct, U, y, aX, jd, f, N, q, cM, cs, u, V, cV, el, ht, J, fO, ad, P, T, cy, jE, zE, aY, bm, ie, fg, dc); #c1(SLC25A22) c2(XP_011518673) c3(10420) c4(36534, 49591, 62648, 23477, 75705) c5(IC, crT, yH, hS); #c1(SLC25A23) c2(NP_077008) c3(10421) c4(36535, 49592, 62649, 23478, 75706) c5(b, X, f, ar, ct, ji, av); #c1(SLC25A25) c2(NP_001006642) c3(10422) c4(36536, 49593, 62650, 23479, 75707) c5(Ns, aX, Nq); #c1(SLC25A27) c2(NP_001190980) c3(10423) c4(36537, 49594, 62651, 23480, 75708) c5(sG, aV, bF, I, cV); #c1(SLC25A2) c2(NP_114153) c3(10424) c4(36538, 49595, 62652, 23481, 75709) c5(aig, bDA); #c1(SLC25A36) c2(NP_001098117) c3(10425) c4(36539, 49596, 62653, 23482, 75710) c5(ag, aV, T); #c1(SLC25A37) c2(NP_057696) c3(10426) c4(36540, 49597, 62654, 23483, 75711) c5(bP, bi, aw, b, X, zF, pR, lW, eu, O, aNP, w, ds, ZM, z, bf, U, G, xI, cp, aX, pp, ag, jd, t, pq, f, q, cc, bu, jo, nL, vu, aO, gg, iJ, fP, av, aV, u, dh, ff, g, wK, aP, V, sB, J, cM, ad, IR, IX, IJ, fO, bq, gn, bb, by, anf, JJ, aM, bPT, ao, cs, sS, PY, fw, aE, gd, cT, lS, fI, zS, aA, y); #c1(SLC25A38) c2(NP_060345) c3(10427) c4(36541, 49598, 62655, 23484, 75712) c5(bDx, bb, v, kU); #c1(SLC25A3) c2(NP_002626) c3(10428) c4(36542, 49599, 62656, 23485, 75713) c5(A, SS, k, X, dB, aE, fI, di, O, bf, ey, buk, y, co, aX, b, f, bu, fr, B, av, aV, u, bze, ff, I, ze, pF, J, bp, ft, dt, P, zi, by, jG, aM, sK, cFd, OJ, fc, aA); #c1(SLC25A40) c2(NP_061331) c3(10429) c4(36543, 49600, 62657, 23486, 75714) c5(d, e); #c1(SLC25A41) c2(NP_775908) c3(10430) c4(36544, 49601, 62658, 23487, 75715) c5(u, y); #c1(SLC25A42) c2(NP_848621) c3(10431) c4(36545, 49602, 62659, 23488, 75716) c5(MT); #c1(SLC25A43) c2(NP_660348) c3(10432) c4(36546, 49603, 62660, 23489, 75717) c5(bdT, u, y, b, bZ); #c1(SLC25A45) c2(NP_001265179) c3(10433) c4(36547, 49604, 62661, 23490, 75718) c5(aX); #c1(SLC25A46) c2(NP_001290178) c3(10434) c4(36548, 49605, 62662, 23491, 75719) c5(cy, ap); #c1(SLC25A47) c2(NP_997000) c3(10435) c4(36549, 49606, 62663, 23492, 75720) c5(g); #c1(SLC25A4) c2(NP_001142) c3(10436) c4(36550, 49607, 62664, 23493, 75721) c5(ak, am, X, sv, ns, wn, nm, nt, nq, nr, nn, Bo, no, np, A, fD, xI, ez, cK, co, bb, b, kW, cA, f, q, cy, mR, y, bgW, oD, av, u, Qx, o, aNN, vi, dj, NT, cFf, Bs, cFe, ctf, awT, ala, aFj, vX, rO, fx, qe, P, LU, AB, fw, B, w, i, I, eG); #c1(SLC25A52) c2(NP_001029344) c3(10437) c4(36551, 49608, 62665, 23494, 75722) c5(hT, u, y); #c1(SLC25A5) c2(NP_001143) c3(10438) c4(36552, 49609, 62666, 23495, 75723) c5(nU, b, jz, A, hM, Iv, z, y, jQ, sb, f, q, Uq, ar, B, mR, bm, ff, aNN, Ea, T, cK, ii, u, fD, pO); #c1(SLC25A6) c2(NP_001627) c3(10439) c4(36553, 49610, 62667, 23496, 75724) c5(ak, kW, f, P, w, mR, cA, aFj); #c1(SLC26A1) c2(NP_071325) c3(10440) c4(36554, 49611, 62668, 23497, 75725) c5(ih, aX, cO, ak, fO, W, wq, MR, Qt, cA, TW, u, fx, cM); #c1(SLC26A2) c2(NP_000103) c3(10441) c4(36555, 49612, 62669, 23498, 75726) c5(b, iP, rP, aQq, adp, cFj, cp, cFg, bu, cs, fy, u, Yj, em, ax, fs, cFh, bp, ad, dt, wq, by, AP, dH, rM, W, ID, cC, cFi); #c1(SLC26A3) c2(XP_011514169) c3(10442) c4(36556, 49613, 62670, 23499, 75727) c5(b, jH, w, akL, iL, gE, bf, U, rP, jT, gz, Ll, g, Vl, v, ar, cs, aMM, TW, aV, IT, bk, em, V, apx, IP, afB, gv, dt, wq, bh, x, cFk, ad, aM, W, aZS, lD, hX, fc, cT, Bm, gR, bzA, iu); #c1(SLC26A4) c2(NP_000432) c3(10443) c4(36557, 49614, 62671, 23500, 75728) c5(hV, iq, b, Sc, DT, oH, A, hM, aNa, y, rP, cy, or, na, h, f, bCC, bCE, auy, u, bzf, wK, bCF, yV, VD, an, bCN, gL, J, dt, auH, P, xO, T, ll, HO, W, nV, akn, dP, ID, aTr, aIo, wq, bDZ, Bx, I, di, bwJ, at, iu, as); #c1(SLC26A5) c2(NP_001161434) c3(10444) c4(36558, 49615, 62672, 23501, 75729) c5(rP, ID, cFI, vQ, wq, hM, Kt); #c1(SLC26A6) c2(NP_001035544) c3(10445) c4(36559, 49616, 62673, 23502, 75730) c5(aAU, bpR, FC, W, HC, wq, di, MR, VX); #c1(SLC26A7) c2(NP_439897) c3(10446) c4(36560, 49617, 62674, 23503, 75731) c5(HN, FC, W, wq, bBU, VX); #c1(SLC26A8) c2(NP_001180405) c3(10447) c4(36561, 49618, 62675, 23504, 75732) c5(pM, fh, A, bb, fD, am, bK, re, B, FC, cIG, P, i, bq, fx, at, VX, ap); #c1(SLC26A9) c2(NP_599152) c3(10448) c4(36562, 49619, 62676, 23505, 75733) c5(cy, I, cFe, DT, cFn, cFm, aZ, gE, bf, aMw, aM); #c1(SLC27A1) c2(XP_011526304) c3(10449) c4(36563, 49620, 62677, 23506, 75734) c5(mz, I, bxC, eX, eH, om, bq, aA, gF, ap); #c1(SLC27A2) c2(NP_001153101) c3(10450) c4(36564, 49621, 62678, 23507, 75735) c5(co, ex, mX, y, O, u, o); #c1(SLC27A3) c2(NP_077306) c3(10451) c4(36565, 49622, 62679, 23508, 75736) c5(g, co, b, w, GF, O); #c1(SLC27A4) c2(NP_005085) c3(10452) c4(36566, 49623, 62680, 23509, 75737) c5(by, vR, dw, I, om, fN, eX, aKv, cFp, ll, bxN, aA, bu); #c1(SLC27A5) c2(NP_036386) c3(10453) c4(36567, 49624, 62681, 23510, 75738) c5(eX, b, iU, vB, sJ, z, BH, eb, eK, aof, f, q, cy, iv, gg, bm, I, LR, gm, j, aKK, dt, P, cl, pi, qV, MW, eF, fN, dY, sN, gd, aKP, zO, I); #c1(SLC28A1) c2(NP_004204) c3(10454) c4(36568, 49625, 62682, 23511, 75739) c5(P, iw, o, fv, ac, h, q, bp, ag, cT, hN, ar, y, bw, Hh, fy, u, CH); #c1(SLC28A2) c2(XP_011520500) c3(10455) c4(36569, 49626, 62683, 23512, 75740) c5(ch, vQ, cT, Hh, et, CH, pq); #c1(SLC28A3) c2(NP_001186562) c3(10456) c4(36570, 49627, 62684, 23513, 75741) c5(iw, ch, P, cT, hN, gE, Hh, pq); #c1(SLC29A1) c2(NP_001071643) c3(10457) c4(36571, 49628, 62685, 23514, 75742) c5(lO, jz, gE, bw, aI, G, jQ, gd, t, h, fv, fH, fy, CH, fh, bp, P, Hh, fJ, pq, ch, aaB, mA, ag, cT); #c1(SLC29A2) c2(XP_011543277) c3(10458) c4(36572, 49629, 62686, 23515, 75743) c5(b, gE, NH, bVJ, Fm, ey, FA, aX, t, h, q, n, iv, cFq, o, qq, J, G, Hh, iA, NG, gd, cT, pH, CH); #c1(SLC29A3) c2(NP_060814) c3(10459) c4(36573, 49630, 62687, 23516, 75744) c5(US, cr, mP, b, CH, aY, dE, LG, aq, by, mk, bGJ, cFr, dc, bf, cCN, aE, cM, aM); #c1(SLC29A4) c2(XP_006715730) c3(10460) c4(36574, 49631, 62688, 23517, 75745) c5(dh, CH, by); #c1(SLC2A10) c2(NP_110404) c3(10461) c4(36575, 49632, 62689, 23518, 75746) c5(kB, bf, bW, y, co, BL, aTg, cl, ar, aTe, u, I, nx, nz, LR, cy, aM, AL, Eo, agw, rv, ji); #c1(SLC2A11) c2(NP_001020109) c3(10462) c4(36576, 49633, 62690, 23519, 75747) c5(AL, A, I, B, fO, bW); #c1(SLC2A12) c2(NP_660159) c3(10463) c4(36577, 49634, 62691, 23520, 75748) c5(A, B, fO, di, u, y); #c1 (SLC2A13) c2(NP_443117) c3(10464) c4(36578, 49635, 62692, 23521, 75749) c5(d, b, ja, IV, fy, bj, e); #c1 (SLC2A14) c2(NP_001273163) c3(10465) c4(36579, 49636, 62693, 23522, 75750) c5(k, X, wy, w, ey, e, y, d, m, co, t, f, hY, ar, O, cs, fB, fH, av, fy, u, o, mz, si, I, ad, G, od, fx, f J, ahT, nV, QN, mA, i, ji, mo); #c1(SLC2A2) c2(NP_000331) c3(10466) c4(36580, 49637, 62694, 23523, 75751) c5(dx, b, if, gw, bf, ey, e, y, d, BM, cFs, PK, q, Uq, bJa, arK, cs, QJ, u, aE, mz, vR, I, mt, du, gm, ad, awI, T, Il, et, aM, ahT, ch, mB, cf, yE, fN, mD, aA, ap); #c1(SLC2A3) c2(NP_008862) c3(10467) c4(36581, 49638, 62695, 23524, 75752) c5(k, X, mo, wy, w, di, Lr, ey, e, y, d, m, co, yQ, vR, f, hY, ar, O, cs, fB, fH, av, fy, u, o, mz, ma, si, I, ad, T, ji, fx, fJ, ahT, nV, ii, QN, ch, cf, mA, ep, i, gj, od, eG); #c1(SLC2A4RG) c2(NP_064446) c3(10468) c4(36582, 49639, 62696, 23525, 75753) c5(dx, aeT, f, b, cG, hS, A, O, y, aeQ, co, aX dv, h, nU, zi, ar, B, u, kF, cV, nW, du, J, cM, cz, dt, bQ, ct, yQ, gA, Ia, aeu); #c1(SLC2A5) c2(XP_011540307) c3(10469) c4(36583, 49640, 62697, 23526, 75754) c5(fi, A, b, I, bm, B, q, di, eX, u, y); #c1 (SLC2A6) c2(NP_001138571) c3(10470) c4(36584, 49641, 62698, 23527, 75755) c5(nX, b, m, cER, fO, nT, bq, at); #c1(SLC2A8) c2(NP_001258640) c3(10471) c4(36585, 49642, 62699, 23528, 75756) c5(f0); #c1(SLC2A9) c2(NP_001001290) c3(10472) c4(36586, 49643, 62700, 23529, 75757) c5(nX, nH, I, b, cFt, cER, eX, Nq, fO, ih, zz, ob, Rj, bq, aA, at, o, nK); #c1(SLC30A10) c2(NP_061183) c3(10473) c4(36587, 49644, 62701, 23530, 75758) c5(mz, A, cFu, I, mD, zf, MP, aE, gF, bf, bM, yW, Wy, ey, aM); #c1(SLC30A1) c2(NP_067017) c3(10474) c4(36588, 49645, 62702, 23531, 75759) c5(pu, ag, qL, bm, q, tF, mL, o, i, sX, I, mD, u, dh, y); #c1(SLC30A3) c2(NP_003450) c3(10475) c4(36589, 49646, 62703, 23532, 75760) c5(aL, DT, aN, bf, aK, aM); #c1(SLC30A4) c2(XP_011520299) c3(10476) c4(36590, 49647, 62704, 23533, 75761) c5(ma, pN, JF, B, zN, A, i, aNU, I, cFv, o); #c1(SLC30A5) c2(NP_075053) c3(10477) c4(36591, 49648, 62705, 23534, 75762) c5(A, fl); #c1(SLC30A6) c2(NP_001180442) c3(10478) c4(36592, 49649, 62706, 23535, 75763) c5(A, o); #c1(SLC30A7) c2(XP_011539081) c3(10479) c4(36593, 49650, 62707, 23536, 75764) c5(ik, aV, A, jh); #c1 (SLC30A8) c2(NP_001166286) c3(10480) c4(36594, 49651, 62708, 23537, 75765) c5(dx, A, gU, gE, bf, ey, gF, cy, mm, aE, mz, kF, I, du, P, bq, zf, yW, aM, Ah, MP, mD, aA, at); #c1(SLC30A9) c2(NP_006336) c3(10481) c4(36595, 49652, 62709, 23538, 75766) c5(A); #c1 (SLC31A1) c2(NP_001850) c3(10482) c4(36596, 49653, 62710, 23539, 75767) c5(co, b, Kj, nU, X, A, Re, B, i, fK, av, fy, fx); #c1(SLC31A2) c2(NP_001851) c3(10483) c4(36597, 49654, 62711, 23540, 75768) c5(b, X, f, fO, av, nP); #c1(SLC32A1) c2(NP_542119) c3(10484) c4(36598, 49655, 62712, 23541, 75769) c5(W, hS); #c1(SLC33A1) c2(NP_001177921) c3(10485) c4(36599, 49656, 62713, 23542, 75770) c5(dx, uk, IK, LM, dv, dM, di, cO, MZ, aI, A, aO, gO, qs, bQ, aX, et, f, q, wv, Vr, cM, vE, u, fh, I, Nc, Fw, du, cFw, QC, v, W, sV, cFx, MK, ajj, sK, ao, PL, aY, bm, Ic, fw, B, ag, dc, bq, aA, at, eG, Hq, y, ap); #c1(SLC34A1) c2(NP_001161051) c3(10486) c4(36600, 49657, 62714, 23543, 75771) c5(ma, aAW, bbT, iU, ii, AR, cFA, awI, hM, cFB, D, TW, cFy, et, fD, cFz, gD); #c1(SLC34A2) c2(NP_001171470) c3(10487) c4(36601, 49658, 62715, 23544, 75772) c5(cFC, bsT, gP, bsX, bsP, fy, bzs); #c1

(SLC34A3) c2(NP_001170788) c3(10488) c4(36602, 49659, 62716, 23545, 75773) c5(aAU, aLt, cFE, em, mt, cFD, AQ, cFz, arA, TW, cEE, amK, AD); #c1(SLC35A1) c2(NP_001161870) c3(10489) c4(36603, 49660, 62717, 23546, 75774) c5(KC, LE, eQ, f, cFF, aBc); #c1(SLC35A2) c2(NP_001027460) c3(10490) c4(36604, 49661, 62718, 23547, 75775) c5(KC, A, byJ, b, cFG, EN, hS, iL, U, qG, y, d, it, B, e, q, bqC, cU, ik, fx, cs, PT, u, V, iI, ad, eq, iA, py, IC, bm, i); #c1(SLC35A3) c2(XP_011539439) c3(10491) c4(36605, 49662, 62719, 23548, 75776) c5(o, aW, cFH); #c1(SLC35A4) c2(NP_542401) c3(10492) c4(36606, 49663, 62720, 23549, 75777) c5(b, q, by, ji, u, y); #c1 (SLC35B2) c2(NP_001273442) c3(10493) c4(36607, 49664, 62721, 23550, 75778) c5(jI, b, Os, cFl, gm, Ov, cT, Um, Ou, jT); #c1(SLC35B4) c2(NP_116215) c3(10494) c4(36608, 49665, 62722, 23551, 75779) c5(aA); #c1 (SLC35C1) c2(NP_001138738) c3(10495) c4(36609, 49666, 62723, 23552, 75780) c5(dt, KG, g); #c1(SLC35D3) c2(NP_001008783) c3(10496) c4(36610, 49667, 62724, 23553, 75781) c5(aA, eX, IZ); #c1(SLC35F1) c2(NP_001025029) c3(10497) c4(36611, 49668, 62725, 23554, 75782) c5(oy, cO, ap, dA); #c1(SLC35F2) c2(NP_059985) c3(10498) c4(36612, 49669, 62726, 23555, 75783) c5(at, bb); #c1(SLC35F3) c2(NP_001287774) c3(10499) c4(36613, 49670, 62727, 23556, 75784) c5(bb, f, td, di, bg, cCS, he); #c1(SLC35F4) c2(XP_011535022) c3(10500) c4(36614, 49671, 62728, 23557, 75785) c5(ak, td); #c1(SLC35F6) c2(NP_060347) c3(10501) c4(36615, 49672, 62729, 23558, 75786) c5(bw, ag, kJ); #c1 (SLC35G1) c2(NP_001128130) c3(10502) c4(36616, 49673, 62730, 23559, 75787) c5(A, I, b, aY, p, h, B, J, cz, Me, P, dc, asI, bf, aA, pF, cM, aM); #c1(SLC35G2) c2(NP_001091069) c3(10503) c4(36617, 49674, 62731, 23560, 75788) c5(aX, dB); #c1(SLC35G5) c2(NP_473369) c3(10504) c4(36618, 49675, 62732, 23561, 75789) c5(I, or, dK); #c1(SLC35G6) c2(NP_001096084) c3(10505) c4(36619, 49676, 62733, 23562, 75790) c5(u); #c1 (SLC36A1) c2(NP_510968) c3(10506) c4(36620, 49677, 62734, 23563, 75791) c5(di, A, u, y, yM); #c1(SLC36A2) c2(NP_861441) c3(10507) c4(36621, 49678, 62735, 23564, 75792) c5(ig, dA, cFJ, cFK); #c1(SLC37A1) c2(NP_061837) c3(10508) c4(36622, 49679, 62736, 23565, 75793) c5(cFL, u); #c1(SLC37A2) c2(NP_001138762) c3(10509) c4(36623, 49680, 62737, 23566, 75794) c5(aA); #c1(SLC37A4) c2(NP_001157749) c3(10510) c4(36624, 49681, 62738, 23567, 75795) c5(g, gK, Fp, AU, fk, b, iw, ni, ch, w, byv, aE, dt, BM, cEE, bf, aeI, hN, O, aM); #c1 (SLC38A1) c2(NP_001265316) c3(10511) c4(36625, 49682, 62739, 23568, 75796) c5(dM, aw, iU, cO, bf, bIL, e, O, cy, t, pq, blz, aC, fO, dB, Ce, x, fx, jT, cq, oi, i, azz, fE, hS, iG, cA, U, Oh, cM, co, ak, bu, awd, cs, av, fy, is, V, dP, B, ji, qh, apU, b, tN, au, Og, ciD, jD, d, jh, Iz, bX, hV, q, ar, bcs, u, I, dT, ad, as, G, wq, aPe, ct, nV, bkq, ih, MR, I, di, A, jc, hI, C, iL, m, jI, h, y, W, bR, P, Oi, nP, by, aM, QN, hq, amS, fP, E, Ez, eG); #c1(SLC38A2) c2(NP_061849) c3(10512) c4(36626, 49683, 62740, 23569, 75797) c5(A, aX, b, LQ, f, q, bu, W, hS, fI, T, DP, ar, u, y); #c1(SLC38A4) c2(NP_001137296) c3(10513) c4(36627, 49684, 62741, 23570, 75798) c5(bf, ey, A, g, bq); #c1(SLC38A5) c2(NP_277053) c3(10514) c4(36628, 49685, 62742, 23571, 75799) c5(nU); #c1(SLC38A6) c2(NP_001166173) c3(10515) c4(36629, 49686, 62743, 23572, 75800) c5(azz, A, b, U, e, y, d, co, jI, Os, B, F, q, jV, bu, awd, cs, u, V, dA, bp, ad, W, cV, fx, by, at, dP, bkq, blz, hq, ag, amS, i, apU); #c1(SLC38A7) c2(NP_060701) c3(10516) c4(36630, 49687, 62744, 23573, 75801) c5(d, qs, hW, cFJ, aXh, sI, tW, f, e, cEQ, akB, oi, afb, cFK, cA, aA, fy, u, bev, y, cq);

c1(SLC38A8) c2(NP_001073911) c3(10517) c4(36631, 49688, 62745, 23574, 75802) c5(cot, cFN, KU, cFM); #c1(SLC38A9) c2(NP_001245215) c3(10518) c4(36632, 49689, 62746, 23575, 75803) c5(bm, cV); #c1(SLC39A10) c2(NP_001120729) c3(10519) c4(36633, 49690, 62747, 23576, 75804) c5(yJ, A, cV, Eo, yM, u, y); #c1(SLC39A11) c2(NP_001153242) c3(10520) c4(36634, 49691, 62748, 23577, 75805) c5(oy, ao); #c1(SLC39A12) c2(NP_001138667) c3(10521) c4(36635, 49692, 62749, 23578, 75806) c5(oy, di, A, aX, fP); #c1(SLC39A13) c2(NP_001121697) c3(10522) c4(36636, 49693, 62750, 23579, 75807) c5(zM, vc, A, Ex, cFO); #c1(SLC39A14) c2(NP_001121903) c3(10523) c4(36637, 49694, 62751, 23580, 75808) c5(aJe, V, b, cf, W, Lc, fP, JF, aci, U); #c1(SLC39A1) c2(NP_001258888) c3(10524) c4(36638, 49695, 62752, 23581, 75809) c5(dx, dv, an, du, A, B, JF, as, bk); #c1(SLC39A2) c2(NP_055394) c3(10525) c4(36639, 49696, 62753, 23582, 75810) c5(cy, vY, i, eO, I, fx, u); #c1(SLC39A3) c2(NP_653165) c3(10526) c4(36640, 49697, 62754, 23583, 75811) c5(b, ak, he, ag, fv, ar); #c1(SLC39A4) c2(NP_060237) c3(10527) c4(36641, 49698, 62755, 23584, 75812) c5(IJ, b, B, q, dt, ag, zN, JF, bw, xt, cFv); #c1(SLC39A6) c2(NP_001092876) c3(10528) c4(36642, 49699, 62756, 23585, 75813) c5(jh, jE, A, aw, b, qL, bm, B, q, ag, aoe, T, bk, u, y); #c1(SLC39A7) c2(NP_001070984) c3(10529) c4(36643, 49700, 62757, 23586, 75814) c5(m, bb, ap, bq, at, u, y, fh); #c1(SLC39A8) c2(NP_001128618) c3(10530) c4(36644, 49701, 62758, 23587, 75815) c5(oy, bP, A, V, dA, du, P, dv, di, fl, dx, U, at); #c1(SLC39A9) c2(NP_001239079) c3(10531) c4(36645, 49702, 62759, 23588, 75816) c5(A, u, B, y); #c1(SLC3A1) c2(NP_000332) c3(10532) c4(36646, 49703, 62760, 23589, 75817) c5(azI, qs, cFP, sK, dS, tR, ih, BM, di, fI, fD, cFQ, wX, azJ, bev, at); #c1(SLC3A2) c2(NP_001012680) c3(10533) c4(36647, 49704, 62761, 23590, 75818) c5(dx, by, en, aw, Zq, bx, aHH, iX, dB, sJ, vQ, cO, Ou, ps, oU, xI, amG, yg, dv, cy, aXh, t, chH, aKH, CK, kz, mR, cl, fH, gI, apz, g, og, aC, du, gm, fO, aoS, cia, od, hR, cq, bgc, wh, fc, bjF, ie, anb, Ot, cT, Ee, pH, fD, bq, pJ, bP, jS, fI, gE, zr, cG, X, rq, akL, dE, ig, NH, Ku, IW, U, y, V, pw, px, aoR, Wn, f, bjn, bu, B, iv, oD, av, fi, yV, Ov, nI, cd, Jp, MW, afz, AF, bt, jG, cK, fJ, atE, if, dP, chB, To, P, gR, bri, iu, TA, bAH, fn, WH, OG, uy, cCn, b, qz, boE, jy, jD, hh, nU, bgR, boG, AK, QE, apJ, ff, oO, CI, yW, u, dh, da, Id, Pu, chQ, jE, I, im, Dg, BT, j, xs, as, vS, Lc, pD, Io, ct, et, Wz, jU, yG, jH, ao, PL, hU, chS, hX, Y, ZI, aE, yy, ur, zD, bL, amo, aov, fd, asi, pR, Ik, mW, Rd, aZF, di, Vy, cFT, cFS, PI, aI, m, cr, iI, fq, h, F, M, aYv, cFR, ik, oJ, aV, bev, aAq, aqi, apx, an, hZ, Oq, be, J, asM, jo, T, jI, gF, Pk, fM, sK, jT, eh, pp, NG, Ic, G, aWz, At, aEb, akm, sf, fP, cZ, rI, iB, aT, bgx); #c1 (SLC40A1) c2(NP_055400) c3(10534) c4(36648, 49705, 62762, 23591, 75819) c5(aw, att, bHR, aVf, z, yK, aci, aiT, fH, u, bev, bm, si, aVi, yO, cz, dt, fJ, pq, eG, Ck, bk, yM, fN, bxQ, bh, aVh); #c1(SLC41A1) c2(XP_005245126) c3(10535) c4(36649, 49706, 62763, 23592, 75820) c5(byj, bj, Ff, vU); #c1(SLC43A1) c2(NP_001185739) c3(10536) c4(36650, 49707, 62764, 23593, 75821) c5(wV, afE, pR, B, wP, A, jT); #c1(SLC43A2) c2(NP_001271428) c3(10537) c4(36651, 49708, 62765, 23594, 75822) c5(b, sI, pR, akB, oi, cA, e, y, d, qs, aXh, f, F, fy, u, bev, hW, afb, cFK, cq, cFJ, tW, cEQ, aA); #c1(SLC43A3) c2(NP_001265135) c3(10538) c4(36652, 49709, 62766, 23595, 75823) c5(fI); #c1(SLC44A1) c2(NP_001273659) c3(10539) c4(36653, 49710, 62767, 23596, 75824) c5(O, fU, v, co, cV); #c1 (SLC44A2) c2(NP_001138528) c3(10540) c4(36654, 49711, 62768, 23597, 75825) c5(aFH); #c1(SLC44A4) c2(NP_001171515) c3(10541) c4(36655, 49712, 62769, 23598, 75826) c5(m, ho, aV, aE, qB); #c1(SLC44A5) c2(XP_011539285) c3(10542) c4(36656, 49713, 62770, 23599, 75827) c5(ap, o, dA); #c1(SLC45A2) c2(NP_001012527) c3(10543) c4(36657, 49714, 62771, 23600, 75828) c5(cFV, aw, b, ain, cY, aie, A, ic, auc, U, e, y, d, it, co, aX, B, hN, IV, u, V, aeM, J, byJ, cy, iw, cFU, DO, tI); #c1(SLC45A3) c2(NP_149093) c3(10544) c4(36658, 49715, 62772, 23601, 75829) c5(A, cy, b, B, T, bj); #c1(SLC45A4) c2(NP_001073900) c3(10545) c4(36659, 49716, 62773, 23602, 75830) c5(ak, hW); #c1(SLC46A1) c2(NP_001229295) c3(10546) c4(36660, 49717, 62774, 23603, 75831) c5(fy, b, ni, iP, yO, bwq, eu, pr, xf, bk, yM, nA, J, pq, gO); #c1(SLC46A2) c2(NP_149040) c3(10547) c4(36661, 49718, 62775, 23604, 75832) c5(re, iT); #c1(SLC47A1) c2(NP_060712) c3(10548) c4(36662, 49719, 62776, 23605, 75833) c5(bf, et, I, SS, aM); #c1(SLC48A1) c2(NP_060312) c3(10549) c4(36663, 49720, 62777, 23606, 75834) c5(u, y, b); #c1(SLC4A10) c2(NP_001171486) c3(10550) c4(36664, 49721, 62778, 23607, 75835) c5(gE, aY, nU, qr, hS, acI, dc, aOe, acq, cM); #c1(SLC4A11) c2(NP_001167560) c3(10551) c4(36665, 49722, 62779, 23608, 75836) c5(aOB, cFX, cFY, cFW, cFZ, Ij, na, bmI, alO, cGa, LK, ba, u, y, alP); #c1(SLC4A1AP) c2(NP_060628) c3(10552) c4(36666, 49723, 62780, 23609, 75837) c5(o); #c1(SLC4A1) c2(NP_000333) c3(10553) c4(36667, 49724, 62781, 23610, 75838) c5(cGe, bP, b, si, bqG, eW, yD, vR, di, cGf, aIp, oy, ps, oB, cGi, bu, cGd, ar, TW, qK, pP, cGc, cfU, fD, ae, cGb, akd, gJ, FC, gL, Oj, by, pq, CY, TY, zI, vU, Ck, ab, cGg, fK, aU, VX, cGh); #c1(SLC4A2) c2(NP_001186622) c3(10554) c4(36668, 49725, 62782, 23611, 75839) c5(gG, aaI, by, vR, cs, ad, i, z, I, bu, bT); #c1(SLC4A3) c2(NP_005061) c3(10555) c4(36669, 49726, 62783, 23612, 75840) c5(hS, aQD, hR, nQ); #c1(SLC4A4) c2(NP_001091954) c3(10556) c4(36670, 49727, 62784, 23613, 75841) c5(akd, er, cGj, DR, nU, dB, cGk, yz, zl, di, bk, ml); #c1(SLC4A5) c2(NP_067019) c3(10557) c4(36671, 49728, 62785, 23614, 75842) c5(oy, aA, di); #c1(SLC4A7) c2(NP_001245308) c3(10558) c4(36672, 49729, 62786, 23615, 75843) c5(PL, b, Ga, bk, dn, PT, IV, fy, u, y); #c1(SLC4A9) c2(NP_001245355) c3(10559) c4(36673, 49730, 62787, 23616, 75844) c5(fU, fy, pp); #c1(SLC50A1) c2(NP_001116309) c3(10560) c4(36674, 49731, 62788, 23617, 75845) c5(cr, cGI, T, Ny, fl, aw); #c1(SLC5IA) c2(NP_689885) c3(10561) c4(36675, 49732, 62789, 23618, 75846) c5(gB, bT); #c1(SLC51B) c2(NP_849190) c3(10562) c4(36676, 49733, 62790, 23619, 75847) c5(az, gB, aA, au, bT); #c1(SLC52A1) c2(NP_060456) c3(10563) c4(36677, 49734, 62791, 23620, 75848) c5(KC, A, AI, b, X, IW, ic, cO, bf, Co, e, y, d, cy, fm, ag, re, B, yp, Mr, ky, O, gg, ar, av, aV, u, dh, da, be, czh, aC, LR, bp, ad, IX, P, T, eq, bq, zR, aM, jH, aaj, he, gd, fP, bk, dn, I, aZU, eG, rr); #c1(SLC52A2) c2(NP_001240745) c3(10564) c4(36678, 49735, 62792, 23621, 75849) c5(by, A, aw, aZ, b, cY, aF, gG, cGn, dB, vB, bqc, MS, w, ajc, Fm, bw, aI, y, m, co, aX, adJ, sS, ag, h, B, F, q, bu, cU, ff, cs, av, u, o, cl, auU, dn, wp, ckJ, aC, LR, J, bp, ad, jo, T, II, bt, x, cy, iA, Pk, gg, nb, Y, bdB, add, gd, oi, cGm, rv, I, at); #c1(SLC52A3) c2(XP_011527450) c3(10565) c4(36679, 49736, 62793, 23622, 75850) c5(d, cW, cGo, il, jh, py, cGp, ao, biv, ik, cGm, OA, hP, e); #c1(SLC5A11) c2(NP_001245340) c3(10566) c4(36680, 49737, 62794, 23623, 75851) c5(bf, lJ, kF, m); #c1(SLC5A12) c2(NP_848593) c3(10567) c4(36681, 49738, 62795, 23624, 75852) c5(cy, bb); #c1(SLC5A1) c2(NP_000334) c3(10568) c4(36682, 49739, 62796, 23625, 75853) c5(at, cFs, I, b, mt, f, aE, W, vR, ar, iT, arK, p, hR, cgx, IT, lG); #c1(SLC5A2) c2(NP_003032) c3(10569) c4(36683, 49740, 62797, 23626, 75854) c5(bJa, kZ, cFs, I, mt, f, di, cf, vw, bf, ey, gF, aM); #c1(SLC5A3) c2(NP_008864) c3(10570) c4(36684, 49741, 62798, 23627, 75855) c5(wh, f, kF, ak, dB, oJ, bq, bf, at); #c1(SLC5A4) c2(NP_055042) c3(10571) c4(36685, 49742, 62799, 23628, 75856) c5(bJa, cf, cFs, b, I, mt, kZ, vw, bf, ey, gF); #c1(SLC5A5) c2(NP_000444) c3(10572) c4(36686, 49743, 62800, 23629, 75857) c5(Dr, A, iq, b, X, Sc, vD, w, hM, O, bw, U, e, y, yV, d, co, aX, xO, hV, g, oc, bu, og, ra, FN, dQ, B, cs, cGq, av, fy, u, o, ff, if, fe, nV, V, VD, cV, gG, nI, jE, fO, ad, W, qp, T, lI, Bd, bq, Fr, nP, by, fp, ct, wV, baa, iP, aeq, wP, Y, ck, bm, jR, ag, zU, hI, od, iu, Dg); #c1(SLC5A6) c2(XP_006712193) c3(10573) c4(36687, 49744, 62801, 23630, 75858) c5(A, u, B, y); #c1(SLC5A7) c2(NP_001291934) c3(10574) c4(36688, 49745, 62802, 23631, 75859) c5(dj, cGr, f, aiY, agw, gZ); #c1(SLC5A8) c2(NP_666018) c3(10575) c4(36689, 49746, 62803, 23632, 75860) c5(Dr, A, b, k, O, bw, U, e, y, d, co, h, hV, bu, FN, fv, B, cs, u, og, V, ob, Fs, J, bp, ad, W, T, x, by, jH, ag); #c1(SLC6A11) c2(NP_055044) c3(10576) c4(36690, 49747, 62804, 23633, 75861) c5(de, bhG, ma, aX, aC, hS, vR); #c1(SLC6A12) c2(XP_005253803) c3(10577) c4(36691, 49748, 62805, 23634, 75862) c5(vR, cy, k, f, hS, gE, aA, o); #c1(SLC6A13) c2(NP_001177926) c3(10578) c4(36692, 49749, 62806, 23635, 75863) c5(hS, vR, hW, fD); #c1(SLC6A14) c2(NP_009162) c3(10579) c4(36693, 49750, 62807, 23636, 75864) c5(cGs, jH, sI, re, aZz, Mg, cFm, fP, aZ, aA, u, y, cg); #c1(SLC6A15) c2(NP_060527) c3(10580) c4(36694, 49751, 62808, 23637, 75865) c5(hW, aY, f, dc, cA, aA, cM); #c1(SLC6A18) c2(NP_872438) c3(10581) c4(36695, 49752, 62809, 23638, 75866) c5(di, i, cFJ, cFK); #c1(SLC6A19) c2(NP_001003841) c3(10582) c4(36696, 49753, 62810, 23639, 75867) c5(sI, cO, di, cFJ, cFK); #c1(SLC6A1) c2(NP_003033) c3(10583) c4(36697, 49754, 62811, 23640, 75868) c5(ao, hS, aY, fw, ih, cGt, iZ, GF, Rg, fh); #c1(SLCGA20) c2(NP_064593) c3(10584) c4(36698, 49755, 62812, 23641, 75869) c5(aF, iP, fI, cFJ, cFK); #c1(SLC6A2) c2(NP_001165972) c3(10585) c4(36699, 49756, 62813, 23642, 75870) c5(f, EM, cO, wX, Jx, e, Os, AX, aFH, mR, zb, bIz, g, aBs, Ej, bp, aTY, fx, awj, cbQ, aei, ag, i, dc, aA, azz, cA, vI, cM, TC, co, yX, rr, ak, bu, awd, cs, bm, vR, V, qq, VP, JY, dP, aY, B, apU, fn, b, jJ, bg, IB, pI, d, q, jV, vu, ar, u, im, ad, qV, bdu, bkq, sW, ih, y, FY, QU, A, tR, di, U, oy, awi, jP, F, oE, wW, aqz, IV, dj, fU, hW, cV, W, T, jl, by, qp, hq, Jz, aiY, amS, bII, at); #c1(SLC6A4) c2(NP_001036) c3(10586) c4(36700, 49757, 62814, 23643, 75871) c5(ig, amC, bop, aw, Gt, Gm, Hv, oc, aqt, ns, nm, dd, nq, nr, nn, Gy, no, np, bq, vr, bjk, jv, hF, b, ahq, ahj, cGx, dI, gA, jm, aQd, cGC, kX, IV, oN, aUc, aeO, KH, yL, du, rV, xk, aFE, vc, aqx, aTY, abd, bhS, hR, xx, Ew, ro, akn, amD, fJ, amu, dc, nt, aA, aUr, abu, ux, id, Jy, bWm, aqu, cGy, eu, GI, mk, cGA, aqL, cA, si, U, Co, Jx, cM, TC, cGE, aCC, aUg, rr, f, xb, Go, cbH, ky, aaF, hj, cGu, bMF, tQ, vi, JB, Gr, V, bhZ, lM, bj, nu, v, gv, IR, fq, Js, eX, aGU, acb, hH, zf, bhR, aUu, Ib, xd, cGv, acd, sK, aY, HZ, cbi, qc, Ai, abw, Gn, wX, RB, aFl, vf, clZ, uS, GL, amH, ak, cGw, jJ, ZE, Ey, qa, jP, tG, bb, gZ, abq, aaf, bMD, Ag, wZ, Ba, vd, Iz, aqB, Qi, nU, dW, ap, NJ, vu, aUb, qu, Gj, aM, u, aVS, zb, z, GF, VD, hv, gL, cz, da, IX, aaB, xq, rB, fH, JJ, jH, rQ, hS, acw, tW, hT, he, ih, na, bMw, IS, o, HV, I, ahm, cbl, bMH, FY, bL, oC, bf, azm, tZ, gU, IW, aFz, tR, EE, aqV, bcx, vg, gE, buI, sx, vI, aqQ, m, cGz, cr, I, cuB, cO, bxf, wr, aqs, hB, aqE, bMG, oE, iZ, y, aqz, aqy, aq, dx, CH, IG, dj, bdj, hW, afx, mc, xJ, aPi, sC, cGD, P, Wj, Sw, j, bh, Fq, di, vv, Sp, to, at, Fp, cGB, aeq, tA, Jz, vW, sG, aiY, QI, fP, jN, PU, Rj, bWy, aG, eG, oT); #c1(SLC6A5) c2(XP_011518775) c3(10587) c4(36701, 49758, 62815, 23644, 75872) c5(g, awj, by, vR, awi, b, IB, IV, AX, f, q, bu, aWR, T, ar, cGF, u, y, JY); #c1(SLC6A6) c2(NP_001127839) c3(10588) c4(36702, 49759, 62816, 23645, 75873) c5(jB, vR, V, b, nW, gA, U, at, mI); #c1 (SLC6A7) c2(NP_055043) c3(10589) c4(36703, 49760, 62817, 23646, 75874) c5(Xt, vR, cy); #c1(SLC6A8) c2(NP_001136277) c3(10590) c4(36704, 49761, 62818, 23647, 75875) c5(by, nU, aw, k, dD, ako, FE, hS, A, cO, cF, y, re, f, bu, B, cg, u, bAa, bzt, KH, UK, nz, ad, dt, P, UT, cV, cjz, cz, KK, nw, na, Oi, iT, fl, bM, awt); #c1(SLC6A9) c2(XP_011540319) c3(10591) c4(36705, 49762, 62819, 23648, 75876) c5(Ew, Qi, he, xq, ky, di, Vn, aqu); #c1 (SLC7A10) c2(NP_062823) c3(10592) c4(36706, 49763, 62820, 23649, 75877) c5(Tw, fP, bnx, u, bev, y); #c1 (SLC7A11) c2(NP_055146) c3(10593) c4(36707, 49764, 62821, 23650, 75878) c5(IY, b, cGG, f, O, bw, at, u, y); #c1(SLC7A13) c2(NP_620172) c3(10594) c4(36708, 49765, 62822, 23651, 75879) c5(dM, at); #c1(SLC7A14) c2(NP_066000) c3(10595) c4(36709, 49766, 62823, 23652, 75880) c5(nE, nQ, cGH); #c1(SLC7A1) c2(XP_005266564) c3(10596) c4(36710, 49767, 62824, 23653, 75881) c5(iU, qs, A, dN, b, bj, B, cs, cc, ad, abf, di, iT, cO, U, cp, u, av, y, V); #c1(SLC7A2) c2(NP_001158243) c3(10597) c4(36711, 49768, 62825, 23654, 75882) c5(vR, dA, aXh, aF, q, iU, abf, aox, bf, aM); #c1(SLC7A3) c2(NP_001041629) c3(10598) c4(36712, 49769, 62826, 23655, 75883) c5(bVC); #c1(SLC7A4) c2(NP_004164) c3(10599) c4(36713, 49770, 62827, 23656, 75884) c5(bL, aw, b, WH, asi, mW, NU, gE, Ou, G, jD, m, cy, t, px, Em, cGI, gI, asM, yV, Ov, aC, nI, gm, fO, J, fq, P, pD, afb, jI, jT, aHp, cq, wU, if, bY, K, cT, CL, cGJ, aU, zD); #c1(SLC7A5) c2(NP_003477) c3(10600) c4(36714, 49771, 62828, 23657, 75885) c5(fl, b, k, pR, gG, dB, w, A, e, O, js, hh, aX, aGp, aXh, rI, B, F, q, Mr, yW, fy, iR, bev, d, bp, dt, fO, jU, qp, pp, u, fl, gj, ji, adf); #c1(SLC7A6) c2(NP_003974) c3(10601) c4(36715, 49772, 62829, 23658, 75886) c5(afE, eK, b, aXh, pR, B, A, cs, jT); #c1(SLC7A7) c2(XP_011535601) c3(10602) c4(36716, 49773, 62830, 23659, 75887) c5(afE, eK, I, aXh, pR, B, A, sc, aA, jT, bev, cGK); #c1(SLC7A8) c2(NP_001253965) c3(10603) c4(36717, 49774, 62831, 23660, 75888) c5(wh, bb, b, aXh, h, q, M, oJ, eG, pR); #c1(SLC7A9) c2(XP_011524704) c3(10604) c4(36718, 49775, 62832, 23661, 75889) c5(vR, aXh, si, ht, aE, aC, Bm, fD, bq, gO, bf, vI, cGL, et, bev, o, aM); #c1(SLC8A1) c2(NP_001106271) c3(10605) c4(36719, 49776, 62833, 23662, 75890) c5(aJm, dk, vR, di, cO, bf, qs, bb, f, q, bu, vE, bm, dh, fh, iF, ma, Bs, qq, by, HR, aM, ch, fw, at, ap); #c1(SLC8A2) c2(NP_055878) c3(10606) c4(36720, 49777, 62834, 23663, 75891) c5(dk, ma, O, fh); #c1(SLC8A3) c2(NP_001123889) c3(10607) c4(36721, 49778, 62835, 23664, 75892) c5(dk, ma, bk, fh); #c1(SLC9A1) c2(XP_011540323) c3(10608) c4(36722, 49779, 62836, 23665, 75893) c5(bP, dx, blZ, b, IW, w, hM, cO, ey, y, qs, dv, aX, h, q, O, jG, sK, u, dh, ajz, ma, I, Bs, yL, du, Fs, v, J, T, jU, HL, jH, ii, ch, aE, fP, iT, fD, rr, di, Mp, at, re); #c1(SLC9A2) c2(NP_003039) c3(10609) c4(36723, 49780, 62837, 23666, 75894) c5(W, blZ, di, rj); #c1(SLC9A3) c2(NP_004165) c3(10610) c4(36724, 49781, 62838, 23667, 75895) c5(bP, jH, Fp, vR, cFk, aZ, ch, sH, aZz, blh, afB, byv, W, cFm, di, bk, rj, p, aA, fD); #c1(SLC9A3R1) c2(NP_004243) c3(10611) c4(36725, 49782, 62839, 23668, 75896) c5(b, cGN, w, z, U, cGM, O, ed, fq, rr, f, q, y, bm, aE, da, V, P, T, jU, jE, u, os, fP, bk, OI); #c1(SLC9A3R2) c2(NP_001123484) c3(10612) c4(36726, 49783, 62840, 23669, 75897) c5(b, ahS, dB, di, iG, e, O, d, F, q, bu, kz, ar, y, cs, av, fy, bm, ad, W, P, ahO, T, x, by, OA, Tu, u, ag, aAp); #c1(SLC9A4) c2(NP_001011552) c3(10613) c4(36727, 49784, 62841, 23670, 75898) c5(ig); #c1(SLC9A5) c2(NP_004585) c3(10614) c4(36728, 49785, 62842, 23671, 75899) c5(bP, blZ, cvb, v, fD, cGO); #c1(SLC9A6) c2(NP_001036002) c3(10615) c4(36729, 49786, 62843, 23672, 75900) c5(cjN, fl, aw, WW, aE, Mj, ud, cGP, cGX, cO, bIg, Mn, auC, bjV, gd, nU, DC, agw, Us, cGW, cGR, Zz, qm, bK, nz, cxC, cz, CM, cGS, QZ, cGU, cGQ, aei, cGV, Y, nG, fw, cGT, aof, aFm, bk, fD, aA); #c1(SLC9A7) c2(NP_115980) c3(10616) c4(36730, 49787, 62844, 23673, 75901) c5(cGQ, nz, cGP, agw); #c1(SLC9A8) c2(NP_001247420) c3(10617) c4(36731, 49788, 62845, 23674, 75902) c5(blh); #c1(SLC9A9) c2(NP_775924) c3(10618) c4(36732, 49789, 62846, 23675, 75903) c5(oy, d, cz, cGY, ik, bf, at, e); #c1(SLC9B1) c2(NP_001094344) c3(10619) c4(36733, 49790, 62847, 23676, 75904) c5(sE, bf, f, Oz, ajf); #c1(SLC9B2) c2(NP_001287685) c3(10620) c4(36734, 49791, 62848, 23677, 75905) c5(qs, di); #c1 (SLC9C1) c2(NP_898884) c3(10621) c4(36735, 49792, 62849, 23678, 75906) c5(bP, da, qs, I, ml, f, vT, aE, di, fD, fP, et, dh); #c1(SLC9C2) c2(NP_848622) c3(10622) c4(36736, 49793, 62850, 23679, 75907) c5(da, A, aW); #c1(SLCO1A2) c2(NP_602307) c3(10623) c4(36737, 49794, 62851, 23680, 75908) c5(acE, A, I, b, jH, B, F, Iy, az, hS, au, T, byJ, di, u, aE, y); #c1(SLCO1B1) c2(NP_006437) c3(10624) c4(36738, 49795, 62852, 23681, 75909) c5(aw, b, dD, dB, eR, cGZ, eH, au, di, C, z, bf, qG, y, gM, it, t, vj, q, az, gX, hN, tE, cs, bv, oD, av, fy, u, ff, I, IP, aC, xf, ad, W, P, byJ, cK, qx, jE, bm, G, bg, aA, at, bT); #c1(SLCO1B3) c2(NP_062818) c3(10625) c4(36739, 49796, 62853, 23682, 75910) c5(bP, A, b, aE, cGZ, gB, ck, ic, z, U, hP, y, PP, it, bn, adr, B, q, fJ, hN, ar, cs, fH, av, fy, u, aBd, ma, si, V, bp, ad, Lv, x, aVd, jG, iw, bm, nJ, ag, bT); #c1(SLCO1B7) c2(NP_001009562) c3(10626) c4(36740, 49797, 62854, 23683, 75911) c5(az, au); #c1(SLCO1C1) c2(NP_001139417) c3(10627) c4(36741, 49798, 62855, 23684, 75912) c5(aY, aC, hM, dc, cM, cp); #c1(SLCO2A1) c2(NP_005621) c3(10628) c4(36742, 49799, 62856, 23685, 75913) c5(avO, it, vR, V, pz, F, W, T, cHa, U, aBU, gP); #c1(SLCO2B1) c2(NP_001138683) c3(10629) c4(36743, 49800, 62857, 23686, 75914) c5(it, A, bm, hV, F, jE, ag, nV, B, u, y); #c1(SLCO3A1) c2(NP_001138516) c3(10630) c4(36744, 49801, 62858, 23687, 75915) c5(b, t, ag, di, y, u, ac); #c1(SLCO4A1) c2(NP_057438) c3(10631) c4(36745, 49802, 62859, 23688, 75916) c5(ao, X, ag, vS, fv, av); #c1(SLCO4C1) c2(NP_851322) c3(10632) c4(36746, 49803, 62860, 23689, 75917) c5(di); #c1(SLCO5AI) c2(NP_001139480) c3(10633) c4(36747, 49804, 62861, 23690, 75918) c5(bm, jE, u, y, bq); #c1(SLCO6A1) c2(NP_001275931) c3(10634) c4(36748, 49805, 62862, 23691, 75919) c5(dx, by, B, pV, sE, iU, w, Gq, aw, e, O, cp, dv, cy, b, t, aZv, jU, Dc, fH, n, g, bm, asQ, aC, ft, du, is, ao, bp, gY, fx, hR, pq, pb, akn, Ic, ie, aeR, ag, cT, bk, i, dn, pt, aA, GD, fO, cG, X, ix, iG, bf, U, y, yt, co, js, f, cs, bu, k, awd, iv, av, fy, QD, iT, cj, vi, jB, azd, V, ae, IT, bq, aZD, JY, aNc, py, er, fw, aNw, tI, OL, ji, fD, ci, vL, ap, ck, kE, am, au, aZB, bFR, ya, d, jh, bb, Ox, re, hV, q, es, ar, ff, as, jG, aM, u, aE, o, da, fs, iI, j, ad, qO, G, Lt, jH, aWN, nV, iR, hT, Bg, ex, zZ, xX, I, aU, yA, A, pF, asx, fr, Lv, gE, bFP, NA, og, di, C, iL, eM, hP, qG, aW, m, qs, Wj, aX, I, fq, h, F, az, ik, rR, cB, qB, Jk, fU, hW, ez, cV, an, fJ, be, dB, J, W, P, ti, T, II, Ez, bFS, D, bek, qe, bFQ, jT, hq, fP, bh, at, eG, gf); #c1 (SLFN12) c2(NP_001275938) c3(10635) c4(36749, 49806, 62863, 23692, 75920) c5(Ir, b, ad, fG, Qr, cs, bba); #c1 (SLFN12L) c2(XP_011522471) c3(10636) c4(36750, 49807, 62864, 23693, 75921) c5(P, aX, aE); #c1(SLFN14) c2(NP_001123292) c3(10637) c4(36751, 49808, 62865, 23694, 75922) c5(aX); #c1(SLFN5) c2(NP_659412)

c3(10638) c4(36752, 49809, 62866, 23695, 75923) c5(aX); #c1(SLIT1) c2(NP_003052) c3(10639) c4(36753, 49810, 62867, 23696, 75924) c5(hT, nV, V, b, aC, eG, hV, nJ, bu, co, O, by, u, y); #c1(SLIT2) c2(NP_001276064) c3(10640) c4(36754, 49811, 62868, 23697, 75925) c5(A, aw, b, X, dB, hS, BY, ic, bw, U, adr, e, y, d, jR, MT, co, bb, yQ, kJ, re, B, q, bu, qL, Mr, iZ, ar, O, sV, av, jM, u, iT, g, fU, V, cV, Be, by, P, T, gg, Yw, nJ, ag, fP, MU); #c1(SLIT3) c2(NP_003053) c3(10641) c4(36755, 49812, 62869, 23698, 75926) c5(B, aw, b, X, dB, hS, BY, A, ic, bw, U, bj, e, y, cp, d, jR, MT, co, yQ, kJ, adr, re, hV, wN, bu, qL, Mr, iZ, ar, O, sV, av, jM, u, iT, g, V, dA, Be, by, P, cV, nV, Yw, nJ, ag, fP, aC, aA, eG); #c1(SLITRK1) c2(NP_001268432) c3(10642) c4(36756, 49813, 62870, 23699, 75927) c5(qu, rV, hW, zb, Ww); #c1(SLITRK2) c2(NP_115928) c3(10643) c4(36757, 49814, 62871, 23700, 75928) c5(ak); #c1(SLITRK3) c2(NP_055741) c3(10644) c4(36758, 49815, 62872, 23701, 75929) c5(oy, cO); #c1(SLITRK5) c2(NP_056382) c3(10645) c4(36759, 49816, 62873, 23702, 75930) c5(ih, qu); #c1(SLITRK6) c2(NP_115605) c3(10646) c4(36760, 49817, 62874, 23703, 75931) c5(Bu, cHb); #c1(SLK) c2(NP_001291672) c3(10647) c4(36761, 49818, 62875, 23704, 75932) c5(d, ma, b, B, zS, IV, u, e, y); #c1(SLMAP) c2(NP_001291349) c3(10648) c4(36762, 49819, 62876, 23705, 75933) c5(c, BC, iK); #c1(SLMO2) c2(NP_057129) c3(10649) c4(36763, 49820, 62877, 23706, 75934) c5(bw); #c1(SLN) c2(NP_003054) c3(10650) c4(36764, 49821, 62878, 23707, 75935) c5(aw, bwI, cO, mL, y, cr, b, vC, akJ, re, aui, cs, u, iT, ad, aX, akK, acw, DO, EX, aA, at); #c1(SLPI) c2(NP_003055) c3(10651) c4(36765, 49822, 62879, 23708, 75936) c5(bL, fr, e, b, if, X, rR, IW, DT, wy, z, Iw, ai, Co, U, y, Ne, d, ag, co, bb, Vx, TX, bw, ft, j, F, q, bu, cU, Cu, Cz, ar, cfI, cs, ba, jD, av, fy, u, bk, TV, cHc, bm, bo, bx, Cq, dB, Dp, gL, ad, IR, IX, P, od, CA, aZ, aj, x, rO, cfH, TW, yh, jH, jT, qp, aBz, TU, kJ, Io, fO, by, aof, IS, Cy, aC, fI, I, Im, aeI, bp, eG, bT, jU, aG); #c1(SLTM) c2(NP_001013865) c3(10652) c4(36766, 49823, 62880, 23709, 75937) c5(KS, B, aw, Io, dB, w, Mn, e, O, jR, kJ, cl, Qx, g, og, bp, ft, jT, av, sg, ag, bk, i, bP, X, iP, jz, eu, jf, iG, cA, bw, U, y, co, pp, f, bu, gX, cs, aup, fy, bm, V, Qz, afz, VP, jC, iA, iY, aum, ahq, nJ, Le, ji, kD, Dr, b, oi, fD, d, jh, hV, q, ar, ff, Xp, iR, aNN, aEf, aza, ad, iD, Vw, ct, aCq, rQ, u, py, SJ, he, Sk, QP, bIo, A, lO, SS, k, fr, pR, Iv, gE, fs, buk, jQ, aX, h, F, cU, n, PT, fU, bXf, Fs, W, jo, Ql, T, fO, cz, qp, js, QN, adu, by, XH, jN, eG); #c1(SLU7) c2(NP_006416) c3(10653) c4(36767, 49824, 62881, 23710, 75938) c5(bfs, b, X, Ik, ea, w, yn, cO, ex, A, y, co, aX, h, f, q, aW, iv, av, u, n, aO, nQ, nW, cs, ad, jC, cz, ao, sg, nJ, B, cT, bNO, aA); #c1(SLURP1) c2(NP_065160) c3(10654) c4(36768, 49825, 62882, 23711, 75939) c5(arM, b, cG, mk, Rs, bCB, baW, y, aX, cn, u, bhn, hZ, be, LG, dt, P, ll, ac, bvg, Y, Im); #c1(SLX4) c2(NP_115820) c3(10655) c4(36769, 49826, 62883, 23712, 75940) c5(oM, u, y, b, pt); #c1(SLX41P) c2(NP_001009608) c3(10656) c4(36770, 49827, 62884, 23713, 75941) c5(t, G); #c1(SMAD1) c2(NP_005891) c3(10657) c4(36771, 49828, 62885, 23714, 75942) c5(gK, A, am, X, EM, IW, bw, e, y, d, jT, ip, h, B, q, bu, M, fr, cc, av, u, aE, iT, bm, V, yO, aB, bd, bp, ft, Ca, ny, by, jG, hU, BX, ch, ag, Im, at, re); #c1(SMAD2) c2(XP_006722514) c3(10658) c4(36772, 49829, 62886, 23715, 75943) c5(gK, B, dB, w, bV, bf, e, O, M, Hq, cy, kJ, aHC, bh, zb, Hs, hP, bp, ft, Ce, jT, gg, wh, aai, ag, i, aA, bT, X, EE, iG, IW, bw, U, y, co, f, bu, cs, Ch, av, fy, iT, aKq, V, IR, pr, dv, sw, JY, bkU, afE, b, MS, ic, ba, d, jh, re, q, ar, VM, xd, u, dh, da, LR, j, by, lX, mA, lS, l, yA, brL, bL, A, kY, fr, xa, gE, sx, cr, fq, h, F, cU, oJ, Jk, cV, T, fU, Nl, ad, AP, aM, ED, Nq, fP, Oi); #c1(SMAD3) c2(NP_001138574) c3(10659)

c4(36773, 49830, 62887, 23716, 75944) c5(dx, B, aw, w, bV, bW, e, O, dv, cy, DE, kJ, bnh, bRW, Hs, g, aC, Gd, du, lj, bp, cHd, od, gg, AL, wh, BX, ag, bk, mD, aA, bT, X, jz, eu, lW, bw, U, y, co, ip, yE, f, cs, vQ, bu, aeE, iv, av, fy, bm, V, lR, lh, AF, ny, Qt, xd, Rz, cf, in, lP, sw, b, z, d, jh, bb, lz, q, jF, ff, u, aE, o, zb, I, gL, ad, lX, Ca, lo, ct, et, jH, lS, fl, l, yA, af, bL, A, jR, iL, gE, al, sx, jQ, aX, fq, h, F, oJ, cB, J, P, T, j, bh, by, AP, Jh, lc, Nq, fP, Oi, at); #c1(SMAD4) c2(NP_005350) c3(10660) c4(36774, 49831, 62888, 23717, 75945) c5(bck, gK, f, aw, Yq, gG, dB, auJ, ku, e, O, kJ, cHe, zb, Hs, fe, Xc, yO, bp, Ce, aiL, x, fx, YY, gg, pq, MS, wh, OR, YA, os, ag, i, pt, Dr, Jy, sm, X, bNB, eu, wy, lW, lw, O, y, tp, co, Ml, hg, Ll, bu, gX, B, cs, oD, av, fy, bm, iT, d, YV, V, afz, cGS, mD, JY, ahT, py, QG, nJ, oM, CA, pv, ck, b, Nl, Qy, Ty, BQ, Mr, hh, jh, aHC, jd, re, hV, q, ar, ff, fv, xd, u, aE, cl, kF, il, qL, UG, j, ad, rw, ct, jU, jH, wV, nV, kM, jc, Bg, Cr, wP, kC, zO, Ol, fl, Lr, yA, brL, bL, A, iL, BY, og, hA, bw, cHf, hP, Ct, aX, I, h, F, cU, Cz, ik, oJ, cB, cV, Be, J, W, jo, T, Oi, by, AP, Hy, YX, Jh, Nq, YJ, Yv, bll, bh); #c1(SMAD5) c2(NP_001001420) c3(10661) c4(36775, 49832, 62889, 23718, 75946) c5(hh, jH, aKg, V, b, h, yO, q, gL, J, fP, Ca, cB, IW, gC, U, bp, aE, jU, n); #c1(SMAD6) c2(NP_005576) c3(10662) c4(36776, 49833, 62890, 23719, 75947) c5(d, co, V, I, X, adh, f, e, T, O, lW, I, vp, av, fy, U, su, adg); #c1(SMAD7) c2(NP_001177751) c3(10663) c4(36777, 49834, 62891, 23720, 75948) c5(by, A, aw, ny, b, X, cs, jz, eu, Hr, O, bw, HJ, vp, U, bu, yE, y, jQ, d, tp, byO, co, aX, pp, aiT, wd, re, f, e, q, gT, cU, aHC, pC, B, gg, n, av, u, aE, zb, jB, kF, V, I, oJ, bc, aB, hv, j, J, wV, blF, cEo, ff, bt, Qt, x, cy, iA, ad, et, aA, jU, wh, nV, BX, wP, jw, acw, Jh, kJ, Nq, ip, ag, cT, fP, T, cHg, at, wy, dB); #c1(SMAD9) c2(NP_001120689) c3(10664) c4(36778, 49835, 62892, 23721, 75949) c5(W, A, b, B, ad, lR, IX, cHh, lS, IW, Cp, Co); #c1(SMAGP) c2(NP_001029045) c3(10665) c4(36779, 49836, 62893, 23722, 75950) c5(U, fv, V, b); #c1(SMAP1) c2(NP_001037770) c3(10666) c4(36780, 49837, 62894, 23723, 75951) c5(V); #c1(SMARCA1) c2(NP_001269803) c3(10667) c4(36781, 49838, 62895, 23724, 75952) c5(OG, A, b, k, X, pR, w, iL, Lq, U, e, O, jx, d, co, aX, agv, jd, t, B, q, ff, cB, cs, fy, cI, cHi, V, nz, J, bp, ad, jo, ll, SJ, G, ag, fl, hd); #c1(SMARCA2) c2(NP_001276326) c3(10668) c4(36782, 49839, 62896, 23725, 75953) c5(OG, A, b, PC, w, Lq, Eh, bRB, e, O, jx, d, alS, aX, agv, k, F, q, ar, fv, u, cHj, Fg, qw, nz, Fs, J, bp, T, bq, bb, aA, rQ, Eo, ag, tl, ji, yA, rb); #c1(SMARCA4) c2(NP_001122316) c3(10669) c4(36783, 49840, 62897, 23726, 75954) c5(dx, jl, OG, A, b, PC, X, Lq, jz, eR, qY, O, w, jR, IW, Eh, asQ, U, e, y, jQ, d, alS, co, aX, cHm, fv, t, f, q, OS, bu, ar, B, gw, cs, oD, sK, u, cl, fU, vO, cB, nz, du, Fs, J, bp, by, W, G, dv, T, pD, pt, bb, k, cHl, cHk, jT, fy, ji, ch, Bg, ag, agv, tl, bg, oM, yA, at, MS, ap); #c1(SMARCA5) c2(NP_003592) c3(10670) c4(36784, 49841, 62898, 23727, 75955) c5(h, fl, jt, J, jR, es, iL, iv, aU, OJ, u, y); #c1(SMARCAD1) c2(NP_001121901) c3(10671) c4(36785, 49842, 62899, 23728, 75956) c5(hW, b, I, fr, ft, Mn, iK); #c1(SMARCAL1) c2(XP_005246688) c3(10672) c4(36786, 49843, 62900, 23729, 75957) c5(fD, PC, f, mg, C, PD, aGJ, PE, et, hc); #c1(SMARCB1) c2(NP_001007469) c3(10673) c4(36787, 49844, 62901, 23730, 75958) c5(ayo, OG, cHp, b, jR, cY, QB, cHt, gw, jt, aNH, HG, lp, kB, w, cHs, bw, cHg, aw, Q, byl, O, d, ec, QV, co, aX, cHm, jd, t, AX, f, e, es, HH, EM, ar, oJ, cB, Nk, Tk, cl, jG, u, Sl, aiR, ff, g, fi, fe, fs, V, ae, cV, byk, kt, qY, Fs, wh, gL, lx, anD, P, Ql, T, iD, Vw, bny, Zh, cHr, cHo, Ut, Ll, aDJ, cHn, aiJ, SJ, G, dY, OJ, agv, OM, h); #c1(SMARCC1) c2(NP_003065) c3(10674) c4(36788, 49845, 62902, 23731, 75959) c5(f, aw, V, Dt, bp, ag, A, ar, U, u, y); #c1(SMARCC2)

c2(NP_001123892) c3(10675) c4(36789, 49846, 62903, 23732, 75960) c5(Fo, f, b); #c1(SMARCD1) c2(NP_003067) c3(10676) c4(36790, 49847, 62904, 23733, 75961) c5(cHu, b); #c1(SMARCD3) c2(NP_001003801) c3(10677) c4(36791, 49848, 62905, 23734, 75962) c5(aAF, kY); #c1(SMARCE1) c2(NP_003070) c3(10678) c4(36792, 49849, 62906, 23735, 75963) c5(cHi, A, agv, cfx, B, aiL, rb, u, y); #c1(SMC1A) c2(NP_001268392) c3(10679) c4(36793, 49850, 62907, 23736, 75964) c5(aDJ, bWR, M, V, m, nW, nU, i, aNS, bep, rb, kY, u, y, cq); #c1(SMC1B) c2(NP_001278430) c3(10680) c4(36794, 49851, 62908, 23737, 75965) c5(NT, BX, ip, i, wn, ny); #c1(SMC2) c2(XP_011516451) c3(10681) c4(36795, 49852, 62909, 23738, 75966) c5(Ew, dA, J, he, eu, Qt, cjQ, jT, ac); #c1(SMC3) c2(NP_005436) c3(10682) c4(36796, 49853, 62910, 23739, 75967) c5(M, wp, b, bep, nW, nU, cHv, aNS, T, qX, cs, ar, Yp, afL); #c1(SMC4) c2(NP_005487) c3(10683) c4(36797, 49854, 62911, 23740, 75968) c5(A, b, B, fl, O, cjQ, jT, u, y); #c1(SMC5) c2(NP_055925) c3(10684) c4(36798, 49855, 62912, 23741, 75969) c5(A, dA); #c1(SMC6) c2(NP_001135758) c3(10685) c4(36799, 49856, 62913, 23742, 75970) c5(u, y); #c1(SMCHD1) c2(NP_056110) c3(10686) c4(36800, 49857, 62914, 23743, 75971) c5(fl, b, pp, dA, hX, rO, cHw, jT); #c1(SMC1A) c2(NP_064564) c3(10687) c4(36801, 49858, 62915, 23744, 75972) c5(c0); #c1(SMCP) c2(NP_109588) c3(10688) c4(36802, 49859, 62916, 23745, 75973) c5(aX, dA, X, t, BK, G, y, cs, cK, av, arE, mO); #c1(SMEK1) c2(NP_001271209) c3(10689) c4(36803, 49860, 62917, 23746, 75974) c5(c0); #c1(SMEK2) c2(NP_001116436) c3(10690) c4(36804, 49861, 62918, 23747, 75975) c5(oy, dD, oG); #c1(SMG1) c2(NP_055907) c3(10691) c4(36805, 49862, 62919, 23748, 75976) c5(hV, b, dB, bg, sl, y, dN, aof, h, f, F, q, ra, u, LR, VD, cV, aC, be, J, fO, P, T, DR, ag); #c1(SMG6) c2(NP_001269255) c3(10692) c4(36806, 49863, 62920, 23749, 75977) c5(at, ap); #c1(SMG8) c2(NP_060619) c3(10693) c4(36807, 49864, 62921, 23750, 75978) c5(g, fT); #c1(SMIM15) c2(NP_001041714) c3(10694) c4(36808, 49865, 62922, 23751, 75979) c5(oy); #c1(SMIM19) c2(NP_001129148) c3(10695) c4(36809, 49866, 62923, 23752, 75980) c5(oy, gf); #c1(SMIM20) c2(NP_001138904) c3(10696) c4(36810, 49867, 62924, 23753, 75981) c5(aC, aE); #c1(SMIM21) c2(NP_001032408) c3(10697) c4(36811, 49868, 62925, 23754, 75982) c5(oy, bb, dA, ak, et, cp); #c1(SMIM23) c2(NP_001276899) c3(10698) c4(36812, 49869, 62926, 23755, 75983) c5(td); #c1(SMIM5) c2(XP_011523418) c3(10699) c4(36813, 49870, 62927, 23756, 75984) c5(pR); #c1(SMN2) c2(NP_059107) c3(10700) c4(36814, 49871, 62928, 23757, 75985) c5(aw, aTt, dB, aoJ, O, cy, t, ayd, asA, cc, lO, nl, rQ, OA, ape, hQ, cHz, sS, aei, Fv, beO, cG, asf, y, RD, f, bu, xl, oD, gg, fy, OF, v, VP, boV, aEr, beQ, bsh, b, Hr, AA, jh, oB, hV, q, afl, es, kz, as, u, ahe, LR, j, by, nd, G, aYw, ao, PL, acw, HJ, Sf, ahV, bdE, axQ, Nm, m, cr, h, HY, Vr, afl, bjc, Ps, cV, an, cHx, dt, T, Nl, apR, Y, apA, At, iB, afw, cHy); #c1(SMOC1) c2(NP_001030024) c3(10701) c4(36815, 49872, 62929, 23758, 75986) c5(dA, akO, kJ, aiW, Nq, j, uH, Ak, ll, cV, bw, cHA, jG, aE); #c1(SMOC2) c2(NP_001159884) c3(10702) c4(36816, 49873, 62930, 23759, 75987) c5(pV, yY, qB, iq, gE, cy, bg); #c1(SMO) c2(NP_005622) c3(10703) c4(36817, 49874, 62931, 23760, 75988) c5(by, B, auO, b, bx, fr, iP, pD, kB, A, ic, iG, xg, bw, U, ey, y, d, jR, ip, bn, f, e, jV, bu, ar, cl, hb, cs, fM, u, g, tl, aeM, aSw, bp, cz, T, ny, ft, YU, jH, BX, py, QG, Dj, jd, oi, i); #c1(SMOX) c2(NP_787033) c3(10704) c4(36818, 49875, 62932, 23761, 75989) c5(A, Kt, b, bx, fr, aE, iP, pD, oi, iG, wX, U, e, y, d, bb, jd, f, bu, ar, B, hb, cs, fM, u, cl, SA, Us, cM, ft, P, bp, bt, by, YU, jH, py, QG, jR, gd, bk, tl, Oi); #c1(SMPD1) c2(NP_000534) c3(10705) c4(36819, 49876, 62933, 23762, 75990) c5(bm, b, mk, akR, z, wf, bj, cM, dC, ed, cln, aX, eZ, Qm, ajx, fq, h, f, aQb, cHB, cs, u, le, hW, bK, LG, tz, ad, dt, fK, cy, pi, jE, Rz, aY, ch, vT, bk, i, dc, I, aA, at, wz); #c1(SMPD2) c2(NP_003071) c3(10706) c4(36820, 49877, 62934, 23763, 75991) c5(eZ, b, fq, f, J, ad, O, cs, u, y); #c1(SMPD3) c2(NP_061137) c3(10707) c4(36821, 49878, 62935, 23764, 75992) c5(bBN, avX, b, h, ie, J, n, u, y); #c1(SMPDL3A) c2(NP_001273067) c3(10708) c4(36822, 49879, 62936, 23765, 75993) c5(eG, i); #c1(SMPDL3B) c2(XP_011539561) c3(10709) c4(36823, 49880, 62937, 23766, 75994) c5(te); #c1(SMPX) c2(NP_055147) c3(10710) c4(36824, 49881, 62938, 23767, 75995) c5(cHC, f); #c1(SMR3B) c2(NP_006676) c3(10711) c4(36825, 49882, 62939, 23768, 75996) c5(aw, b, cY, iL, U, y, jh, co, aX, h, q, bu, ar, cs, jG, u, V, cV, J, fO, by, dU, T, ad); #c1(SMS) c2(NP_001245352) c3(10712) c4(36826, 49883, 62940, 23769, 75997) c5(KC, nU, hS, ak, cM, cp, jR, S, bll, KA, f, Me, dj, Yv, cV, nz, aX, mF, cHD, xM, he, ih, rv, OU); #c1(SMTN) c2(NP_008863) c3(10713) c4(36827, 49884, 62941, 23770, 75998) c5(Ee, f, bw); #c1(SMTNL1) c2(NP_001099035) c3(10714) c4(36828, 49885, 62942, 23771, 75999) c5(b); #c1(SMOU1) c2(NP_060695) c3(10715) c4(36829, 49886, 62943, 23772, 76000) c5(bw); #c1(SMUG1) c2(XP_006719385) c3(10716) c4(36830, 49887, 62944, 23773, 76001) c5(fr, gk, aw, bS, b, X, iX, zK, hS, sJ, ahd, OV, cA, U, xw, e, y, d, jh, anG, co, ajF, ra, ahc, re, hV, q, bu, tF, Mr, ar, U, cs, kD, av, aV, u, o, og, V, I, an, zj, ad, lR, IX, vc, zk, T, ji, fy, ft, fM, qW, ao, nV, FZ, chm, QN, en, by, ag, zp, lS, iT, Oi, aT, as); #c1(SMURF1) c2(NP_065162) c3(10717) c4(36831, 49888, 62945, 23774, 76002) c5(pb, BO, jE, V, b, jH, bm, Jh, j, ag, bw, u, y); #c1(SMURF2) c2(NP_073576) c3(10718) c4(36832, 49889, 62946, 23775, 76003) c5(d, cB, b, Be, u, Jh, v, j, dB, kY, Hs, et, e, y); #c1(SMYD1) c2(NP_938015) c3(10719) c4(36833, 49890, 62947, 23776, 76004) c5(ji, cn); #c1(SMYD2) c2(NP_064582) c3(10720) c4(36834, 49891, 62948, 23777, 76005) c5(t, G, T, b); #c1(SMYD3) c2(NP_001161212) c3(10721) c4(36835, 49892, 62949, 23778, 76006) c5(d, jh, A, fs, V, b, bm, ak, q, e, xq, T, B, cO, ik, nP, u, U, y); #c1(SMYD4) c2(NP_443160) c3(10722) c4(36836, 49893, 62950, 23779, 76007) c5(at, u, jR, y); #c1(SMYD5) c2(NP_006053) c3(10723) c4(36837, 49894, 62951, 23780, 76008) c5(hx, g, jV, J, fy, u, y); #c1(SNAI1) c2(NP_005976) c3(10724) c4(36838, 49895, 62952, 23781, 76009) c5(Dr, g, by, hV, aw, b, X, LM, rU, jc, w, di, iL, D, Al, U, A, e, y, jx, d, gB, ahi, aX, ip, f, q, bu, cU, fr, B, cs, av, Hs, u, yJ, V, Be, LR, is, ad, jo, co, T, eX, ny, aPN, x, ft, fy, BX, QD, PY, jR, ag, sf, I, aA, dB); #c1(SNAI2) c2(NP_003059) c3(10725) c4(36839, 49896, 62953, 23782, 76010) c5(Dr, QD, A, aw, b, X, iP, ahS, dB, w, aAM, O, U, e, y, d, aPN, co, S, hV, q, cU, fr, ik, B, cs, ar, av, u, yJ, gG, cV, LR, bjS, ad, ahO, T, aX, ft, iK, iY, cHE, jh, nJ, asO, aA); #c1(SNAI3) c2(NP_840101) c3(10726) c4(36840, 49897, 62954, 23783, 76011) c5(aX, xa); #c1(SNAP23) c2(NP_003816) c3(10727) c4(36841, 49898, 62955, 23784, 76012) c5(l, pS, YR, W, at, jx); #c1(SNAP25) c2(NP_003072) c3(10728) c4(36842, 49899, 62956, 23785, 76013) c5(OG, nU, bS, b, Sx, ak, acH, jz, hS, qa, oR, lv, cO, cA, ai, aK, cp, jv, kH, iR, cHF, t, YR, aeB, jn, do, jT, bK, jQ, ag, o, hW, I, cV, nl, Jt, nu, J, W, P, eX, fx, akV, cq, wG, ao, rQ, KR, ch, G, Jj, ag, i, dc, ap); #c1(SNAP29) c2(NP_004773) c3(10729) c4(36843, 49900, 62957, 23786, 76014) c5(aA, mk, cn, dz, cHG); #c1(SNAP47) c2(NP_444280) c3(10730) c4(36844, 49901, 62958, 23787, 76015) c5(we, f); #c1(SNAP91) c2(NP_001229721)

c3(10731) c4(36845, 49902, 62959, 23788, 76016) c5(b, hX, hx, J, Nq, M, Ns, amS, iv, sf, h); #c1(SNAPC1) c2(NP_003073) c3(10732) c4(36846, 49903, 62960, 23789, 76017) c5(u); #c1(SNAPC4) c2(NP_003077) c3(10733) c4(36847, 49904, 62961, 23790, 76018) c5(nl); #c1 (SNAPC5) c2(NP_006040) c3(10734) c4(36848, 49905, 62962, 23791, 76019) c5(aW); #c1(SNCA) c2(NP_009292) c3(10735) c4(36849, 49906, 62963, 23792, 76020) c5(A, brW, Gt, b, k, rq, aqu, jz, Dm, aN, bg, cHJ, dd, HS, gE, CT, cHl, Jz, aK, y, bS, ec, aX, Ll, zo, bj, f, cHK, B, RA, Gj, jQ, u, aE, o, bfJ, alX, afx, aC, bK, GS, jR, LG, v, Oc, vc, xq, ll, GR, iN, Gl, to, W, ao, amc, xM, cHH, HN, P, he, ex, m, im, aaS, cV, dc, aT, GJ, wz, lv); #c1(SNCAIP) c2(NP_001229864) c3(10736) c4(36850, 49907, 62964, 23793, 76021) c5(acE, GS, cV, f, v, bg, GR, aA, bj); #c1(SNCB) c2(NP_003076) c3(10737) c4(36851, 49908, 62965, 23794, 76022) c5(aDH, cV, Be, f, Fs, v, jR, bg, bj, rn); #c1(SNCG) c2(NP_003078) c3(10738) c4(36852, 49909, 62966, 23795, 76023) c5(b, X, jq, Dm, bg, BY, dd, PM, iL, U, bj, e, y, d, Ag, f, cB, cs, av, u, o, V, v, bp, ad, T, jE, bm, er, PY, Af, i, dc, bh, aA, eG); #c1(SND1) c2(NP_055205) c3(10739) c4(36853, 49910, 62967, 23796, 76024) c5(hh, jT, ahM, b, re, f, jz, fO, B, cz, A, jQ, lv, cs, x, ad, u, y, R); #c1(SNED1) c2(NP_001073906) c3(10740) c4(36854, 48911, 62968, 23797, 76025) c5(wV, jR, ad, wP, w, T, cs, bf, aA, D, aM); #c1(SNF8) c2(NP_009172) c3(10741) c4(36855, 49912, 62969, 23798, 76026) c5(dx, dv, b, cV, h, du, J, P); #c1(SNIP1) c2(XP_011540462) c3(10742) c4(36856, 49913, 62970, 23799, 76027) c5(co, cHL, fy, b); #c1(SNRK) c2(NP_001094064) c3(10743) c4(36857, 49914, 62971, 23800, 76028) c5(cs, ad); #c1 (SNRNP200) c2(NP_054733) c3(10744) c4(36858, 49915, 62972, 23801, 76029) c5(ml, cHM, nW, v, yn); #c1 (SNRNP27) c2(NP_006848) c3(10745) c4(36859, 49916, 62973, 23802, 76030) c5(Jm); #c1(SNRNP70) c2(NP_001287998) c3(10746) c4(36860, 49917, 62974, 23803, 76031) c5(A, tR, aby, aHc, wX, bf, O, m, cy, ak, B, sV, gl, Kx, I, j, vc, eX, mW, cl, fx, aM, rQ, wn, i, aA); #c1(SNRPA) c2(NP_004587) c3(10747) c4(36861, 49918, 62975, 23804, 76032) c5(vp, m, gl, mW, aHc); #c1(SNRPB) c2(NP_003082) c3(10748) c4(36862, 49919, 62976, 23805, 76033) c5(m, nW, u, v, bu); #c1(SNRPC) c2(NP_003084) c3(10749) c4(36863, 49920, 62977, 23806, 76034) c5(m); #c1(SNRPD1) c2(NP_008869) c3(10750) c4(36864, 49921, 62978, 23807, 76035) c5(bP, m, gJ); #c1(SNRPD3) c2(NP_004166) c3(10751) c4(36865, 49922, 62979, 23808, 76036) c5(Ag, P, T, Af); #c1(SNRPE) c2(NP_001291393) c3(10752) c4(36866, 49923, 62980, 23809, 76037) c5(f, s, ag, cY, gG, w, O, auV, CT, U, A, yE, y, jh, co, aX, agB, h, hV, fy, cHN, QE, OC, ar, cM, cs, QJ, u, ff, og, fs, V, Eg, aC, FC, bp, J, auf, Ql, T, eX, iD, x, jC, fx, ad, fM, yG, W, nV, bm, DO, nJ, B, avl, E, Bi, zD); #c1(SNRPF) c2(NP_003086) c3(10753) c4(36867, 49924, 62981, 23810, 76038) c5(bj, cl); #c1(SNRPN) c2(NP_073719) c3(10754) c4(36868, 49925, 62982, 23811, 76039) c5(auS, b, cG, asf, wy, AA, ahV, bdE, U, axQ, oU, Nm, apR, m, am, t, oB, f, cHO, ayd, es, Vr, kz, afl, cc, nl, oD, DA, bjc, NT, hW, V, cV, cHx, iv, v, cz, dt, G, sf, mF, wV, ao, rQ, Y, apA, wP, Lo, agw, rv, afw, h); #c1(SNTA1) c2(NP_003089) c3(10755) c4(36869, 49926, 62983, 23812, 76040) c5(Fp, b, cHP, dk, mO, u, BK, y, sK); #c1(SNTB1) c2(NP_066301) c3(10756) c4(36870, 49927, 62984, 23813, 76041) c5(ali, an, Bu, di, as, bf, ap); #c1(SNTG1) c2(NP_001274743) c3(10757) c4(36871, 49928, 62985, 23814, 76042) c5(c, I, rl, hT, cC, ji, aW); #c1(SNTG2) c2(NP_061841) c3(10758) c4(36872, 49929, 62986, 23815, 76043) c5(Wk, cM, cz); #c1(SNUPN) c2(NP_005692) c3(10759) c4(36873, 49930, 62987, 23816, 76044) c5(sE); #c1(SNURF) c2(NP_005669) c3(10760) c4(36874, 49931, 62988, 23817, 76045) c5(rv); #c1(SNW1) c2(NP_036377) c3(10761) c4(36875, 49932, 62989, 23818, 76046) c5(EO, aX, b, DO, ag, cy); #c1(SNX10) c2(NP_001186764) c3(10762) c4(36876, 49933, 62990, 23819, 76047) c5(qf, fl, bb, zl, cHQ, zM, bj, cp); #c1 (SNX12) c2(NP_001243117) c3(10763) c4(36877, 49934, 62991, 23820, 76048) c5(o); #c1(SNX14) c2(NP_001284543) c3(10764) c4(36878, 49935, 62992, 23821, 76049) c5(WW, nU); #c1(SNX16) c2(NP_690049) c3(10765) c4(36879, 49936, 62993, 23822, 76050) c5(A, qr); #c1(SNX18) c2(NP_001096045) c3(10766) c4(36880, 49937, 62994, 23823, 76051) c5(ix); #c1(SNX19) c2(NP_001288018) c3(10767) c4(36881, 49938, 62995, 23824, 76052) c5(dx, fh, dv, bb, du, bq, at, ap); #c1(SNX1) c2(NP_003090) c3(10768) c4(36882, 49939, 62996, 23825, 76053) c5(qs, co, V, ad, di, cs, x, T, U, fy); #c1(SNX20) c2(NP_001138444) c3(10769) c4(36883, 49940, 62997, 23826, 76054) c5(fP, Bm); #c1(SNX24) c2(NP_054754) c3(10770) c4(36884, 49941, 62998, 23827, 76055) c5(fl, dA); #c1(SNX25) c2(XP_005263324) c3(10771) c4(36885, 49942, 62999, 23828, 76056) c5(hS, iZ); #c1(SNX29) c2(NP_115543) c3(10772) c4(36886, 49943, 63000, 23829, 76057) c5(oy, qf, bb); #c1(SNX2) c2(NP_003091) c3(10773) c4(36887, 49944, 63001, 23830, 76058) c5(co, fl); #c1(SNX30) c2(NP_001013012) c3(10774) c4(36888, 49945, 63002, 23831, 76059) c5(Ns, Nq); #c1(SNX3) c2(NP_001287857) c3(10775) c4(36889, 49946, 63003, 23832, 76060) c5(d, cHR, arl, QZ, kD, e, bCa); #c1(SNX5) c2(NP_689413) c3(10776) c4(36890, 49947, 63004, 23833, 76061) c5(o, bu); #c1(SNX9) c2(NP_057308) c3(10777) c4(36891, 49948, 63005, 23834, 76062) c5(nk, cy, ad, cs, x, u); #c1(SOAT1) c2(NP_001239440) c3(10778) c4(36892, 49949, 63006, 23835, 76063) c5(dx, B, aHH, sd, dB, eH, sJ, w, bf, ps, cU, dv, fH, pq, g, fe, lb, du, gm, fO, jT, cq, of, ag, aWQ, pt, pJ, jz, eu, y, co, px, f, N, iv, zQ, fy, bm, jB, iA, fJ, en, fw, tl, oM, pv, hV, b, zH, bah, jd, qR, q, jV, anf, aWa, pn, dQ, pB, jG, u, o, da, I, pF, G, et, nV, fg, bL, A, lv, gE, jQ, aX, h, op, M, aC, n, aq, ez, apx, be, J, P, Ql, T, jl, nP, aM, zM, akm, ap, rZ); #c1(SOAT2) c2(NP_003569) c3(10779) c4(36893, 49950, 63007, 23836, 76064) c5(dx, eH, dv, fD, jH, ch, dD, du, q, bd, az, au, i, I, ji, aA, at, bm); #c1(SOBP) c2(NP_060483) c3(10780) c4(36894, 49951, 63008, 23837, 76065) c5(nU, cHS, bb, he); #c1(SOCS1) c2(NP_003736) c3(10781) c4(36895, 49952, 63009, 23838, 76066) c5(dx, gK, en, aw, Ob, iU, w, bf, pz, e, gO, dv, cy, fH, lb, du, gm, fO, dB, fx, jT, gg, fc, aOS, ag, cT, i, bq, aA, bT, rn, iF, cY, jz, wy, mk, pK, bw, U, y, co, Ml, px, yE, f, N, bu, B, cs, av, fy, bm, iT, d, jB, V, nl, gv, pJ, fJ, gt, auK, ci, ij, pv, b, LX, aF, dk, oi, z, yK, re, hV, q, X, pn, ar, pB, jG, u, aE, o, da, I, LR, ad, pF, aFj, eF, cW, jH, wV, nV, ig, wP, fg, fl, C, A, lv, iL, gE, al, jQ, m, aX, h, F, aC, n, aV, jZ, Be, J, P, Ql, T, ll, bh, by, aM, qp, gj, Ez); #c1(SOCS2) c2(NP_001257400) c3(10782) c4(36896, 49953, 63010, 23839, 76067) c5(bL, A, b, bx, X, aF, qi, Fr, U, e, y, d, m, aX, wp, DM, B, N, cU, do, Km, av, u, V, I, aC, pF, T, cy, iA, jG, px, Dl, fg, bk, gj, pv); #c1(SOCS3) c2(NP_003946) c3(10783) c4(36897, 49954, 63011, 23840, 76068) c5(dx, en, aw, aiW, iU, w, Dy, bf, pz, e, O, gO, dv, cy, kJ, yh, Hs, g, gG, jH, aC, sH, du, fO, bp, ft, fy, gs, fc, bm, ag, aZA, aA, dB, iP, pK, bkc, U, xU, y, co, rY, DM, f, N, vQ, bu, ky, B, Dl, cs, CX, aOS, cHT, iT, V, v, gv, eX, iA, cf, fG, ij, pv, b, aF, dk, oi, z, ey, d, yN, re, hV, q, dQ, ar, jG, u, aE, da, kF, I, gL, ad, pF, et, jU, iw, nV, ch, ex, gd, fg, I, bL, A, fr, gN, C, iL, gE, al, iK, m, aX, fq, h, F, hN, aCH, aV, ma, cV, be, BC, J, P, T, ll, jl, by, aM, Lc, mb, cHU, fP, gj, bh, at, gl); #c1(SOCS4) c2(NP_543143) c3(10784) c4(36898, 49955, 63012, 23841, 76069) c5(ma, cf, gv, fx, i, bh, al, aOS, aA); #c1(SOCS5) c2(NP_659198) c3(10785) c4(36899, 49956, 63013, 23842, 76070) c5(b, fq, f, fP, rn, I, aCH, aOS, aE, ri); #c1(SOCS6) c2(XP_005266840) c3(10786) c4(36900, 49957, 63014, 23843, 76071) c5(m, jE, QJ, aw, V, b, f, Rd, bu, w, U, by, bm); #c1(SOCS7) c2(NP_055413) c3(10787) c4(36901, 49958, 63015, 23844, 76072) c5(by, QJ, aw, V, b, bm, cf, jE, gv, w, fx, aA, i, bh, al, bu, aOS, U); #c1(SOD1) c2(NP_000445) c3(10788) c4(36902, 49959, 63016, 23845, 76073) c5(dx, by, dM, pV, Ob, cnY, dD, bYj, aN, w, hM, cO, aw, ajf, aHp, e, O, cp, dv, cy, iR, aKH, kz, mg, kX, cc, g, xc, sE, lb, bK, sH, du, Wc, aWN, bp, MO, ee, KK, cV, aye, bMk, gg, pq, bg, Xf, gt, cHV, fc, aq, lK, ag, bLx, dX, i, dc, vJ, bq, GJ, sU, ug, td, bS, cG, X, z, afD, dV, bOZ, bf, ai, Co, y, co, fC, PL, adc, f, aWQ, beP, bu, xg, dZ, B, il, oD, av, fy, bm, wH, fF, adf, V, ae, ec, Bs, HV, v, Zr, gv, acU, ix, bh, bd, xd, PY, fw, uK, HB, br, aFf, fD, wQ, nU, kE, b, acE, cHW, AA, KN, m, bPa, Fm, ey, ba, ary, d, Ag, ala, bb, MX, oB, gz, q, afl, Kz, ar, p, as, sR, u, dh, o, fh, aNN, fs, alX, acv, KL, gL, ad, da, lX, awT, Ql, rw, cmF, rB, Nh, aC, cs, et, jU, yi, ao, rQ, ch, tW, HN, eo, ih, cX, amk, amb, Au, I, vZ, Mp, gc, bL, lb, A, asx, fN, Ue, cvu, di, HS, wf, mL, al, axQ, U, aW, vH, jl, I, bn, bj, ayi, lr, Vr, iZ, aE, cB, nl, PT, aV, aaH, AS, ma, si, qB, nQ, afx, an, yO, sB, J, bmX, dt, P, T, jV, aj, cz, axZ, aM, cHX, apR, aDl, ii, xM, apA, UE, eB, fP, DA, afw, aT, at, mo, ml); #c1(SOD2) c2(NP_001019636) c3(10789) c4(36903, 49960, 63017, 23846, 76074) c5(dx, SC, pV, aZ, dN, cnY, dD, sE, dB, aE, aN, eH, lH, sJ, ak, cO, aw, aK, e, O, gO, dv, cy, b, aim, mR, lV, g, Oe, HX, aC, sH, du, yO, gm, bp, GK, cV, x, aCP, fx, hR, OA, pq, lp, aoC, gs, cHY, fN, F, os, ag, cT, i, dc, aCQ, bq, aA, aFa, rn, ug, td, GM, X, vD, mk, ali, vT, H, bf, cA, bw, U, bF, zL, cM, tp, bhG, co, ip, f, bu, ky, B, av, cp, bm, yJ, vi, IT, AU, V, fC, jh, aco, v, cd, gv, lh, eX, cl, Mp, ahK, xd, dO, hp, aY, kO, PY, dY, xe, vH, HB, cf, ji, vL, ap, ake, bn, am, bL, aF, lb, bg, oi, ic, cK, ey, d, Ag, bb, lz, kW, fy, MX, re, q, aCF, vu, ar, as, u, dh, o, aBh, aCC, iP, Pz, I, mZ, KL, gL, by, awT, dy, rB, ct, et, jH, ao, rQ, ch, tW, he, ex, na, ix, HV, I, vZ, yA, fh, xa, azt, de, oC, A, gU, lW, gN, axA, di, HS, nl, gE, wf, afs, cla, aW, m, aX, Zw, bj, cHZ, qr, ik, y, cB, qB, aV, ag, dj, ma, abA, an, be, J, GB, P, ti, T, fO, Oi, jl, ac, aM, to, jT, bmV, ii, Y, xM, sp, bh, aT, at, mo); #c1(SOD3) c2(NP_003093) c3(10790) c4(36904, 49961, 63018, 23847, 76075) c5(dx, f, pV, am, X, cnY, vD, bmV, A, di, cO, bf, O, xU, y, qs, ba, sH, I, hV, lW, eE, B, qB, u, dh, g, De, LR, VD, aC, nW, du, wE, BZ, ti, rB, jl, ac, nV, rQ, DR, PY, fw, tD, ag, i, I, bq, at, ap); #c1 (SOHLH1) c2(NP_001012415) c3(10791) c4(36905, 49962, 63019, 23848, 76076) c5(pM, wn, afm); #c1 (SOHLH2) c2(NP_060296) c3(10792) c4(36906, 49963, 63020, 23849, 76077) c5(X, av, Ap, jw, b); #c1(SON) c2(NP_001278340) c3(10793) c4(36907, 49964, 63021, 23850, 76078) c5(en, b, J, pu, u, rb); #c1(SORBS1) c2(NP_001030127) c3(10794) c4(36908, 49965, 63022, 23851, 76079) c5(b, di, Ku, gE, bf, al, U, y, awa, bb, aej, si, uj, q, aM, u, wK, kF, V, I, ui, fl, vF, P, cy, uf, dP, bm, awb, avZ, aA); #c1(SORBS2) c2(NP_001139142) c3(10795) c4(36909, 49966, 63023, 23852, 76080) c5(bw, jh, b, ag); #c1(SORBS3) c2(NP_005766) c3(10796) c4(36910, 49967, 63024, 23853, 76081) c5(oy); #c1(SORCS1) c2(NP_001013049) c3(10797) c4(36911, 49968, 63025, 23854, 76082) c5(oy, dx, cf, I, bj, du, eo, do, bf, aA, et, aE, o, aM); #c1(SORCS2) c2(NP_065828) c3(10798) c4(36912, 49969, 63026, 23855, 76083) c5(A, bb, I, ak, hR, at); #c1(SORCS3) c2(NP_055793) c3(10799) c4(36913, 49970, 63027, 23856, 76084) c5(aY, at, bu, cM, dc); #c1(SORD) c2(NP_003095) c3(10800) c4(36914, 49971, 63028, 23857, 76085) c5(l, b, X, ch, W, xa, Bs, wf, bf, Pl, et, aM);

c1(SORL1) c2(NP_003096) c3(10801) c4(36915, 49972, 63029, 23858, 76086) c5(dx, bL, gk, Dm, aN, di, bf, oy, dv, bb, t, h, ak, tF, iv, aq, o, I, cV, du, G, aM, aaS); #c1(SOS1) c2(NP_005624) c3(10802) c4(36916, 49973, 63030, 23859, 76087) c5(dx, by, ak, aw, dB, w, baB, bf, ra, O, gO, jR, dv, lZ, e, cxv, cl, fH, Hs, cc, fe, aC, nW, du, fO, ft, hU, fx, jT, dL, av, Bi, sS, fN, ag, mx, bk, i, bq, aA, auB, bT, id, axq, cY, cnm, hS, Ni, iG, U, y, co, aeT, f, bu, gX, B, cs, gg, fy, bm, iT, fi, jB, V, dA, ze, v, Wh, zi, pJ, cK, gv, fJ, py, QG, fw, re, brv, hV, b, Hr, oi, ic, blU, fD, d, aeQ, bvV, eA, vj, aua, PA, q, jV, ND, X, apB, ar, jG, u, dh, iP, aEf, I, j, ad, Sq, ct, aYw, Ut, yG, ao, nz, kB, blo, A, fr, pR, bll, HJ, OC, og, C, gE, aux, KT, dl, jx, m, QV, aX, or, h, F, M, bjP, Qf, fU, si, clb, J, dt, T, Di, cr, cz, AP, aM, Lc, zM, fP, Sv, OA, bh, eG, gf); #c1(SOS2) c2(NP_008870) c3(10803) c4(36917, 49974, 63031, 23860, 76088) c5(dx, B, b, X, cnm, hS, w, ak, O, A, y, aeQ, dv, aX, aeT, lZ, vj, f, M, dl, OA, fy, u, nW, o, wp, aC, nz, du, v, cz, zi, et, jT, ao, sS, ag, h); #c1(SOSTDC1) c2(NP_056279) c3(10804) c4(36918, 49975, 63032, 23861, 76089) c5(fe, b, u, pR, dB, jo, T, ff, et, y); #c1(SOST) c2(NP_079513) c3(10805) c4(36919, 49976, 63033, 23862, 76090) c5(A, b, fr, Ak, zM, bZ, cp, jh, akl, aSi, th, cle, fO, ft, dt, bfP, rM, zl, cld, clc, aA, caz, aG); #c1(SOX10) c2(NP_008872) c3(10806) c4(36920, 49977, 63034, 23863, 76091) c5(KC, b, cG, ahS, HG, yD, dV, J, O, clg, aTh, Ld, jx, S, aJm, UZ, clj, cfR, k, q, aug, dZ, y, Ll, u, clh, g, afu, cJ, bK, bjS, clf, cli, ahO, asO, iD, aX, fT, ac, bgD, aJl, jR, ahe, na, cV, T, ic); #c1(SOX11) c2(NP_003099) c3(10807) c4(36921, 49978, 63035, 23864, 76092) c5(aw, b, k, X, w, cO, bj, O, oy, co, bb, am, kH, t, bu, jT, av, fU, dA, gm, fO, J, G, cr, fx, by, et, pk, hX, ie, jR, Eo, i, kD, rb, zD); #c1(SOX12) c2(NP_008874) c3(10808) c4(36922, 49979, 63036, 23865, 76093) c5(cs, ad); #c1(SOX13) c2(NP_005677) c3(10809) c4(36923, 49980, 63037, 23866, 76094) c5(l, di, bf, yW, aE, aM); #c1(SOX14) c2(NP_004180) c3(10810) c4(36924, 49981, 63038, 23867, 76095) c5(KC, arJ, anK, z); #c1(SOX15) c2(NP_008873) c3(10811) c4(36925, 49982, 63039, 23868, 76096) c5(fl, kF, b, ad, ag, cs, bw); #c1(SOX17) c2(NP_071899) c3(10812) c4(36926, 49983, 63040, 23869, 76097) c5(b, gG, w, sF, VJ, hP, U, y, jh, co, apG, bu, ik, cs, fy, u, V, il, cV, ad, clk, Qt, by, fp, wV, uH, wP, Lo); #c1(SOX18) c2(NP_060889) c3(10813) c4(36927, 49984, 63041, 23870, 76098) c5(dx, cll, dv, Pz, b, CA, du, bu, mk, alx, aw, VJ, by, u, y); #c1(SOX1) c2(NP_005977) c3(10814) c4(36928, 49985, 63042, 23871, 76099) c5(fU, X, re, q, A, xS, av, iT); #c1(SOX21) c2(NP_009015) c3(10815) c4(36929, 49986, 63043, 23872, 76100) c5(dt, pK, w, O, fU); #c1(SOX2) c2(NP_003097) c3(10816) c4(36930, 49987, 63044, 23873, 76101) c5(ml, aw, cnw, Bt, HG, w, bf, e, O, g, bp, ft, ahO, fp, ag, Lo, fD, aA, GD, id, X, ahS, eu, wy, hS, U, y, co, pp, na, Dq, B, beT, bu, cs, av, fy, awc, iT, iF, V, bBW, bt, Lx, JY, pk, auK, jR, ji, kD, b, d, jh, hw, re, q, bkm, ar, u, aE, il, by, sf, jH, wV, ch, Bu, Bg, wP, UT, KC, A, k, fr, BY, iC, aW, m, aX, F, iZ, ik, rR, QJ, Lq, fU, cV, Be, W, T, fO, ad, aM, kH, acK, eG); #c1(SOX3) c2(NP_005625) c3(10817) c4(36931, 49988, 63045, 23874, 76102) c5(aw, am, Ry, cln, Ps, wn, clo, adt, cO, avX, bj, Pm, jh, nU, Sc, Fb, o, aew, bBN, fU, elm, nz, dt, clp, mF, EZ, ym, mB, jR, uH, adi, agd, ahl, aA, acK); #c1(SOX4) c2(NP_003098) c3(10818) c4(36932, 49989, 63046, 23875, 76103) c5(A, aw, b, cY, jq, jz, eu, w, kY, O, U, jQ, fx, y, cp, cU, co, aX, kJ, t, h, f, q, bu, dl, lA, ar, B, cs, fy, u, g, fU, V, J, bp, by, G, cr, iA, M, gt, DO, jR, ag, i, rb); #c1(SOX5) c2(NP_001248343) c3(10819) c4(36933, 49990, 63047, 23876, 76104) c5(pM, qf, A, S, KH, dA, Wk, NT, B, wV, j, wn, mL, sX, I, jD, O, wP); #c1(SOX6) c2(NP_001139283) c3(10820) c4(36934, 49991, 63048, 23877, 76105) c5(jh, Al, il, q, ik, eO, mD, aA, bq, O, cp); #c1(SOX7) c2(NP_113627) c3(10821) c4(36935, 49992, 63049, 23878, 76106) c5(co, aw, V, b, wN, q, bu, cU, mx, A, ar, fy, cr, U, by, u, iA, y); #c1(SOX8) c2(NP_055402) c3(10822) c4(36936, 49993, 63050, 23879, 76107) c5(pK, WV, fO, aMp, aV, kD, ac); #c1(SOX9) c2(NP_000337) c3(10823) c4(36937, 49994, 63051, 23880, 76108) c5(aw, afg, EM, Cf, w, cO, vp, e, O, cy, UZ, kJ, PH, afM, g, aeM, afu, lb, bK, bfm, x, fx, fy, os, ag, i, aNk, X, afY, mk, pK, bf, bw, U, y, co, B, bu, clj, cs, av, PX, V, bjS, EE, W, py, jR, agd, ji, apH, b, jq, ic, d, Ag, Wk, jV, acO, ar, u, da, wp, bgF, by, iD, clq, aNl, kB, acw, aiJ, agb, cgs, aMp, A, Lu, clr, agj, cr, il, cU, ik, Kw, UR, Gd, cls, J, dt, axl, T, aX, gF, ad, AP, aGi, lD, Nq, Af); #c1(SP100) c2(NP_001073860) c3(10824) c4(36938, 49995, 63052, 23881, 76109) c5(g, b, lb, J, jV, do, jd, cT, w, ll, fl, pB, bT, O); #c1(SP110) c2(NP_001171944) c3(10825) c4(36939, 49996, 63053, 23882, 76110) c5(pp, LX, eu, gL, iU, cT, gE, csA, aCV); #c1(SP140) c2(NP_001005176) c3(10826) c4(36940, 49997, 63054, 23883, 76111) c5(jV, gL, cT, ll, lo, aV, bT); #c1(SP1) c2(NP_612482) c3(10827) c4(36941, 49998, 63055, 23884, 76112) c5(dx, by, A, b, fN, cY, ey, fw, akQ, eR, hS, m, w, hC, ic, iL, O, nT, U, ha, vl, y, cp, d, we, fl, co, VO, cy, ip, t, re, f, e, q, bu, X, B, cB, cs, av, fy, u, dh, o, cl, xc, V, jh, du, bp, J, gL, ad, W, P, dv, T, j, ny, ji, x, aX, gF, cz, dL, JY, cW, nV, BX, bm, Jh, iT, HN, nJ, fO, ajf, ag, oi, bk, i, bg, di, lz, iu); #c1(SP2) c2(NP_003101) c3(10828) c4(36942, 49999, 63056, 23885, 76113) c5(d, jZ, e); #c1(SP3) c2(NP_001017371) c3(10829) c4(36943, 50000, 63057, 23886, 76114) c5(g, he, hC, O, i, I, bq, aV, et, iK, cl); #c1(SP4) c2(NP_003103) c3(10830) c4(36944, 50001, 63058, 23887, 76115) c5(ak, hW, b, hV, he, Cr, clt, di, i, cs, x, bb, ai, ad, nV); #c1(SP5) c2(NP_001003845) c3(10831) c4(36945, 50002, 63059, 23888, 76116) c5(A); #c1(SP6) c2(NP_954871) c3(10832) c4(36946, 50003, 63060, 23889, 76117) c5(em, I, tl); #c1(SP7) c2(NP_690599) c3(10833) c4(36947, 50004, 63061, 23890, 76118) c5(zJ, fr, buD, ft, zM, aG); #c1(SP8) c2(NP_874359) c3(10834) c4(36948, 50005, 63062, 23891, 76119) c5(ak, b, he); #c1(SPA17) c2(XP_011541172) c3(10835) c4(36949, 50006, 63063, 23892, 76120) c5(d, ck, b, il, X, re, fO, e, cU, aC, ik, ar, av, fy, iA, iT); #c1(SPACA1) c2(NP_112222) c3(10836) c4(36950, 50007, 63064, 23893, 76121) c5(FU); #c1(SPACA3) c2(NP_776246) c3(10837) c4(36951, 50008, 63065, 23894, 76122) c5(ck, b); #c1(SPAG11A) c2(NP_001075021) c3(10838) c4(36952, 50009, 63066, 23895, 76123) c5(ao, A, cy, b, py, X, EB, lc, xc, bu, by, aC, B, baB, at, o); #c1(SPAG11B) c2(NP_057596) c3(10839) c4(36953, 50010, 63067, 23896, 76124) c5(ao, A, cy, b, py, X, EB, lc, xc, bu, by, aC, B, baB, at, o); #c1(SPAG16) c2(NP_001020607) c3(10840) c4(36954, 50011, 63068, 23897, 76125) c5(td, aFL, bb, I, bq, Fg); #c1(SPAG1) c2(NP_757367) c3(10841) c4(36955, 50012, 63069, 23898, 76126) c5(bVp, b, MW, ag, clu, Pu, fv); #c1(SPAG4) c2(NP_003107) c3(10842) c4(36956, 50013, 63070, 23899, 76127) c5(pR, ff, b, dB); #c1(SPAG5) c2(NP_006452) c3(10843) c4(36957, 50014, 63071, 23900, 76128) c5(re, u, iT, kY); #c1(SPAG6) c2(NP_001240783) c3(10844) c4(36958, 50015, 63072, 23901, 76129) c5(bq, u, ae, y); #c1(SPAG7) c2(NP_004881) c3(10845) c4(36959, 50016, 63073, 23902, 76130) c5(0n); #c1(SPAG8) c2(NP_001034681) c3(10846) c4(36960, 50017, 63074, 23903, 76131) c5(em, ao, bS, f, aA, oG, Ha); #c1(SPAG9) c2(NP_001123999) c3(10847) c4(36961, 50018, 63075, 23904, 76132) c5(ck, b, k, dB, A, kY, U, e, y, d, co, E, re, hV, q, ff, cs, av, fy, u, iT, Bd, V, VD, j, ad, jo, fx, jG, nV, iR, B, Eo, i, Bi); #c1(SPAM1) c2(XP_011514825) c3(10848)

c4(36962, 50019, 63076, 23905, 76133) c5(hh, d, fU, aw, b, X, B, F, e, cU, A, T, fx, i, av, u, iA, y); #c1(SPANXA2) c2(NP_663695) c3(10849) c4(36963, 50020, 63077, 23906, 76134) c5(wV, A, aX, V, b, wP, X, h, B, cT, jG, am, wn, BY, ck, NT, fO, U, wy, fp); #c1(SPANXB1) c2(NP_115850) c3(10850) c4(36964, 50021, 63078, 23907, 76135) c5(NT, aX, am, B, wn, A); #c1(SPANXD) c2(NP_115793) c3(10851) c4(36965, 50022, 63079, 23908, 76136) c5(wn, NT, A, B, am); #c1(SPANXN4) c2(NP_001009613) c3(10852) c4(36966, 50023, 63080, 23909, 76137) c5(oy, dA); #c1(SPARC) c2(NP_003109) c3(10853) c4(36967, 50024, 63081, 23910, 76138) c5(dx, gK, B, aw, jt, dB, eC, w, bf, pz, O, cp, yg, dv, Vx, kJ, anL, oP, g, Jl, aC, bRS, sH, du, fO, lj, bp, ft, x, fx, av, gs, OJ, clv, i, bq, aA, cY, jj, eu, jf, JE, bw, U, apt, y, co, sr, ag, ml, f, N, bu, cs, gg, fy, iT, vi, V, nl, bQ, iA, aUn, JY, py, er, jR, vH, VE, cHA, Xt, aG, An, b, caf, z, jh, zJ, jd, re, q, es, X, ar, ff, jG, qT, u, o, wR, I, LR, j, ad, wq, uQ, et, aAs, mA, xU, fg, aFi, dn, aOB, A, k, fr, zF, tO, di, wf, hP, yw, MT, aX, h, qr, cU, pC, n, Ek, ez, cV, Be, adh, jo, T, ll, by, aM, arq, Jh, zM, bh, at); #c1(SPARCL1) c2(NP_001121782) c3(10854) c4(36968, 50025, 63082, 23911, 76139) c5(A, b, X, hS, iL, bw, O, kJ, B, q, bu, cs, av, fy, V, bp, by, T, ad, aV, ag, eG); #c1(SPAST) c2(NP_055761) c3(10855) c4(36969, 50026, 63083, 23912, 76140) c5(afE, lK, Ue, aji, hS, Md, bhl, bMp, sG, ajj, nU, Me, iZ, clw, bK, aye, OA, aV, o, ckc, nl, ajl, v, QC, bN, dt, lG, kS, ac, ao, amy, dk, hT, he, cC, Kl, clx, rw); #c1(SPATA13) c2(NP_001159743) c3(10856) c4(36970, 50027, 63084, 23913, 76141) c5(W, et, bb, fh); #c1(SPATA16) c2(NP_114161) c3(10857) c4(36971, 50028, 63085, 23914, 76142) c5(bEA, A, am); #c1(SPATA17) c2(XP_005273109) c3(10858) c4(36972, 50029, 63086, 23915, 76143) c5(wn, jJ, am); #c1(SPATA18) c2(NP_660306) c3(10859) c4(36973, 50030, 63087, 23916, 76144) c5(kG); #c1(SPATA19) c2(NP_001278921) c3(10860) c4(36974, 50031, 63088, 23917, 76145) c5(A, b, tl, B); #c1(SPATA20) c2(NP_001245301) c3(10861) c4(36975, 50032, 63089, 23918, 76146) c5(gG); #c1(SPATA21) c2(XP_011539714) c3(10862) c4(36976, 50033, 63090, 23919, 76147) c5(bm, kF); #c1(SPATA22) c2(NP_001164166) c3(10863) c4(36977, 50034, 63091, 23920, 76148) c5(wn, NT); #c1(SPATA25) c2(NP_542175) c3(10864) c4(36978, 50035, 63092, 23921, 76149) c5(wn); #c1(SPATA2) c2(NP_001129245) c3(10865) c4(36979, 50036, 63093, 23922, 76150) c5(da, m, aX, b, im, aC, rq, jz, P, vc, ll, gE, jQ, u, aE, y, lv); #c1(SPATA5) c2(NP_660208) c3(10866) c4(36980, 50037, 63094, 23923, 76151) c5(Pl); #c1(SPATA7) c2(NP_001035518) c3(10867) c4(36981, 50038, 63095, 23924, 76152) c5(A, alM, nW, B, cyR, T, nR); #c1(SPATA8) c2(NP_775770) c3(10868) c4(36982, 50039, 63096, 23925, 76153) c5(bj, bb, bq, cO); #c1(SPATA9) c2(NP_114158) c3(10869) c4(36983, 50040, 63097, 23926, 76154) c5(od, UW, am); #c1(SPATC1) c2(NP_001127846) c3(10870) c4(36984, 50041, 63098, 23927, 76155) c5(kr, eo); #c1(SPC24) c2(NP_872319) c3(10871) c4(36985, 50042, 63099, 23928, 76156) c5(bq); #c1(SPC25) c2(NP_065726) c3(10872) c4(36986, 50043, 63100, 23929, 76157) c5(fl); #c1(SPCS3) c2(NP_068747) c3(10873) c4(36987, 50044, 63101, 23930, 76158) c5(at, cO); #c1(SPDEF) c2(NP_001239223) c3(10874) c4(36988, 50045, 63102, 23931, 76159) c5(co, V, b, X, dc, aza, cs, B, W, A, T, y, bdw, x, ar, av, ad, u, U, aec); #c1(SPDL1) c2(NP_060255) c3(10875) c4(36989, 50046, 63103, 23932, 76160) c5(ac); #c1(SPDYA) c2(NP_001008779) c3(10876) c4(36990, 50047, 63104, 23933, 76161) c5(aw, b, q, C, O, u, y); #c1(SPECC1) c2(NP_001028726) c3(10877) c4(36991, 50048, 63105, 23934, 76162) c5(acE, en, sQ, aZ, uH, aoe, aaR, qj, U, u, pJ, y); #c1(SPECC1L) c2(NP_001138940) c3(10878) c4(36992, 50049, 63106, 23935, 76163) c5(azz, cly); #c1(SPEF2) c2(NP_079143) c3(10879) c4(36993, 50050, 63107, 23936, 76164) c5(aV); #c1(SPEG) c2(NP_001166947) c3(10880) c4(36994, 50051, 63108, 23937, 76165) c5(xP, dv, mR, Vl); #c1 (SPESP1) c2(NP_663633) c3(10881) c4(36995, 50052, 63109, 23938, 76166) c5(h, et, fD, I); #c1(SPG11) c2(NP_001153699) c3(10882) c4(36996, 50053, 63110, 23939, 76167) c5(Uc, ao, cb, lK, nQ, hS, KA, nU, clB, bcY, QC, bAr, bcZ, v, clA, bN, eD, clz); #c1(SPG20) c2(NP_055902) c3(10883) c4(36997, 50054, 63111, 23940, 76168) c5(V, b, bkp, py, bN, W, bcZ, cc, U); #c1(SPG21) c2(NP_001121362) c3(10884) c4(36998, 50055, 63112, 23941, 76169) c5(Xq, clC, QC, oE, bk, bN); #c1(SPG7) c2(NP_003110) c3(10885) c4(36999, 50056, 63113, 23942, 76170) c5(A, MZ, b, cE, X, eu, bcZ, fl, hM, O, U, kV, bG, y, aX, kW, fv, Qe, h, B, q, jF, hN, mR, awS, Pm, aye, av, u, o, clz, cte, V, cV, zl, fO, v, QC, bN, W, awT, T, ll, J, jT, OA, iw, qt, pp, lc, cT, i, fl, clD, aA, fx); #c1(SPHK1) c2(NP_068807) c3(10886) c4(37000, 50057, 63114, 23943, 76171) c5(by, ml, aw, iG, b, qd, X, aF, iP, vB, w, di, jE, kY, O, e, U, A, ey, y, d, aX, il, fy, fH, AX, f, Ll, q, n, bu, fr, ik, B, cs, hV, av, Hs, u, oJ, em, be, V, I, mD, p, ft, LR, J, fO, ad, W, jo, jG, T, ff, Qt, x, Fr, k, gg, jU, qW, wh, nV, qt, oi, bm, ag, fJ, Xh, fP, zS, aA, ar, Dg); #c1(SPHK2) c2(NP_001191087) c3(10887) c4(37001, 50058, 63115, 23944, 76172) c5(fy, bb, b, k, t, sB, J, bu, G, w, O, Dc, oi, gg, by, u, y); #c1(SPHKAP) c2(NP_001136116) c3(10888) c4(37002, 50059, 63116, 23945, 76173) c5(EO, aX, cV, h, DO, bb, O); #c1(SP11) c2(NP_001074016) c3(10889) c4(37003, 50060, 63117, 23946, 76174) c5(b, aF, m, bnS, IE, h, f, jV, clE, M, fH, jG, gm, gL, J, G, fO, jT, fJ, jU, HL, jH, cT); #c1(SPIB) c2(NP_001230927) c3(10890) c4(37004, 50061, 63118, 23947, 76175) c5(V, Ov, J, pB, Ou, U, bT); #c1(SPIC) c2(NP_689536) c3(10891) c4(37005, 50062, 63119, 23948, 76176) c5(U, V); #c1(SPIDR) c2(NP_001073863) c3(10892) c4(37006, 50063, 63120, 23949, 76177) c5(t, U, G, V, b); #c1(SPIN1) c2(NP_006708) c3(10893) c4(37007, 50064, 63121, 23950, 76178) c5(X, d, av, e, b); #c1(SPIN2A) c2(NP_061876) c3(10894) c4(37008, 50065, 63122, 23951, 76179) c5(agH, gK, agJ); #c1(SPINK1) c2(NP_003113) c3(10895) c4(37009, 50066, 63123, 23952, 76180) c5(bP, A, aw, kc, X, Hk, aKD, aCZ, eH, ig, dB, bn, D, iL, bw, bf, U, hP, fD, y, d, bEQ, jT, or, pp, bJm, wG, h, B, e, q, vQ, bu, zB, Mr, aiC, ar, ff, aMq, p, aMj, fv, av, azh, u, aE, cfj, aal, cwf, V, I, bER, qL, gJ, cs, aMk, gv, W, jo, jG, T, eX, x, fx, ad, mm, b, aM, at, alH, aKy, HC, bm, OR, P, ex, ag, ju, bk, i, fN, bh, aKw, oT); #c1(SPINK2) c2(NP_001258647) c3(10896) c4(37010, 50067, 63124, 23953, 76181) c5(ig, jT, J, b); #c1(SPINK4) c2(NP_055286) c3(10897) c4(37011, 50068, 63125, 23954, 76182) c5(ig, qp, Jq); #c1(SPINK5) c2(NP_001121170) c3(10898) c4(37012, 50069, 63126, 23955, 76183) c5(KC, A, Al, Gm, bGG, bRz, aFd, ig, bV, e, d, cy, dw, fq, buX, dI, aD, aE, bir, ti, dP, mk); #c1(SPINK6) c2(NP_001182219) c3(10899) c4(37013, 50070, 63127, 23956, 76184) c5(fq, RY, zw); #c1(SPINK7) c2(NP_115955) c3(10900) c4(37014, 50071, 63128, 23957, 76185) c5(d, jh, co, ar, il, b, q, ik, bw, T, e); #c1(SPINT1) c2(NP_001027539) c3(10901) c4(37015, 50072, 63129, 23958, 76186) c5(by, en, b, X, dB, w, xf, z, U, A, fx, y, d, hP, B, e, vQ, bu, cU, gX, ar, tE, cs, av, u, oJ, BC, gv, W, T, iA, ad, FG, amq, wh, bm, jR, ag, i, I, bh)); #c1(SPINT2) c2(NP_001159575) c3(10902) c4(37016, 50073, 63130, 23959, 76187) c5(A, blZ, b, k, X, pR, bmC, dB, hS, w, O, U, y, Ag, re, B, q, bu, cU, ar, oJ, xt, av, u, iT, In, asQ, BC, by, T, ajV, iA, clF, amq, wh, ajL, bm, blh, jR, ag, gA, Af, aNd); #c1(SPNS1) c2(NP_001135921) c3(10903) c4(37017, 50074, 63131, 23960, 76188) c5(d, A, B, abf, P, w, fl, aD, e); #c1(SPNS2) c2(NP_001118230) c3(10904) c4(37018, 50075, 63132, 23961, 76189) c5(mx); #c1 (SPO11) c2(NP_036576) c3(10905) c4(37019, 50076, 63133, 23962, 76190) c5(wn, h, NT, jw, am); #c1(SPOCK1) c2(NP_004589) c3(10906) c4(37020, 50077, 63134, 23963, 76191) c5(A, ez, kJ, q, bu, w, fy, bw, bf, by); #c1(SPOCK2) c2(NP_001127906) c3(10907) c4(37021, 50078, 63135, 23964, 76192) c5(nl, u, O); #c1(SPOCK3) c2(NP_001035249) c3(10908) c4(37022, 50079, 63136, 23965, 76193) c5(jz, lv, jQ); #c1(SPON1) c2(NP_006099) c3(10909) c4(37023, 50080, 63137, 23966, 76194) c5(av, T); #c1(SPON2) c2(NP_001185950) c3(10910) c4(37024, 50081, 63138, 23967, 76195) c5(A, I, q, ti, co, nk); #c1 (SPOP) c2(NP_003554) c3(10911) c4(37025, 50082, 63139, 23968, 76196) c5(hh, jB, A, b, pR, B, dB, jo, ff, cO, iA, u, Up); #c1(SPP1) c2(NP_000573) c3(10912) c4(37026, 50083, 63140, 23969, 76197) c5(dx, gK, B, aw, bx, EM, gG, Vz, Zf, gi, sJ, w, il, cO, bf, O, e, xl, cp, yg, bQ, cy, kJ, t, fP, Pn, cl, dl, mR, gP, acy, Dd, jC, awi, gl, oP, g, baH, og, mm, aC, Al, du, fO, bp, ft, bmh, x, hR, dL, gg, su, dH, Iq, jE, aV, BX, sS, fc, fN, LR, Ox, Dz, ag, qP, iT, fD, TJ, aA, Mq, hx, bV, mZ, fl, td, cY, ie, oa, jz, eu, alV, rd, kB, fU, clG, iG, bW, bw, U, ex, y, m, co, BL, ip, DM, f, cs, bu, ky, HQ, hZ, av, fy, bm, fY, fi, GS, V, jh, n, Qz, Xr, akT, dv, Mr, bt, atI, VP, cl, iA, k, pi, sP, wR, aH, dy, gt, dP, wz, P, ne, jd, ov, gR, ji, iu, FG, ap, OG, bn, ny, b, zH, aF, jL, bg, at, vY, oi, yU, wv, z, jy, anY, ey, bah, QE, aO, d, eE, bh, zJ, wd, bQf, re, sO, CR, q, X, apB, ar, ff, fv, u, dr, o, fh, da, Id, iP, kF, I, qL, iE, BT, gL, ad, aDv, G, atm, Yi, aZ, clH, et, Ut, jU, VH, ao, nV, hU, ch, DR, kM, dh, gd, cd, sU, bnA, bq, I, uE, BK, acE, A, lO, vd, fr, pR, gE, sv, mW, qY, BY, di, C, iL, eO, jj, aI, jQ, aHA, qs, LS, ajn, oj, h, cU, ik, aE, LI, ZU, kd, jZ, jH, nk, aAU, ax, ez, c, adh, bNw, be, Dw, QV, W, jo, T, ll, aX, by, fM, aM, tf, zM, j, Af, bh, aG, eG, Dq, hz); #c1(SPP2) c2(NP_008875) c3(10913) c4(37027, 50084, 63141, 23970, 76198) c5(da, cy, cp); #c1(SPPL2A) C2(NP_116191) c3(10914) c4(37028, 50085, 63142, 23971, 76199) c5(i, b, k, fr, hV, q, ft, afz, Mr, kY, aj, ai, u, fx, y); #c1(SPPL2B) c2(NP_001070706) c3(10915) c4(37029, 50086, 63143, 23972, 76200) c5(ic, Dm); #c1(SPPL2C) c2(NP_787078) c3(10916) c4(37030, 50087, 63144, 23973, 76201) c5(acE, bj); #c1(SPPL3) c2(NP_620584) c3(10917) c4(37031, 50088, 63145, 23974, 76202) c5(ae, w, I, b, bo); #c1(SPRED1) c2(NP_689807) c3(10918) c4(37032, 50089, 63146, 23975, 76203) c5(A, or, b, aBR, afY, B, q, agb, IR, IX, sJ, IS, t, aiJ, G, EM, O); #c1(SPRED2) c2(NP_001121682) c3(10919) c4(37033, 50090, 63147, 23976, 76204) c5(A, or, aC, EM, B, q, rU, do); #c1(SPRED3) c2(XP_011525279) c3(10920) c4(37034, 50091, 63148, 23977, 76205) c5(EM, or); #c1 (SPR) c2(NP_003115) c3(10921) c4(37035, 50092, 63149, 23978, 76206) c5(cub, ajs, A, aY, bj, ak, dj, B, bAo, aWX, bM, bfi, cz, aq, bAp, cIl); #c1(SPRN) c2(NP_001012526) c3(10922) c4(37036, 50093, 63150, 23979, 76207) c5(eJ, kr, eo); #c1(SPRR1A) c2(NP_001186757) c3(10923) c4(37037, 50094, 63151, 23980, 76208) c5(d, jh, fq, gm, lp, e); #c1(SPRR1B) c2(NP_003116) c3(10924) c4(37038, 50095, 63152, 23981, 76209) c5(QN, sd, f, mk, ar, fq, rZ); #c1(SPRR2A) c2(NP_005979) c3(10925) c4(37039, 50096, 63153, 23982, 76210) c5(gG, jh, Ps, qz, gE, fl, b, YX, f, aE, bu, xK, aJQ, aIM, aZ, z, bf, aA, fp, aM); #c1(SPRR2B) c2(NP_001017418) c3(10926) c4(37040, 50097, 63154, 23983, 76211) c5(cy); #c1(SPRR3) c2(NP_001091058) c3(10927) c4(37041, 50098, 63155, 23984, 76212) c5(d, jh, il, b, bzX, fq, f, mk, T, Xx, ar, aEs, e); #c1(SPRTN)

c2(NP_001010984) c3(10928) c4(37042, 50099, 63156, 23985, 76213) c5(b, f, q, Nh, T, Lq, rT); #c1(SPRY1) c2(NP_001244968) c3(10929) c4(37043, 50100, 63157, 23986, 76214) c5(A, b, X, afY, y, cp, or, t, B, q, cI, cs, u, EM, gv, G, QI, nP, pF, QG, agb, XH, aMp, bh, aA); #c1(SPRY2) c2(NP_005833) c3(10930) c4(37044, 50101, 63158, 23987, 76215) c5(B, jT, b, bvY, EM, rU, A, di, bf, y, qf, co, aX, or, hV, q, cU, ar, O, cs, fy, u, og, fs, jE, I, cV, gm, bp, gv, cIJ, QI, T, aZ, ckU, jI, ad, AP, wV, nV, hX, bm, Nq, Ns, wP, Lo, bh, aA); #c1(SPRY3) c2(NP_005831) c3(10931) c4(37045, 50102, 63159, 23988, 76216) c5(EM, or); #c1(SPRY4) c2(NP_001280218) c3(10932) c4(37046, 50103, 63160, 23989, 76217) c5(oy, co, aX, or, b, cY, Lv, EM, fM, wy, pF, A, Lt, ck, Lr, fy, bb, at, cIK, ER); #c1(SPRYD7) c2(NP_001120954) c3(10933) c4(37047, 50104, 63161, 23990, 76218) c5(cgi); #c1(SPSB3) c2(NP_543137) c3(10934) c4(37048, 50105, 63162, 23991, 76219) c5(aA); #c1(SPSB4) c2(NP_543138) c3(10935) c4(37049, 50106, 63163, 23992, 76220) c5(bf, sX); #c1(SPTA1) c2(XP_011508218) c3(10936) c4(37050, 50107, 63164, 23993, 76221) c5(da, cIL, qt, ae, VX, Io, FG, cIM, T, oM, aU, di, jT, pP, qK); #c1(SPTAN1) c2(NP_001123910) c3(10937) c4(37051, 50108, 63165, 23994, 76222) c5(bC, bU, V, b, m, an, nU, v, bu, by, hS, aer, cs, pt, gn, oD, cIN, ad, as, dl, kH); #c1(SPTB) c2(NP_000338) c3(10938) c4(37052, 50109, 63166, 23995, 76223) c5(ao, bb, cIO, cIP, FG, wh, oD, aU, qK, VX, eV, alk, fh); #c1(SPTBN1) c2(NP_842565) c3(10939) c4(37053, 50110, 63167, 23996, 76224) c5(by, Bz, V, b, pP, h, N, gn, bu, cs, U, ad, hP, mF, cp); #c1(SPTBN2) c2(NP_008877) c3(10940) c4(37054, 50111, 63168, 23997, 76225) c5(BS, cy, aCU, kV, cIQ, v, KL, aIY, zp, rw, dl, Nw, kS, EX); #c1(SPTBN4) c2(NP_066022) c3(10941) c4(37055, 50112, 63169, 23998, 76226) c5(kF, bb, dB); #c1(SPTBN5) c2(NP_057726) c3(10942) c4(37056, 50113, 63170, 23999, 76227) c5(bb); #c1(SPTLC1) c2(NP_006406) c3(10943) c4(37057, 50114, 63171, 24000, 76228) c5(bhh, xy, PL, b, cN, afx, bK, Zy, cG, qZ, v, dt, Y, aFh, ac, cV, yk, at, o, bS); #c1(SPTLC2) c2(NP_004854) c3(10944) c4(37058, 50115, 63172, 24001, 76229) c5(PL, aw, Y, cIR, yk, HE, bJb); #c1(SPTLC3) c2(NP_060797) c3(10945) c4(37059, 50116, 63173, 24002, 76230) c5(v, beH); #c1(SPTSSB) c2(NP_001035189) c3(10946) c4(37060, 50117, 63174, 24003, 76231) c5(dA); #c1(SPTY2D1) c2(NP_919261) c3(10947) c4(37061, 50118, 63175, 24004, 76232) c5(at, bb); #c1(SPZ1) c2(NP_115956) c3(10948) c4(37062, 50119, 63176, 24005, 76233) c5(A, b, asx, cY, dB, oi, DX, cO, Eh, e, y, d, co, aX, pp, Tq, re, B, bu, cU, aaZ, O, cs, av, fy, u, dh, iT, mz, fs, bfV, cV, aC, be, j, ad, W, jo, bQ, T, fO, iA, by, DG, DR, er, jR, ji, aA, Jh, afd, ap); #c1(SQLE) c2(NP_003120) c3(10949) c4(37063, 50120, 63177, 24006, 76234) c5(A, gt, X, bm, dD, B, q, dt, av, u, y); #c1(SQRDL) c2(NP_067022) c3(10950) c4(37064, 50121, 63178, 24007, 76235) c5(fP, A, bj, dA); #c1(SQSTM1) c2(NP_001135771) c3(10951) c4(37065, 50122, 63179, 24008, 76236) c5(A, bS, b, ag, fr, pR, gG, nI, ad, KN, w, bZ, kY, O, zK, ai, xw, bj, U, aW, TC, d, ec, jT, aX, kJ, h, f, F, q, e, Vr, bdT, Kz, ar, y, WF, oD, DA, fy, u, o, ff, bm, V, cV, Dg, ft, GS, gm, v, Fo, T, bt, aj, cy, BV, fv, jG, P, ao, aum, aq, jo, B, zM, bdY, iT, amb, ew, aA, bT); #c1(SRA1) c2(NP_001030312) c3(10952) c4(37066, 50123, 63180, 24009, 76237) c5(A, aw, aNk, b, X, pK, y, cU, Fp, co, sT, B, q, jV, acO, do, av, u, o, mz, yg, lb, bK, J, Yl, axI, T, fx, dL, pb, aNI, bm, nJ, i, fN, I); #c1(SRBD1) c2(NP_060549) c3(10953) c4(37067, 50124, 63181, 24010, 76238) c5(Ig, er, ez, ap); #c1(SRCAP) c2(NP_006653) c3(10954) c4(37068, 50125, 63182, 24011, 76239) c5(aIS, A, aVI, B, J, rb); #c1(SRC) c2(NP_005408) c3(10955) c4(37069, 50126, 63183, 24012, 76240) c5(dx, g, by, A, iL, b, k, X, iP, dk, w, oR, iG, zK, bw, U, adr, e, y, azp, d, co, aX, pz, h, B, q, jG, bu, cU, qL, dQ, O, cB, cs, fM, fv, av, fy, u, fh, yJ, ma, V, I, cV, Be, du, J, ad, P, nV, T, pJ, jT, ji, x, bb, aeC, cz, gg, fU, pq, jx, qO, oQ, VQ, bm, zl, asM, OJ, ag, cT, QI, i, I, di, yq, zD, hd, jU, aG); #c1(SRCIN1) c2(NP_079524) c3(10956) c4(37070, 50127, 63184, 24013, 76241) c5(m, co, bb, ji, jw, u); #c1(SRD5AI) c2(XP_011512405) c3(10957) c4(37071, 50128, 63185, 24014, 76242) c5(A, aw, b, afg, LD, hM, kY, bW, jw, y, PP, bQ, jI, NI, B, avW, q, afH, ar, O, aJ, av, u, kF, pN, I, bc, vF, afJ, T, eq, Fr, cz, dL, afv, ac, fN, PU, PS, PH, aA, eG); #c1(SRD5A2) c2(XP_011531370) c3(10958) c4(37072, 50129, 63186, 24015, 76243) c5(A, aw, b, afg, X, aft, gE, z, bf, al, ho, y, bQ, wp, UZ, aga, NI, B, avW, q, cU, LD, afH, Up, aJ, av, u, UP, o, bm, kF, pN, I, afW, bbu, gv, afJ, iA, cz, afv, ac, jE, UR, yy, PH, eG); #c1(SRD5A3) c2(NP_078868) c3(10959) c4(37073, 50130, 63187, 24016, 76244) c5(KC, pk, A, cIT, Mi, nU, cIS, B, eq, kS); #c1(SREBF1) c2(NP_001005291) c3(10960) c4(37074, 50131, 63188, 24017, 76245) c5(bP, dx, A, b, sO, ia, dD, vD, FM, QY, eH, w, di, iL, gE, bf, U, bj, gF, y, cf, dv, sT, dL, bo, f, aBx, q, cU, B, aM, u, aE, o, em, bm, V, I, aoz, du, gm, gV, P, eX, rT, Hh, iA, et, Ha, tm, ch, Kf, ep, uG, fD, fN, aA, at, Mb); #c1(SREBF2) c2(NP_004590) c3(10961) c4(37075, 50132, 63189, 24018, 76246) c5(bP, dx, B, b, dD, eO, eH, A, di, z, bf, fD, y, dv, eZ, f, q, bu, av, u, o, eX, mz, jB, V, cV, du, dK, P, gV, fx, hR, et, aM, dO, aac, dS, ep, bFg, i, vJ, bq, aA, at, on); #c1(SREK1) c2(NP_001070667) c3(10962) c4(37076, 50133, 63190, 24019, 76247) c5(o); #c1(SREK1IP1) c2(NP_776190) c3(10963) c4(37077, 50134, 63191, 24020, 76248) c5(o); #c1(SRFBP1) c2(NP_689759) c3(10964) c4(37078, 50135, 63192, 24021, 76249) c5(ji, cO, T, b, es); #c1(SRF) c2(NP_001278930) c3(10965) c4(37079, 50136, 63193, 24022, 76250) c5(Dr, bL, jK, A, aw, b, aqt, mk, sL, di, cO, sx, cM, bb, eA, Xv, Bi, f, q, Kk, bu, FN, mR, B, hS, fy, o, da, Bd, aC, dk, j, P, aFj, Nh, QZ, oq, aCq, aFe, aY, AC, mx, dc, cK, aRK); #c1(SRGAP1) c2(NP_065813) c3(10966) c4(37080, 50137, 63194, 24023, 76251) c5(nU); #c1(SRGAP2) c2(NP_001287881) c3(10967) c4(37081, 50138, 63195, 24024, 76252) c5(ao, aX, nU, kB, Dd, cB, Lr, ZU, u, y); #c1(SRGAP3) C2(NP_001028289) c3(10968) c4(37082, 50139, 63196, 24025, 76253) c5(BO, ao, ZU, bb, bj, nU, Dd, at, u, y); #c1(SRGN) c2(NP_002718) c3(10969) c4(37083, 50140, 63197, 24026, 76254) c5(qW, fl, b, jh, lb, pS, h, f, eu, fO, ag, jV, u, y); #c1(SRI) c2(NP_001243821) c3(10970) c4(37084, 50141, 63198, 24027, 76255) c5(MM, b, Pv, cO, U, O, cN, h, f, hN, y, qu, u, fs, V, dA, J, rV, iw, xO, lu, ji, ael, cK); #c1(SRL) c2(NP_001092284) c3(10971) c4(37085, 50142, 63199, 24028, 76256) c5(bEW, bf); #c1(SRMS) c2(NP_543013) c3(10972) c4(37086, 50143, 63200, 24029, 76257) c5(bm, u, b); #c1(SRP14) c2(NP_003125) c3(10973) c4(37087, 50144, 63201, 24030, 76258) c5(Eo, es); #c1(SRP19) c2(NP_001191122) c3(10974) c4(37088, 50145, 63202, 24031, 76259) c5(bb); #c1(SRP68) c2(NP_001247431) c3(10975) c4(37089, 50146, 63203, 24032, 76260) c5(AP, Pz, mk); #c1(SRP72) c2(NP_001254651) c3(10976) c4(37090, 50147, 63204, 24033, 76261) c5(cj, cIU, ci, n); #c1(SRP9) c2(NP_001123912) c3(10977) c4(37091, 50148, 63205, 24034, 76262) c5(x); #c1(SRPK1) c2(NP_003128) c3(10978) c4(37092, 50149, 63206, 24035, 76263) c5(fy, aX, b, cY, jz, DO, gL, wy, W, X, II, iL, ji, x, bw, av, QJ, u, U, y, jQ); #c1(SRPK2) c2(NP_872633) c3(10979) c4(37093, 50150, 63207, 24036, 76264) c5(fy, dA, h, J, j, gL, II, iL, ji, QJ, Jh); #c1(SRPRB) c2(NP_067026) c3(10980) c4(37094, 50151, 63208, 24037, 76265) c5(x, O, q, y); #c1(SRPR) c2(NP_001171313) c3(10981) c4(37095, 50152, 63209, 24038, 76266) c5(UG, ff); #c1(SRPX2) c2(XP_005262178) c3(10982) c4(37096, 50153, 63210, 24039, 76267) c5(oy, by, V, b, hS, cIV, nU, Wh, bxd, ar, Lk, iv, U, bu, hP, akp); #c1(SRPX) c2(NP_001164221) c3(10983) c4(37097, 50154, 63211, 24040, 76268) c5(fl, b, aY, nW, ih, T, dc, ar, cM); #c1(SRR) c2(XP_011522276) c3(10984) c4(37098, 50155, 63212, 24041, 76269) c5(DU, m, ao, cy, I, sB, fw, gd, bf, aM, eG, ap); #c1(SRRM1) c2(NP_001290377) c3(10985) c4(37099, 50156, 63213, 24042, 76270) c5(aPM); #c1(SRRM2) c2(NP_057417) c3(10986) c4(37100, 50157, 63214, 24043, 76271) c5(by, en, iL, b, dB, wy, AA, hS, w, brZ, kY, O, jy, bw, ai, bu, A, e, y, cy, d, ed, co, aX, bj, aEz, f, el, q, es, Vr, kz, mR, B, iv, Tk, QJ, u, nz, o, sz, fU, si, jE, ae, m, bK, Ua, cs, v, j, J, P, T, aj, fy, rO, aro, ad, xx, fM, ao, KK, bm, Jh, ag, cz, jT, fl, QP, nU); #c1(SRRM4) c2(NP_919262) c3(10987) c4(37101, 50158, 63215, 24044, 76272) c5(fU); #c1(SRRT) c2(XP_005250462) c3(10988) c4(37102, 50159, 63216, 24045, 76273) c5(cA, gG); #c1(SRSF10) c2(NP_001287865) c3(10989) c4(37103, 50160, 63217, 24046, 76274) c5(X, iA, kF); #c1(SRSF11) c2(XP_011540729) c3(10990) c4(37104, 50161, 63218, 24047, 76275) c5(U, T); #c1(SRSF12) c2(NP_542781) c3(10991) c4(37105, 50162, 63219, 24048, 76276) c5(o); #c1(SRSF1) c2(NP_001071634) c3(10992) c4(37106, 50163, 63220, 24049, 76277) c5(en, b, cY, lk, lp, U, e, y, d, m, co, bb, kz, ff, iv, jG, QJ, bm, V, cV, J, bp, ahu, ll, rT, P, oH, jE, fy, u, jo, ji); #c1(SRSF2) c2(NP_001182356) c3(10993) c4(37107, 50164, 63221, 24050, 76278) c5(ake, ats, SS, zF, oH, yn, pz, Ag, co, G, b, h, nU, zh, q, n, as, QJ, cj, an, wO, eI, J, bp, ahu, T, jT, pc, ao, fy, HN, P, Af, ji, pJ, ci); #c1(SRSF3) c2(NP_003008) c3(10994) c4(37108, 50165, 63222, 24051, 76279) c5(en, b, cV, X, ak, qr, ad, dt, hX, bNO, cs, aqR, av, Fg); #c1(SRSF4) c2(XP_011540253) c3(10995) c4(37109, 50166, 63223, 24052, 76280) c5(pM, q, vQ, ex); #c1(SRSF5) c2(NP_001307143) c3(10996) c4(37110, 50167, 63224, 24053, 76281) c5(Ik, Ll, b, aY, vv, EM, le, je, cs, qr, B, z, ahu, A, y, dc, fH, ajW, u, fJ, cM); #c1(SRSF6) c2(NP_006266) c3(10997) c4(37111, 50168, 63225, 24054, 76282) c5(pM, b, rT, ad, ahu, cs, yA, u); #c1(SRSF7) c2(NP_001026854) c3(10998) c4(37112, 50169, 63226, 24055, 76283) c5(v); #c1(SRSF9) c2(NP_003760) c3(10999) c4(37113, 50170, 63227, 24056, 76284) c5(pM, P, bS, qr); #c1(SRXN1) c2(NP_542763) c3(11000) c4(37114, 50171, 63228, 24057, 76285) c5(f, u, dB, y); #c1(SRY) c2(NP_003131) c3(11001) c4(37115, 50172, 63229, 24058, 76286) c5(clN, fe, A, aw, pK, am, afg, afu, PX, Lu, wn, BY, NT, di, Ku, iL, Fr, bf, U, clW, e, clX, d, acK, b, aX, UI, UZ, bgF, q, Nf, xl, Jh, PH, bfn, u, bfm, afL, fU, V, wp, UK, aC, bfo, Gd, bjS, j, vc, sf, UT, UL, Lb, kw, Qx, y, aM, P, KK, aGi, agl, UR, eQ, UW, QJ, fn, B, ag, Lo, agd, agj, cV, PS, clY, aA, afM, alg, afm, brZ); #c1(SS18) c2(NP_001007560) c3(11002) c4(37116, 50173, 63230, 24059, 76287) c5(QV, ck, aw, b, blH, Qu, clZ, aNH, jR, es, cl, iD, jx); #c1(SS18L1) c2(NP_945173) c3(11003) c4(37117, 50174, 63231, 24060, 76288) c5(m, aX, bEc, CA, Jh, j, IR, IW, bb, mm, et, bT, jx); #c1(SSB) c2(NP_003133) c3(11004) c4(37118, 50175, 63232, 24061, 76289) c5(b, gn, mW, mk, iL, gE, m, eA, AX hN, gI, vi, rN, aC, Oq, be, j, aGa, et, iw, xO, boc, iu, bT); #c1(SSBP1) c2(NP_001243442) c3(11005) c4(37119, 50176, 63233, 24062, 76290) c5(wU, Pz, cV, mk, xX, fl); #c1(SSBP2) c2(NP_001243662) c3(11006) c4(37120, 50177, 63234, 24063, 76291) c5(jh, A, td, b, t, H, B, J, jJ, M, G, w); #c1(SSFA2) c2(NP_001123917) c3(11007) c4(37121, 50178, 63235, 24064, 76292) c5(cs, fO, b, ad); #c1(SSH1) c2(NP_001154802) c3(11008) c4(37122, 50179, 63236, 24065, 76293) c5(aQv, fl, agR, bu); #c1(SSH2) c2(NP_001269058) c3(11009) c4(37123, 50180, 63237, 24066, 76294) c5(T, hV, buP, dB, bu); #c1(SSMEM1) c2(NP_660311) c3(11010) c4(37124, 50181, 63238, 24067, 76295) c5(cO); #c1(SSNA1) c2(NP_003722) c3(11011) c4(37125, 50182, 63239, 24068, 76296) c5(j, aGa); #c1(SSPN) c2(NP_005077) c3(11012) c4(37126, 50183, 63240, 24069, 76297) c5(kG, bx, sE, dB, bgo, cK, xI); #c1(SSP0) c2(NP_940857) c3(11013) c4(37127, 50184, 63241, 24070, 76298) c5(ao); #c1(SSR1) c2(NP_003135) c3(11014) c4(37128, 50185, 63242, 24071, 76299) c5(d, fl, il, b, fr, ft, avu, agf, ik, u, e, y); #c1(SSR2) c2(XP_011508225) c3(11015) c4(37129, 50186, 63243, 24072, 76300) c5(qp, A, cV); #c1(SSRP1) c2(NP_003137) c3(11016) c4(37130, 50187, 63244, 24073, 76301) c5(m, A, wp, b, aC, aF, B, nG, aGq, Lo, bn, ll, wG, zS, u, gl, y); #c1(SSSCA1) c2(NP_006387) c3(11017) c4(37131, 50188, 63245, 24074, 76302) c5(dx, B, aw, gG, dB, w, e, O, yg, dv, iy, og, du, gm, fO, gY, fx, jT, wh, yE, cT, i, bT, X, iP, jz, Ku, iG, U, y, co, ag, f, N, bu, cs, av, fy, bm, iT, iF, jB, V, qq, Qz, ad, aEw, Hh, d, dY, b, hh, jh, apl, re, hV, q, OC, jG, u, o, j, by, et, aoO, nV, fg, bL, A, k, EN, jR, iL, jw, jQ, aX, h, F, cU, n, cB, cV, J, W, P, T, Ap, fM, E, Oi); #c1(SST) c2(NP_001039) c3(11018) c4(37132, 50189, 63246, 24075, 76303) c5(by, B, apS, F, dB, mC, w, bf, e, O, bfJ, jv, Hq, DE, jq, g, aC, Wc, bp, Jj, JN, pb, wh, BX, we, ag, oi, mD, kM, X, afY, bNB, OV, cA, bw, U, xw, y, co, pw, ip, yE, ml, ak, bu, xb, ky, cs, av, fy, bm, Tx, iF, V, xD, bt, iA, hw, JY, anG, OW, nc, jR, aAN, cIB, iu, Tp, ny, b, acA, aF, dk, Bh, bmz, ey, gF, d, eA, jd, hV, CR, q, vu, ar, Km, Tv, u, nj, o, I, bCc, ad, Tr, iD, ct, bmy, Ut, jH, wV, nV, hT, agb, wP, fl, OU, Mp, mv, A, k, jc, di, gE, wf, aW, aX, VD, Tq, bn, hB, cU, iZ, ik, cJa, LI, QJ, dj, fU, cV, hZ, Fs, bks, W, P, T, fO, jI, nP, cz, fM, aM, bpG, jT, qp, Y, apT, Yv, eG, rr); #c1(SSTR1) c2(NP_001040) c3(11019) c4(37133, 50190, 63247, 24076, 76304) c5(A, dk, bw, O, DE, ip, yE, B, bu, y, u, nj, iF, by, W, nV, Jj, ny, fM, qp, BX, hS, ch, kM, ag, Yv, mD); #c1(SSTR2) c2(NP_001041) c3(11020) c4(37134, 50191, 63248, 24077, 76305) c5(dx, Dr, bXH, A, iq, b, hS, Bd, OV, bw, bmy, y, Fp, dv, DE, ip, ag, bll, Bi, B, q, iZ, ar, O, yE, Km, fv, tU, fy, u, nj, iF, fU, vO, kM, cV, vN, du, bp, ad, W, nV, T, Jj, ny, nP, fM, qp, BX, dk, ch, Nv, jR, jd, cT, Yv, mD, aA, iu); #c1(SSTR3) c2(XP_005261778) c3(11021) c4(37135, 50192, 63249, 24078, 76306) c5(B, b, dk, A, OV, bw, hV, bu, ar, u, vR, gL, by, W, nV, JY, qp, akn, ch, yE, i, I, mD); #c1(SSTR4) C2(NP_001043) c3(11022) c4(37136, 50193, 63250, 24079, 76307) c5(ak, b, yu, F, yz, hS, yD, w, di, yx, yn, cO, O, yF, A, yv, y, yy, co, aX, yl, f, hB, ys, oE, yp, X, FN, ar, B, cB, av, yB, u, eI, I, mD, aC, nW, bp, W, P, yk, fO, uw, oi, cy, jv, jC, yA, yG, ahT, ym, dk, yr, cT, gu, il, T, aA, yo); #c1(SSTR5) c2(NP_001166031) c3(11023) c4(37137, 50194, 63251, 24080, 76308) c5(A, b, OV, ns, dk, nm, nt, nq, nr, nn, cJb, no, np, DE, yE, bll, ak, vO, ar, B, bw, tU, u, iF, dj, hW, vN, cz, W, Km, T, Jj, bmy, ahT, OW, ch, ag, Bh, mD); #c1(SSUH2) c2(NP_001243677) c3(11024) c4(37138, 50195, 63252, 24081, 76309) c5(jC); #c1(SSX1) c2(NP_005626) c3(11025) c4(37139, 50196, 63253, 24082, 76310) c5(ck, aX, b, blH, Qu, q, fO, J, ac, o, jx); #c1(SSX2B) c2(NP_001157889) c3(11026) c4(37140, 50197, 63254, 24083, 76311) c5(A, b, fr, aNH, ck, y, jx, QV, jT, aX, Qu, f, M, ik, B, u, cl, V, il, aHK, cIZ, fO, ad, iD, ft, wV, bIH, wP, h); #c1(SSX2IP) c2(XP_011538914) c3(11027) c4(37141, 50198, 63255, 24084, 76312) c5(at, fl); #c1(SSX4B) c2(NP_001030004) c3(11028) c4(37142, 50199, 63256, 24085, 76313) c5(g, ck, aX, b, fO, ac, jx); #c1(SSX5) c2(NP_066295) c3(11029) c4(37143, 50200, 63257, 24086, 76314) c5(aX, q, b); #c1(ST13) c2(NP_003923) c3(11030) c4(37144, 50201, 63258, 24087, 76315) c5(en, b, aWc, w, bf, U, A, e, O, d, jh, co, aX, anR, f, q, jV, ar, B, cs, iR, cc, fU, V, I, lb, ad, aM, bm, Dj, cT, zO, aA); #c1(ST14) c2(NP_068813) c3(11031) c4(37145, 50202, 63259, 24088, 76316) c5(dx, en, b, X, qz, FM, O, A, xf, z, xl, hP, cJc, y, d, co, cr, dw, aFd, re, nU, cs, vQ, e, gX, ar, B, alx, oD, av, u, tE, fi, Ps, du, dB, ad, dv, T, ss, jU, jH, KK, bm, ex, aUQ, fP); #c1(ST18) c2(NP_055497) c3(11032) c4(37146, 50203, 63260, 24089, 76317) c5(sr, Xe, md, ji, u, y); #c1(ST20) c2(NP_001094349) c3(11033) c4(37147, 50204, 63261, 24090, 76318) c5(jE, V, b, re, q, U, bm, iT); #c1(ST3GAL1) c2(XP_005251082) c3(11034) c4(37148, 50205, 63262, 24091, 76319) c5(A, aw, b, X, cO, adp, eO, td, y, oy, bb, ak, B, av, u, o, j, T, fx, cW, agQ, he, i, iu); #c1(ST3GAL2) c2(NP_008858) c3(11035) c4(37149, 50206, 63263, 24092, 76320) c5(A, B, atg); #c1(ST3GAL4) c2(NP_001241687) c3(11036) c4(37150, 50207, 63264, 24093, 76321) c5(cW, LS, V, fv, cY, re, lW, q, dB, vH, cs, T, adp, bf, aX, ey, at, rb, dh, iT, aM); #c1(ST3GAL5) c2(NP_001035902) c3(11037) c4(37151, 50208, 63265, 24094, 76322) c5(fl, X, cJd, hS, aC, av); #c1(ST3GAL6) c2(NP_001258074) c3(11038) c4(37152, 50209, 63266, 24095, 76323) c5(b, X, q, fO, bu, T, av, by, aA); #c1(ST5) c2(NP_005409) c3(11039) c4(37153, 50210, 63267, 24096, 76324) c5(hT); #c1(ST6GAL1) c2(NP_775323) c3(11040) c4(37154, 50211, 63268, 24097, 76325) c5(by, fl, b, X, z, lW, U, e, O, d, pp, re, q, bu, ar, cs, av, iT, fi, V, I, J, j, gv, T, fx, ad, cW, bh, iu); #c1(ST6GAL2) c2(NP_001135824) c3(11041) c4(37155, 50212, 63269, 24098, 76326) c5(bq, at, O); #c1(ST6GALNAC1) c2(NP_060884) c3(11042) c4(37156, 50213, 63270, 24099, 76327) c5(b, ak, he, i, fx, u); #c1(ST6GALNAC2) c2(NP_006447) c3(11043) c4(37157, 50214, 63271, 24100, 76328) c5(fl, u, y, b); #c1(ST6GALNAC4) c2(NP_778204) c3(11044) c4(37158, 50215, 63272, 24101, 76329) c5(Pn); #c1(ST6GALNAC6) c2(NP_001273928) c3(11045) c4(37159, 50216, 63273, 24102, 76330) c5(jo, ff, b); #c1(ST7) c2(NP_060882) c3(11046) c4(37160, 50217, 63274, 24103, 76331) c5(il, V, b, q, ad, T, cs, U, u, y); #c1(ST7L) c2(XP_011539931) c3(11047) c4(37161, 50218, 63275, 24104, 76332) c5(by, O, b, bu); #c1(ST8S1A1) c2(NP_001291379) c3(11048) c4(37162, 50219, 63276, 24105, 76333) c5(dx, aX, pp, qL, du, je, J, bp, z, jG, aV, u, y); #c1(ST8S1A2) c2(NP_006002) c3(11049) c4(37163, 50220, 63277, 24106, 76334) c5(dj, fy, hW, b, cV, ak, BV, cO, qD, cz); #c1(ST8S1A3) c2(NP_056963) c3(11050) c4(37164, 50221, 63278, 24107, 76335) c5(at); #c1(ST8S1A4) c2(NP_005659) c3(11051) c4(37165, 50222, 63279, 24108, 76336) c5(A, td, b, Rd, vY, au, di, U, VX, vl, oy, aeQ, qs, co, bb, lz, B, q, e, abh, u, is, d, si, V, I, dA, sH, FC, P, T, cV, c, KK, bm, jc, mA, ex, gA, fP, Yv, GF, at, fD, cmx); #c1(ST8S1A6) c2(NP_001004470) c3(11052) c4(37166, 50223, 63280, 24109, 76337) c5(t); #c1(STAB1) c2(NP_055951) c3(11053) c4(37167, 50224, 63281, 24110, 76338) c5(et, q); #c1(STAB2) c2(NP_060034) c3(11054) c4(37168, 50225, 63282, 24111, 76339) c5(bb, fN, q, Hh, at, dL); #c1(STAC3) c2(NP_001273185) c3(11055) c4(37169, 50226, 63283, 24112, 76340) c5(cJe); #c1(STAC) c2(NP_003140) c3(11056) c4(37170, 50227, 63284, 24113, 76341) c5(oy, gj); #c1(STAG1) c2(NP_005853) c3(11057) c4(37171, 50228, 63285, 24114, 76342) c5(A, X, f, dB, B, av); #c1(STAG2) c2(NP_001036215) c3(11058) c4(37172, 50229, 63286, 24115, 76343) c5(ao, aYo, b, M, w, T, i, Tk, ar, fx, iR); #c1(STAG3) c2(NP_001269646) c3(11059) c4(37173, 50230, 63287, 24116, 76344) c5(cJf, X, av, am); #c1(STAM2) c2(NP_005834) c3(11060) c4(37174, 50231, 63288, 24117, 76345) c5(A, b, dY); #c1(STAMBP) c2(NP_998787) c3(11061) c4(37175, 50232, 63289, 24118, 76346) c5(cyy, aFF, hT, hS, cJg, QZ); #c1(STAMBPL1) c2(NP_065850) c3(11062) c4(37176, 50233, 63290, 24119, 76347) c5(jQ, jz, cO); #c1(STAM) c2(NP_003464) c3(11063) c4(37177, 50234, 63291, 24120, 76348) c5(bh, q, fN); #c1(STAP1) c2(NP_036240) c3(11064) c4(37178, 50235, 63292, 24121, 76349) c5(dE, bj); #c1(STAP2) c2(NP_001013863) c3(11065) c4(37179, 50236, 63293, 24122, 76350) c5(jG, u, do, y); #c1(STARD10) c2(NP_006636) c3(11066) c4(37180, 50237, 63294, 24123, 76351) c5(A, u, y); #c1(STARD13) c2(NP_001230395) c3(11067) c4(37181, 50238, 63295, 24124, 76352) c5(qf, nU, aX, jE, b, k, bm, f, q, cU, w, T, sF, iA, u, y); #c1(STARD3) c2(NP_001159409) c3(11068) c4(37182, 50239, 63296, 24125, 76353) c5(A, b, B, bu, by, u, y); #c1(STARD3NL) c2(NP_114405) c3(11069) c4(37183, 50240, 63297, 24126, 76354) c5(aF, jI); #c1(STARD5) c2(NP_871629) c3(11070) c4(37184, 50241, 63298, 24127, 76355) c5(f); #c1(STARD7) c2(NP_064536) c3(11071) c4(37185, 50242, 63299, 24128, 76356) c5(od, q); #c1(STARD8) c2(NP_001135975) c3(11072) c4(37186, 50243, 63300, 24129, 76357) c5(A, b, B, T, u, y); #c1(STARD9) c2(NP_065810) c3(11073) c4(37187, 50244, 63301, 24130, 76358) c5(bb); #c1(STAR) c2(NP_000340) c3(11074) c4(37188, 50245, 63302, 24131, 76359) c5(A, aw, b, X, jj, Hq, hM, bbd, O, cA, bD, y, bbc, bQ, jl, ak, cU, bO, cM, hb, av, iz, avP, kF, I, p, Fs, P, hl, UT, Ca, iA, qT, US, aY, ch, B, aqx, o, dc, vJ, di, eG, RB); #c1(STAT1) c2(NP_009330) c3(11075) c4(37189, 50246, 63303, 24132, 76360) c5(dx, by, en, aw, lo, dN, aiW, aMr, w, hM, cJh, ER, e, O, cp, dv, cy, b, t, Hs, gl, n, g, sE, lb, bxO, du, fO, dB, auf, od, x, fx, jT, cJi, zQ, pq, aDI, QJ, aei, ag, cT, oi, bk, i, pt, rn, xN, cY, iP, jz, ig, kY, bW, U, y, co, BL, px, DM, f, cs, vQ, bu, B, iv, av, fy, bm, jM, V, beW, Bs, Dp, cd, gv, mD, pi, dP, oM, Pp, xm, zH, aF, fl, FG, d, jh, bb, bX, q, jV, CO, dQ, pB, ar, jG, u, dh, fs, Dg, gL, bOl, G, wq, bNy, aAF, jH, nV, hU, ch, aAu, aE, aof, I, bOo, azt, bL, A, pF, gE, gn, mW, fe, lv, iL, Ei, zK, al, jQ, m, lE, aX, kn, h, F, M, aC, hN, RQ, gg, aV, aq, jZ, ma, apx, cV, J, bR, P, My, T, ll, bQg, pw, gF, ad, qT, aeq, lD, akm, Dl, bOs, Nj, bh, X, gl); #c1(STAT2) c2(NP_005410) c3(11076) c4(37190, 50247, 63304, 24133, 76361) c5(ER, b, aiW, gE, aI, y, m, Ei, aX, q, jV, M, hN, dQ, aW, cs, aV, bm, da, ma, Dg, ad, P, ll, cy, iw, jM, u, bh); #c1(STAT3) c2(NP_003141) c3(11077) c4(37191, 50248, 63305, 24134, 76362) c5(dx, B, aw, bx, qE, sE, dB, aE, lp, w, cO, bf, aoK, adr, e, O, gF, M, dv, cy, kJ, t, DB, yh, FN, mR, Dc, aD, Dd, Hs, oN, rR, g, mz, asd, fe, aeM, jH, aC, aDT, du, fO, gm, bp, ft, xO, od, lz, x, fx, hR, zQ, cq, ja, ata, aV, jM, sS, fN, pS, DO, baY, ag, cT, qP, pv, bk, i, bq, aA, bT, rn, bP, cC, crw, cY, iP, jz, eu, pJ, rd, cc, ix, Dj, kY, lW, bw, U, ex, y, V, tp, co, Ml, pp, yX, rI, DM, f, mx, bu, gX, cs, iv, iJ, atb, av, fy, bm, iT, em, Dp, yV, jh, Bs, nl, v, gv, IR, afz, zi, eX, bt, cK, iA, qH, pi, anf, JY, fJ, Vs, iY, aY, P, nJ, Le, fG, IP, tl, ji, bn, iu, ci, ap, gG, Dr, Tp, bW, b, zH, Xv, aOQ, A, ic, aiE, bIU, pF, re, fT, HQ, Tr, d, Ag, aem, cJj, jd, aol, oB, hV, q, jV, es, Zx, vu, ar, ff, Xp, Dq, oO, n, jG, u, dh, o, fh, da, gE, kF, jE, I, qL, Mi, gL, ad, CM, G, bub, lG, aZ, fH, oi, ct, aeC, et, jU, yG, iw, nV, hU, NA, hX, ch, py, iq, xU, gd, IS, fl, I, yA, uE, aXD, C, bhv, Qv, fD, iG, k, fr, pR, aZk, gn, pz, QV, bhu, og, vZ, lv, iL, eM, Ez, aI, jR, hP, aW, jQ, m, qs, xT, aX, iI, Ec, aQk, fq, h, F, cU, hN, ik, iK, sX, Ll, ZU, aq, yd, Ac, fU, xc, cV, Be, hZ, be, BC, J, agh, GB, dU, jo, QI, T, ll, Oi, jl, nP, by, fM, aM, jT, Lc, ip, lX, bug, mb, DI, fP, Af, atR, bh, X, at, gf, gl); #c1(STAT4) c2(NP_003142) c3(11078) c4(37192, 50249, 63306, 24135, 76363) c5(bP, dx, by, fl, gE, dN, zH, z, rr, Mz, mW, eC, ix, iL, cO, cJk, xe, baF, y, cy, yt, fm, b, dv, BL, ajn, t, oB, q, ps, bu, HQ, qB, aD, fP, yW, Hs, u, jZ, aFc, da, PJ, yc, ax, yV, I, jH, aC, du, gJ, j, gY, vc, aE, Jc, aDe, gn, cl, Pk, iU, gg, be, dH, DM, jT, aV, hU, ii, fN, Jh, bY, gI, fG, m, Dl, bOs, br, fD, fI, I, aA, aDF, eG, bT, ap); #c1(STAT5A) c2(NP_001275648) c3(11079) c4(37193, 50250, 63307, 24136, 76364) c5(B, aw, N, w, bf, pz, oU, xl, cy, t, eE, kz, aGV, fH, g, aeI, aC, gm, bp, Jj, ca, jT, bkZ, cT, mD, aA, cY, jz, eu, Ou, asI, U, y, jb, RD, ip, DM, f, zh, e, cc, iv, aPM, av, fy, bm, iT, V, Ov, anf, fG, ji, pv, b, oR, d, Ag, Dx, re, Tp, q, jV, fJ, X, ar, Tr, jG, u, aE, I, pF, G, jH, ao, hX, fg, bL, A, Iv, gE, aJj, jQ, m, jI, LI, fq, h, F, oE, M, n, ma, cV, Be, J, P, T, fO, aM, pp, ID, btA, DI, Af, at); #c1 (STAT5B) c2(NP_036580) c3(11080) c4(37194, 50251, 63308, 24137, 76365) c5(B, N, w, bf, pz, oU, O, BO, t, eE, kz, fH, g, aeI, aC, gm, bp, bkZ, Jj, ca, jT, gs, F, ag, cT, mD, aA, X, jz, Ou, asI, U, y, pp, f, zh, aCS, iv, av, fy, bm, iT, V, Ov, fJ, fG, ji, pv, b, Ey, oR, bKq, Dx, re, Tp, q, jV, anf, ar, Tr, jG, u, aE, pF, G, aZ, jU, iw, hX, ch, fg, Vs, bL, A, Iv, aJj, jQ, jI, LI, fq, h, avW, M, hN, n, Ry, ma, cV, J, P, T, fO, aX, aM, ip, ID, btA); #c1(STAT6) c2(XP_006719637) c3(11081) c4(37195, 50252, 63309, 24138, 76366) c5(dx, aw, bx, sE, iX, DT, w, O, dv, cy, t, eE, cl, aD, fH, Hs, aC, du, gm, bp, dB, x, jT, aoC, sS, cT, pH, fD, cmo, ig, NH, U, y, ip, DM, B, cs, FG, fy, bm, iT, ali, arP, V, ae, bd, bQb, fJ, dP, iu, b, re, q, dQ, ar, u, gL, ad, et, jU, jH, mk, aFi, I, A, k, DK, bIT, m, jI, fq, h, aV, ma, be, J, jo, ti, T, ac, ii, NG, akm, DI, fP, at, eG); #c1(STATH) c2(NP_001009181) c3(11082) c4(37196, 50253, 63310, 24139, 76367) c5(cz); #c1 (STAU2) c2(NP_001157852) c3(11083) c4(37197, 50254, 63311, 24140, 76368) c5(aV, dA); #c1(STBD1) c2(NP_003934) c3(11084) c4(37198, 50255, 63312, 24141, 76369) c5(fk, bj, tJ); #c1(STC1) c2(NP_003146) c3(11085) c4(37199, 50256, 63313, 24142, 76370) c5(A, Jy, b, X, ea, aEd, D, bo, U, hP, aW, bkC, co, aJm, re, f, q, nv, bu, bbJ, y, cB, cs, av, fy, u, nW, iT, fh, ma, V, nQ, dA, Be, aLJ, HH, J, ad, cU, aZ, x, iA, by, et, ao, cmd, jh, B, gA, Yv, mD, bUR); #c1(STC2) c2(NP_003705) c3(11086) c4(37200, 50257, 63314, 24143, 76371) c5(B, b, X, vR, U, A, y, jh, bn, f, bu, ik, cB, av, u, ma, V, il, cV, aC, sB, by, ao, hT, Af, bsX, eG); #c1(STEAP1) c2(NP_036581) c3(11087) c4(37201, 50258, 63315, 24144, 76372) c5(A, aw, b, X, f, nJ, es, B, av, fy, u, aA, y); #c1(STEAP2) c2(NP_001231873) c3(11088) c4(37202, 50259, 63316, 24145, 76373) c5(A, T, B, b, es); #c1(STEAP3) c2(NP_001008410) c3(11089) c4(37203, 50260, 63317, 24146, 76374) c5(avD, A, V, b, Rr, bHc, f, cJI, gv, bGR, B, aNC, bh, T, U); #c1(STEAP4) c2(NP_001192245) c3(11090) c4(37204, 50261, 63318, 24147, 76375) c5(dx, dv, rf, I, du, eX, A, B, aA); #c1(STH) c2(NP_001007533) c3(11091) c4(37205, 50262, 63319, 24148, 76376) c5(acE, si, bS, HN, v, ai, bj, o); #c1(STIL) c2(XP_011540294) c3(11092) c4(37206, 50263, 63320, 24149, 76377) c5(b, 1W, e, ait, d, kJ, t, re, nU, ar, iT, J, Ej, ais, P, T, QZ, cJm, aIe, LE, G, dY, cT, gR); #c1(STIM1) c2(NP_003147) c3(11093) c4(37207, 50264, 63321, 24150, 76378) c5(dx, jp, OG, aw, bjA, b, X, mW, w, di, nl, hP, e, y, iy, d, cU, co, aX, cJn, Dx, Bc, h, cV, q, eE, O, av, fy, u, gl, o, cl, g, fe, ae, beW, hf, aiU, du, cnf, dt, P, dv, T, II, aZ, cy, iA, hR, LI, dO, cJo, m, og, QI, iT, eN, re); #c1(STIM2) c2(NP_001162588) c3(11094) c4(37208, 50265, 63322, 24151, 76379) c5(aX, V, cV, pz, aiU, cs, ad, w, aXS, U, at, u, y); #c1(STIP1) c2(NP_006810) c3(11095) c4(37209, 50266, 63323, 24152, 76380) c5(d, jh, fU, aX, b, X, aq, f, v, Fo, w, od, co, cy, av, u, e, O); #c1(STK10) c2(NP_005981) c3(11096) c4(37210, 50267, 63324, 24153, 76381) c5(eE, mk, Lt); #c1(STK11) c2(NP_000446) c3(11097) c4(37211, 50268, 63325, 24154, 76382) c5(eX, aw, Yq, bf, ca, O, bQ, iy, kJ, e, Kg, Zj, og, bp, Ce, fx, HR, mO, DO, os, ag, i, aA, em, cY, Ly, W, ate, bw, U, y, co, js, f, N, bu, ccM, cs, av, fy, bm, iT, d, YV, V, bGq, cK, iA, aEr, dt, aaa, nJ, apG, tl, ji, ck, b, MS, ic, ey, azn, hh, aga, re, q, X, ar, YU, Yr, fv, u, o, kF, il, by, Lt, mA, I, yA, af, Lv, pR, di, hP, Ld, aX, I, h, F, cU, ik, qO, cV, vF, GB, avw, QI, T, fO, gF, ad, aM, Lc, QN); #c1(STK11IP) c2(NP_443134) c3(11098) c4(37212, 50269, 63326, 24155, 76383) c5(MS, ar); #c1(STK17A) c2(NP_004751) c3(11099) c4(37213, 50270, 63327, 24156, 76384) c5(ck, b, Lv, f, do, w, fp, O); #c1(STK17B) c2(NP_004217) c3(11100) c4(37214, 50271, 63328, 24157, 76385) c5(LR, V, b, cV, hV, Eo, og, U); #c1(STK19) c2(NP_004188) c3(11101) c4(37215, 50272, 63329, 24158, 76386) c5(m, nQ, b, mI, aE, P, yn, nE, ct, U, nW, aW, V); #c1(STK24) c2(NP_001027467) c3(11102) c4(37216, 50273, 63330, 24159, 76387) c5(qs, LR, pw, f, Fb, ak, A, fP, B, adt, dh, o); #c1(STK25) c2(NP_001258907) c3(11103) c4(37217, 50274, 63331, 24160, 76388) c5(B, EZ, cV, Fb, f, cJp, u, dh, y); #c1(STK26) c2(NP_001035917) c3(11104) c4(37218, 50275, 63332, 24161, 76389) c5(A, aw, b, B, q, T); #c1(STK31) c2(NP_001247433) c3(11105) c4(37219, 50276, 63333, 24162, 76390) c5(ck, il, V, b, ad, ik, cs, bq, U, hP, ac); #c1(STK32A) c2(NP_001106195) c3(11106) c4(37220, 50277, 63334, 24163, 76391) c5(ig, co, cO); #c1(STK32B) c2(NP_060871) c3(11107) c4(37221, 50278, 63335, 24164, 76392) c5(b, Nq, Ns, boO, apU, Fg); #c1 (STK32C) c2(NP_775846) c3(11108) c4(37222, 50279, 63336, 24165, 76393) c5(I); #c1(STK33) c2(NP_001275990) c3(11109) c4(37223, 50280, 63337, 24166, 76394) c5(aA, cy, I, b, dA); #c1(STK35) c2(NP_543026) c3(11110) c4(37224, 50281, 63338, 24167, 76395) c5(at); #c1(STK38L) c2(NP_055815) c3(11111) c4(37225, 50282, 63339, 24168, 76396) c5(b, nQ, ic); #c1(STK39) c2(NP_037365) c3(11112) c4(37226, 50283, 63340, 24169, 76397) c5(oy, qs, A, bj, re, f, gm, cz, aeP, di, B, bf, aA, u, iT, aM); #c1(STK3) c2(NP_006272) c3(11113) c4(37227, 50284, 63341, 24170, 76398) c5(LR, qt, V, hV, q, nV, U, u, y); #c1(STK4) c2(NP_006273) c3(11114) c4(37228, 50285, 63342, 24171, 76399) c5(f, b, w, U, A, y, aX, rr, hV, q, bu, cU, mR, B, cs, zQ, aV, u, og, V, cV, bwY, ad, T, fy, cK, iA, by, jH, nV, bgV, aoD, ag, fP, bq); #c1(STMN2) c2(NP_001186143) c3(11115) c4(37229, 50286, 63343, 24172, 76400) c5(aaQ, eJ, f, ahS, dZ, aN, kr, ahO, dV, aqR, al, eo, aK); #c1(STMN3) c2(NP_001263239) c3(11116) c4(37230, 50287, 63344, 24173, 76401) c5(d, ar, Oi, fy, u, e, y); #c1(STMN4) c2(NP_001269983) c3(11117) c4(37231, 50288, 63345, 24174, 76402) c5(cV); #c1 (STOM) c2(NP_004090) c3(11118) c4(37232, 50289, 63346, 24175, 76403) c5(jh, cfU, b, xM, czr, Nq, Ns, O, Ft, fy, iE); #c1(STOML1) c2(NP_001243602) c3(11119) c4(37233, 50290, 63347, 24176, 76404) c5(P); #c1 (STOML2) c2(NP_001273960) c3(11120) c4(37234, 50291, 63348, 24177, 76405) c5(is, d, co, Ov, b, jh, Bc, f, e, fO, bu, zZ, jc, ar, Ou, by, cne, O); #c1(STOML3) c2(NP_001137505) c3(11121) c4(37235, 50292, 63349, 24178, 76406) c5(cfU, nU, OC, agw, rv, mD, O); #c1 (STON1-GTF2A1L) c2(NP_001185522) c3(11122) c4(37236, 50293, 63350, 24179, 76407) c5(U, Ce, V); #c1(STON1) c2(NP_001185524) c3(11123) c4(37237, 50294, 63351, 24180, 76408) c5(U, Ce, V); #c1(STOX1) c2(NP_001123631) c3(11124) c4(37238, 50295, 63352, 24181, 76409) c5(od, cJq, sH, di, eQ); #c1(STRA13) c2(NP_001257935) c3(11125) c4(37239, 50296, 63353, 24182, 76410) c5(fy, b, I, pR, f, bu, Au, pt, by, u, y); #c1(STRA6) c2(NP_001136091) c3(11126) c4(37240, 50297, 63354, 24183, 76411) c5(pk, cr, V, b, aC, kD, nU, wN, kH, ctp, mx, Gs, aZ, cs, x, U, hR, AP, I); #c1(STRA8) c2(NP_872295) c3(11127) c4(37241, 50298, 63355, 24184, 76412) c5(wn, NT); #c1(STRADA) c2(NP_001003787) c3(11128) c4(37242, 50299, 63356, 24185, 76413) c5(cJr, b, N, jR, MS, hS, ar); #c1(STRADB) c2(NP_001193793) c3(11129) c4(37243, 50300, 63357, 24186, 76414) c5(ao); #c1(STRAP) c2(NP_009109) c3(11130) c4(37244, 50301, 63358, 24187, 76415) c5(V, b, es, AA, kz, T, ji, u, y); #c1(STRC) c2(NP_714544) c3(11131) c4(37245, 50302, 63359, 24188, 76416) c5(aIH, bCh, cJs, am); #c1(STRN3) c2(NP_001077362) c3(11132) c4(37246, 50303, 63360, 24189, 76417) c5(PJ, fU, aGa, q, j, bAj, cO); #c1(STRN4) c2(NP_001034966) c3(11133) c4(37247, 50304, 63361, 24190, 76418) c5(ag, cT, b); #c1(STRN) c2(NP_003153) c3(11134) c4(37248, 50305, 63362, 24191, 76419) c5(bb, xj, ap, bq, at, fh); #c1(STS) c2(NP_000342) c3(11135) c4(37249, 50306, 63363, 24192, 76420) c5(dx, en, aw, zw, gG, w, aoK, e, dv, bty, aak, g, buV, aC, nx, du, bp, x, jT, fN, ag, aA, GJ, X, mk, yD, bo, cir, U, y, co, DM, f, B, cs, av, fy, bm, iT, iF, V, ae, gv, bQ, ar, iA, d, W, ahf, btH, b, aht, wn, yK, dw, jd, re, nU, q, fv, ajJ, u, NT, kF, ad, iD, aeC, DP, cW, US, ch, Bg, yy, fl, aOB, A, k, di, cJt, zY, iK, aX, ni, fa, cU, cB, aPI, fU, si, cV, hZ, KU, dt, P, T, II, cz, qe, QN, ale, Rd, cJu, bh, eG, iE); #c1(STT3A) c2(NP_001265432) c3(11136) c4(37250, 50307, 63364, 24193, 76421) c5(eq, Ip, ra, P, pu, cJv); #c1(STT3B) c2(NP_849193) c3(11137) c4(37251, 50308, 63365, 24194, 76422) c5(cJw, SY); #c1(STUB1) c2(NP_005852) c3(11138) c4(37252, 50309, 63366, 24195, 76423) c5(US, o, V, b, anR, X, bK, f, v, u, kV, y, ajw, av, TD, kS, U, bEr, n); #c1(STX11) c2(NP_003755) c3(11139) c4(37253, 50310, 63367, 24196, 76424) c5(cJx, ER, b, pS, h, o, zQ); #c1(STX16) c2(NP_001001433) c3(11140) c4(37254, 50311, 63368, 24197, 76425) c5(ec, Fb, EZ, ym, bWD); #c1(STX17) c2(NP_060389) c3(11141) c4(37255, 50312, 63369, 24198, 76426) c5(PI, bef, aX, ic, cJy); #c1(STX18) c2(NP_058626) c3(11142) c4(37256, 50313, 63370, 24199, 76427) c5(oy, A, Nq, Ns, rQ, di, bw, cgm, u, y); #c1(STX1A) c2(NP_001159375) c3(11143) c4(37257, 50314, 63371, 24200, 76428) c5(f, hS, GN, bf, sG, nU, aQj, o, mz, I, qb, YR, BV, W, alM, cz, qD, aM, akA, ag, fD, bVn, aA); #c1(STX1B) c2(NP_443106) c3(11144) c4(37258, 50315, 63372, 24201, 76429) c5(hS); #c1(STX2) c2(NP_001971) c3(11145) c4(37259, 50316, 63373, 24202, 76430) c5(bP, jH, LR, ajn, pT, qb, f, BV, am, aDW, Ny, fP, gg, Hs, et, qD, IG); #c1(STX3) c2(NP_001171511) c3(11146) c4(37260, 50317, 63374, 24203, 76431) c5(bpo); #c1(STX4) c2(NP_001259025) c3(11147) c4(37261, 50318, 63375, 24204, 76432) c5(bf, A, I, aM); #c1(STX5) c2(NP_001231595) c3(11148) c4(37262, 50319, 63376, 24205, 76433) c5(ls); #c1(STX6) c2(NP_001273139) c3(11149) c4(37263, 50320, 63377, 24206, 76434) c5(acE, fl); #c1(STX8) c2(NP_004844) c3(11150) c4(37264, 50321, 63378, 24207, 76435) c5(yp, LG, o); #c1(STXBP1) c2(NP_001027392) c3(11151) c4(37265, 50322, 63379, 24208, 76436) c5(aqi, f, hT, IC, xM, nU, yH, dY, cz, hS, P, dl, cJB, cJz, cJA, o); #c1(STXBP2) c2(NP_001120868) c3(11152) c4(37266, 50323, 63380, 24209, 76437) c5(cJC, pS, zQ, kZ, eN); #c1(STXBP4) c2(NP_848604) c3(11153) c4(37267, 50324, 63381, 24210, 76438) c5(fP, u, I, y, dA); #c1(STXBP5) c2(NP_001121187) c3(11154) c4(37268, 50325, 63382, 24211, 76439) c5(Ra, pT, cO); #c1 (STXBP5L) c2(NP_055795) c3(11155) c4(37269, 50326, 63383, 24212, 76440) c5(bh, al); #c1(STXBP6) c2(NP_001291406) c3(11156) c4(37270, 50327, 63384, 24213, 76441) c5(oy, aC, qf, cz, cO); #c1(STYK1) c2(XP_005253474) c3(11157) c4(37271, 50328, 63385, 24214, 76442) c5(A, b, B, bp, co, n, fy, u); #c1(STYX) c2(NP_001124173) c3(11158) c4(37272, 50329, 63386, 24215, 76443) c5(NT, am, wn, bf, aE, aM); #c1(SUB1) c2(NP_006704) c3(11159) c4(37273, 50330, 63387, 24216, 76444) c5(aEq, A, b, k, X, Zy, iP, jz, i, O, w, Iv, iG, gE, bw, U, jR, pz, fx, y, jQ, aiH, M, jT, aX, jd, t, h, f, F, q, vQ, bu, cU, ra, ik, B, cB, iv, ar, jG, fy, u, e, o, g, d, fU, V, il, Fs, gm, bp, Yl, W, En, jV, T, fU, J, nP, by, pJ, G, rQ, st, iR, ie, P, aJt, cT, gR, ji, jC, at, dB); #c1(SUCLA2) c2(NP_003841) c3(11160) c4(37274, 50331, 63388, 24217, 76445) c5(dx, SS, awQ, aN, hS, bf, cM, dv, f, nY, aq, o, cJE, du, pQ, fl, cmJ, aoJ, aA, aM, aL, cJD, aY, dc, aT); #c1(SUCLG1) c2(NP_003840) c3(11161) c4(37275, 50332, 63389, 24218, 76446) c5(cJF, bu, cla, aoJ); #c1(SUCLG2) c2(NP_001171070) c3(11162) c4(37276, 50333, 63390, 24219, 76447) c5(ayJ, aA, eG, do); #c1(SUCNR1) c2(NPJ49039) c3(11163) c4(37277, 50334, 63391, 24220, 76448) c5(bP, dx, dv, bb, yO, du, afZ, vw, dZ, di, dV, aW); #c1(SUC0) c2(NP_055098) c3(11164) c4(37278, 50335, 63392, 24221, 76449) c5(P, bNr, EM); #c1(SUDS3) c2(NP_071936) c3(11165) c4(37279, 50336, 63393, 24222, 76450) c5(aHX, di, aHW, b); #c1(SUFU) c2(NP_001171604) c3(11166) c4(37280, 50337, 63394, 24223, 76451) c5(g, aX, BX, ip, jd, aF, QG, jR, YU, ny, ate, asQ, iG, cl); #c1(SUGCT) c2(NP_001180240) c3(11167) c4(37281, 50338, 63395, 24224, 76452) c5(at, dA, sG, t, ED, A, cO, bw, cJG); #c1(SOGP1) c2(NP_757386) c3(11168) c4(37282, 50339, 63396, 24225, 76453) c5(A, b, jz, w, ai, y, jQ, re, f, q, bu, Vr, B, bm, iT, g, v, by, pq, an, u, Ck); #c1(SUGT1) c2(NP_001124384) c3(11169) c4(37283, 50340, 63397, 24226, 76454) c5(c0); #c1(SULF1) c2(NP_055985) c3(11170) c4(37284, 50341, 63398, 24227, 76455) c5(by, ce, aw, b, ag, X, bm, F, q, gT, Be, do, ck, ji, bn, bw, av, bu, u, gg, y); #c1(SULF2) c2(NP_061325) c3(11171) c4(37285, 50342, 63399, 24228, 76456) c5(ml, b, ck, cO, U, bu, O, cJH, ce, bn, q, gT, fv, ff, gg, fy, u, I, cV, qL, sX, LR, fU, by, jo, bg, jC, aA, fP, ji, yA, eG, y); #c1(SULT1A1) c2(NP_803878) c3(11172) c4(37286, 50343, 63400, 24229, 76457) c5(GK, A, aw, Io, b, X, i, w, GM, O, ot, bw, U, gZ, BQ, y, V, d, Ag, qs, cJI, cy, il, ip, re, B, F, q, bu, cU, age, ik, awd, Rh, cs, u, iT, g, fx, bm, hO, I, aub, afn, ad, W, co, T, bp, ny, x, iA, by, M, Lt, GB, pk, nk, iR, Rd, mA, e, Yv, qh, at, fW); #c1(SULT1A2) c2(NP_803564) c3(11173) c4(37287, 50344, 63401, 24230, 76458) c5(A, V, b, i, at, u, y); #c1(SULT1A4) c2(NP_001017390) c3(11174) c4(37288, 50345, 63402, 24231, 76459) c5(fr, Kt, ft); #c1(SULT1B1) c2(NP_055280) c3(11175) c4(37289, 50346, 63403, 24232, 76460) c5(bg); #c1(SULT1C2) c2(NP_001047) c3(11176) c4(37290, 50347, 63404, 24233, 76461) c5(BX, ip, h, ny, u, y); #c1(SULT1E1) c2(NP_005411) c3(11177) c4(37291, 50348, 63405, 24234, 76462) c5(gK, by, A, aw, b, cE, X, jj, ck, O, cJI, aO, ez, co, pw, Iz, ml, nU, F, q, bu, cU, y, cs, av, u, g, iF, ma, kF, V, Eg, Um, Fs, gv, sf, T, bB, Fr, iA, ad, Lt, JY, ao, bm, K, B, ag, cT, bk, Bx, bgo, bh, aA); #c1 (SULT2A1) c2(NP_003158) c3(11178) c4(37292, 50349, 63406, 24235, 76463) c5(gK, A, b, k, adK, z, aBz, O, y, BO, bQ, aX, Im, BI, fq, re, ak, q, bu, cU, B, u, avP, kF, i, jH, aC, Xo, fU, vF, W, P, T, Jj, ry, cy, cz, alf, bT, yE, iT, PU, bQQ, alg); #c1(SULT2B1) c2(NP_004596) c3(11179) c4(37293, 50350, 63407, 24236, 76464) c5(A, V, B, q, cU, ac, gE, bq, U, u, y); #c1(SULT4A1) c2(NP_055166) c3(11180) c4(37294, 50351, 63408, 24237, 76465) c5(aX, BX, ip, yE, T, ny, jv, HR, ac); #c1(SUMF1) c2(NP_001158146) c3(11181) c4(37295, 50352, 63409, 24238, 76466) c5(oy, IU, ahf, adp, aV, kV); #c1(SUMF2) c2(NP_001035934) c3(11182) c4(37296, 50353, 63410, 24239, 76467) c5(qb, uj, ui, qJ, dY, BV, abh, aFm, bk, aAb, auC, RV, cq); #c1(SUMDl) c2(NP_001005781) c3(11183) c4(37297, 50354, 63411, 24240, 76468) c5(Dr, g, A, bS, b, fr, QY, w, sl, cO, e, y, d, gB, co, cr, h, B, N, q, jV, aC, aVn, O, pB, fy, u, aE, yJ, si, cV, lb, v, J, aPe, QZ, fx, csx, ao, bm, Nq, cJJ, acw, Ns, amS, i, apU); #c1(SUMD2) c2(NP_001005849) c3(11184) c4(37298, 50355, 63412, 24241, 76469) c5(jK, A, si, lb, fj, f, aXR, jV, YU, aC, sl, B, pB, u, y); #c1(SUMD3) c2(NP_001273345) c3(11185) c4(37299, 50356, 63413, 24242, 76470) c5(jK, A, si, lb, fj, f, aXR, YU, aC, B, pB, u, y); #c1(SUMD4) c2(NP_001002255) c3(11186) c4(37300, 50357, 63414, 24243, 76471) c5(aGV, vD, ix, vp, wf, bf, HQ, m, q, yW, aM, gl, da, ax, yV, I, aC, aA, dH, cJK, nc, aE, aT, at, iu); #c1(SUN1) c2(NP_001124437) c3(11187) c4(37301, 50358, 63415, 24244, 76472) c5(c, bb, Nh, EM, rT, xl); #c1(SUN2) c2(NP_001186508) c3(11188) c4(37302, 50359, 63416, 24245, 76473) c5(aoa, c, co, jl, cG, aCp, FM, mk, rT); #c1(SUN3) c2(NP_001025190) c3(11189) c4(37303, 50360, 63417, 24246, 76474) c5(ao, bj); #c1(SUDX) c2(NP_000447) c3(11190) c4(37304, 50361, 63418, 24247, 76475) c5(cy, cog, ni, fN, PI, aE); #c1(SUPT20H) c2(NP_001014308) c3(11191) c4(37305, 50362, 63419, 24248, 76476) c5(A, b, re, B, q, iT, T, ff, ji, by, u, pR, y); #c1(SUPT3H) c2(NP_001248752) c3(11192) c4(37306, 50363, 63420, 24249, 76477) c5(v, KM); #c1(SUPT4H1) c2(NP_003159) c3(11193) c4(37307, 50364, 63421, 24250, 76478) c5(eH); #c1(SUPT7L) c2(NP_001269658) c3(11194) c4(37308, 50365, 63422, 24251, 76479) c5(jS, alg, b, cJL, ig, bge, sE, jz, eu, Em, mk, BY, EH, hM, Iv, pu, bf, O, xe, G, fR, y, jQ, bk, awa, co, aX, aeT, t, h, eX, yh, q, bu, FJ, bDe, dQ, ff, iv, oO, o, av, aV, u, aE, pW, aHo, da, im, aC, dB, J, j, by, P, aem, pq, ll, aLy, cq, jT, jG, aMw, aM, jH, qt, Y, hX, pP, Jh, bDf, ie, Ck, he, pa, fG, m, cT, ab, bgd, fj, ic); #c1(SUPV3L1) c2(NP_003162) c3(11195) c4(37309, 50366, 63423, 24252, 76480) c5(lr, b, afW, tx, u, o); #c1(SORF1) c2(NP_003163) c3(11196) c4(37310, 50367, 63424, 24253, 76481) c5(ake, SS, cG, jh, kW, kS, oB, nU, alx, caJ, ov, cJ, bK, v, acU, AP, ac, sK, mP, aAz, ahe, aUE); #c1(SURF4) c2(NP_001267718) c3(11197) c4(37311, 50368, 63425, 24254, 76482) c5(A); #c1(SUSD1) c2(NP_001269569) c3(11198) c4(37312, 50369, 63426, 24255, 76483) c5(ao, Nq, Ns); #c1(SUSD2) c2(NP_062547) c3(11199) c4(37313, 50370, 63427, 24256, 76484) c5(ao, u, y); #c1(SUSD4) c2(NP_001032252) c3(11200) c4(37314, 50371, 63428, 24257, 76485) c5(bq, ac); #c1(SUSD6) c2(NP_055549) c3(11201) c4(37315, 50372, 63429, 24258, 76486) c5(U, V); #c1(SUV39H1) c2(NP_001269095) c3(11202) c4(37316, 50373, 63430, 24259, 76487) c5(m, QG, A, aw, V, b, Bs, h, f, q, mW, J, XH, aE, ey, bf, U, u, gl, y, aM); #c1(SUV39H2) c2(NP_001180353) c3(11203) c4(37317, 50374, 63431, 24260, 76488) c5(wf, co, bp, j, aE); #c1(SUV420H2) c2(NP_116090) c3(11204) c4(37318, 50375, 63432, 24261, 76489) c5(ch, bm, u); #c1(SUZI2) c2(NP_056170) c3(11205) c4(37319, 50376, 63433, 24262, 76490) c5(IJ, A, b, afY, Tw, w, iL, U, bu, fx, y, aX, re, h, B, q, es, cU, O, av, u, EM, iT, o, g, V, lb, by, aEt, T, iD, iA, jG, jE, bm, aid, agb, i, ci); #c1(SV2B) c2(NP_055663) c3(11206) c4(37320, 50377, 63434, 24263, 76491) c5(aY, bb, et, aC, iv); #c1(SV2C) c2(NP_001284645) c3(11207) c4(37321, 50378, 63435, 24264, 76492) c5(Wo, di); #c1(SVEP1) c2(NP_699197) c3(11208) c4(37322, 50379, 63436, 24265, 76493) c5(aig, ahS, u, y); #c1(SVIL) c2(NP_003165) c3(11209) c4(37323, 50380, 63437, 24266, 76494) c5(h, f, aZm, dB, ff, bf, aV); #c1(SVIP) c2(NP_683691) c3(11210) c4(37324, 50381, 63438, 24267, 76495) c5(l, cO); #c1(SVOP) c2(NP_061181) c3(11211) c4(37325, 50382, 63439, 24268, 76496) c5(at, ac); #c1(SWAP70) c2(NP_055870) c3(11212) c4(37326, 50383, 63440, 24269, 76497) c5(X, av, A, B, gL); #c1(SWT1) c2(NP_060143) c3(11213) c4(37327, 50384, 63441, 24270, 76498) c5(h, J, jV); #c1(SYBU) c2(NP_001093213) c3(11214) c4(37328, 50385, 63442, 24271, 76499) c5(A, aE, cbK, w, cO, e, y, d, aX, f, q, B, av, dh, o, GS, v, Yl, P, iy, HN, ag, amu); #c1(SYCE1) c2(NP_001137235) C3(11215) c4(37329, 50386, 63443, 24272, 76500) c5(jw, wp); #c1(SYCE1L) c2(NP_001123451) c3(11216) c4(37330, 50387, 63444, 24273, 76501) c5(IO, b, kg, iP, dB, IM, hS, C, iG, gE, U, al, y, d, it, co, aX, h, gB, q, e, ar, av, fy, u, fU, ly, by, T, II, hX, ag, bT); #c1(SYCP2) c2(NP_055073) c3(11217) c4(37331, 50388, 63445, 24274, 76502) c5(wn, re, NT, iT, o); #c1(SYCP2L) c2(NP_001035364) c3(11218) c4(37332, 50389, 63446, 24275, 76503) c5(ho); #c1(SYCP3) c2(NP_001171420) c3(11219) c4(37333, 50390, 63447, 24276, 76504) c5(pM, aDJ, cJM, b, h, M, wn, tg, re, iT); #c1(SYK) c2(XP_011517248) c3(11220) c4(37334, 50391, 63448, 24277, 76505) c5(dx, ml, aw, b, EM, iP, eu, xb, di, Ou, VJ, e, y, d, m, cn, aX, sm, t, h, N, q, o, cB, aV, u, aAf, Dp, fU, I, qL, du, gm, gL, J, Ov, G, dv, T, jl, jT, be, cxY, hX, ie, gd, cT, cmo, yA, MU); #c1(SYMPK) c2(XP_011525656) c3(11221) c4(37335, 50392, 63449, 24278, 76506) c5(bu); #c1(SYN1) c2(NP_008881) c3(11222) c4(37336, 50393, 63450, 24279, 76507) c5(avQ, I, b, cV, bj, el, cJN, Fs, aN, hS, o, IL, cz, u, Qx, y, bS); #c1(SYN2) c2(NP_003169) c3(11223) c4(37337, 50394, 63451, 24280, 76508) c5(avQ, nr, I, ak, cz, hS, o, zD); #c1(SYN3) c2(NP_598344) c3(11224) c4(37338, 50395, 63452, 24281, 76509) c5(VF, aV, aw, Dq, ak, xj, cz, do, Fg, i, IL, fx, alb, aW); #c1(SYNCRIP) c2(NP_001153146) c3(11225) c4(37339, 50396, 63453, 24282, 76510) c5(kz, fl, cs, ad); #c1(SYNDIG1) c2(NP_079169) c3(11226) c4(37340, 50397, 63454, 24283, 76511) c5(bw, gZ, bq); #c1(SYNE1) c2(NP_149062) c3(11227) c4(37341, 50398, 63455, 24284, 76512) c5(f, b, X, EM, U, kV, e, y, oy, c, qs, aX, t, ak, q, ik, xl, ar, IV, u, d, V, I, J, W, G, T, cK, hR, kS, av, jU, cJP, DO, cJO); #c1(SYNE2) c2(NP_055995) c3(11228) c4(37342, 50399, 63456, 24285, 76513) c5(sX, dB, EM, cJQ, cK, xl); #c1(SYNE4) c2(NP_001034965) c3(11229) c4(37343, 50400, 63457, 24286, 76514) c5(cJR, bCh); #c1(SYNGAP1) c2(NP_006763) c3(11230) c4(37344, 50401, 63458, 24287, 76515) c5(m, xJ, rQ, cyy, aFF, oF, nU, cJS, Cr, dt, hS, bVL, hY, Iw, cz, CA, Ct, oN); #c1(SYNGR1) c2(NP_004702) c3(11231) c4(37345, 50402, 63459, 24288, 76516) c5(h, ak); #c1(SYNGR2) c2(NP_004701) c3(11232) c4(37346, 50403, 63460, 24289, 76517) c5(b); #c1(SYNJ1) c2(NP_001153774) c3(11233) c4(37347, 50404, 63461, 24290, 76518) c5(KS, cV, nW, ak, bAr, ul, vu, cJT, xw, aq, o, cl); #c1(SYNJ2BP) c2(NP_060843) c3(11234) c4(37348, 50405, 63462, 24291, 76519) c5(u, y); #c1(SYNJ2) c2(NP_001171559) c3(11235) c4(37349, 50406, 63463, 24292, 76520) c5(A, cO, JJ, gZ, u, zD); #c1(SYNM) c2(NP_056101) c3(11236) c4(37350, 50407, 63464, 24293, 76521) c5(aw, b, bg, w, PE, bj, Ir, BL, DG, f, q, y, oD, u, apz, HI, afx, GS, v, W, cV, kS, ih, yE); #c1(SYNPO2) c2(NP_001122405) c3(11237) c4(37351, 50408, 63465, 24294, 76522) c5(A, B); #c1(SYNPO) c2(NP_001103444) c3(11238) c4(37352, 50409, 63466, 24295, 76523) c5(A, wd, sH, f, bd, eC, fl, vG, te); #c1(SYNPR) c2(NP_001123475) c3(11239) c4(37353, 50410, 63467, 24296, 76524) c5(cy, bb); #c1(SYP) c2(NP_003170) c3(11240) c4(37354, 50411, 63468, 24297, 76525) c5(0G, xJ, Ir, jq, ak, jj, w, dV, bf, ai, xw, A, e, cM, jx, d, jR, Hq, bb, tX, Tq, f, es, dZ, ar, B, yE, Tk, XH, buB, oN, fU, IU, cV, chu, nz, sB, Fs, W, aax, T, Bg, BW, fy, Lw, nP, bNh, aM, ao, qp, anG, aY, tW, P, fw, aih, adb, cJU, o, Yv, dc, aaA); #c1(SYPL1) c2(NP_006745) c3(11241) c4(37355, 50412, 63469, 24298, 76526) c5(fl); #c1(SYPL2)

c2(XP_011539585) c3(11242) c4(37356, 50413, 63470, 24299, 76527) c5(aN); #c1(SYTI1) c2(NP_689493) c3(11243) c4(37357, 50414, 63471, 24300, 76528) c5(bj, l); #c1(SYTI2) c2(NP_001171351) c3(11244) c4(37358, 50415, 63472, 24301, 76529) c5(l); #c1(SYT13) c2(NP_065877) c3(11245) c4(37359, 50416, 63473, 24302, 76530) c5(bm, dd); #c1(SYTI4) c2(NP_001139733) c3(11246) c4(37360, 50417, 63474, 24303, 76531) c5(oy, bq, v, cJV); #c1(SYT1) c2(NP_001278830) c3(11247) c4(37361, 50418, 63475, 24304, 76532) c5(B, DT, w, bf, e, O, cy, kJ, cl, azx, g, lb, fO, iU, nV, x, gt, bIH, ag, cT, pt, asL, X, jz, hS, U, y, f, bu, xl, av, iT, V, dA, BV, bt, pi, jR, oM, Qu, hV, b, aF, QR, oi, ey, d, jh, bb, fv, re, nU, q, es, jF, ar, pB, dQ, u, o, azY, fs, aSn, j, by, iD, et, jU, jH, ao, axM, aAs, eQ, fl, hd, A, Iv, brx, yw, jx, m, aX, fq, h, clZ, F, jQ, aC, ik, n, aV, aq, cV, J, bEC, T, XO, aM, ii, ck, Jh, he, fP, bh, eG); #c1(SYT4) c2(NP_065834) c3(11248) c4(37362, 50419, 63476, 24305, 76533) c5(hW, aX, fP, l); #c1(SYT6) c2(XP_011539054) c3(11249) c4(37363, 50420, 63477, 24306, 76534) c5(hW, dB); #c1(SYT9) c2(NP_783860) c3(11250) c4(37364, 50421, 63478, 24307, 76535) c5(ag); #c1(SYTL1) c2(XP_011540618) c3(11251) c4(37365, 50422, 63479, 24308, 76536) c5(P, B, T); #c1(SYTL2) c2(NP_001156423) c3(11252) c4(37366, 50423, 63480, 24309, 76537) c5(is, d, co, kG, b, jh, Be, f, bu, jc, by, e); #c1(SYTL5) c2(NP_001156806) c3(11253) c4(37367, 50424, 63481, 24310, 76538) c5(jJ); #c1(SYVN1) c2(NP_115807) c3(11254) c4(37368, 50425, 63482, 24311, 76539) c5(JH, b, dB, e, jx, d, f, oU, n, Kw, ff, kG, rN, aC, kt, nl, avS, jo, jT, aOO, K, xY, bh); #c1(TAAR1) c2(NP_612200) c3(11255) c4(37369, 50426, 63483, 24312, 76540) c5(bEZ, xw, fY); #c1(TAAR2) c2(NP_001028252) c3(11256) c4(37370, 50427, 63484, 24313, 76541) c5(P); #c1(TAAR5) c2(NP_003958) c3(11257) c4(37371, 50428, 63485, 24314, 76542) c5(clL, bFr); #c1(TAAR6) c2(NP_778237) c3(11258) c4(37372, 50429, 63486, 24315, 76543) c5(aY, cA, ak, cM, dc); #c1(TAB1) c2(NP_006107) c3(11259) c4(37373, 50430, 63487, 24316, 76544) c5(aC, kF, u, cy); #c1(TAB2) c2(NP_001278964) c3(11260) c4(37374, 50431, 63488, 24317, 76545) c5(bQ, cJW, aC, iu, bo, aE, mx, T, bjF, cr, u, bq, y); #c1(TAB3) c2(XP_005274539) c3(11261) c4(37375, 50432, 63489, 24318, 76546) c5(da, nX, ao, aw, uj, aF, ui, q, amU, o); #c1(TAC1) c2(NP_003173) c3(11262) c4(37376, 50433, 63490, 24319, 76547) c5(dx, abu, aw, gG, sJ, cO, bf, ps, O, gM, dv, cy, t, gB, do, Qx, mz, aC, du, aB, Ij, cJX, JQ, Xg, bQF, JN, Vb, xO, ro, f, sN, ag, dc, aA, Jy, He, dV, IW, cA, If, vl, cM, TC, ed, co, rY, uj, pz, DM, ak, N, bu, dZ, k, B, fy, DL, V, v, avb, Fr, YU, buB, rK, py, aY, aHo, tl, cIB, b, zH, jh, Fp, bb, Tp, zm, dQ, Tr, HE, DY, u, o, da, il, Vc, sX, cz, G, Io, wx, et, jU, jH, ao, Tv, ih, dn, I, A, asx, gw, eh, aX, wG, F, y, bja, aV, dj, hW, cV, ui, J, P, ti, T, II, pF, aM, nk, vW, eB, sp, DI, fP, fq, at, eG, rr, gl); #c1(TAC3) c2(NP_001171525) c3(11263) c4(37377, 50434, 63491, 24320, 76548) c5(wh, cy, aMW, sH, f, US, yy, di, oJ, cJY, UT, aV, eQ); #c1(TAC4) c2(NP_001070971) c3(11264) c4(37378, 50435, 63492, 24321, 76549) c5(aV, cy, O); #c1(TACC1) c2(NP_001116296) c3(11265) c4(37379, 50436, 63493, 24322, 76550) c5(by, u, y, bu); #c1(TACC2) c2(NP_001278805) c3(11266) c4(37380, 50437, 63494, 24323, 76551) c5(A, u, B, y); #c1(TACC3) c2(NP_006333) c3(11267) c4(37381, 50438, 63495, 24324, 76552) c5(pm, jT, b, u, re, fO, w, O, i, fx, QJ, iR, iT); #c1(TACO1) c2(NP_057444) c3(11268) c4(37382, 50439, 63496, 24325, 76553) c5(ake, acU, aUE, cE); #c1(TACR1) c2(NP_001049) c3(11269) c4(37383, 50440, 63497, 24326, 76554) c5(ak, aw, aDf, b, k, bao, dj, tR, oH, Ey, sJ, w, di, IW, wX, O, A, y, Gt, aX, yQ, uj, t, akv, f, F, bWm, cy, dl, bn, dQ, B, cB, Tr, fP, u, ajs, hW, jH, aC, ui, J, pF, Fo, ti, T, II, Xg, wx, Tp, YU, P, G, ao, ro, Vb, aq, ub, ih, ag, gA, Fk, dn, eG, jU); #c1(TACR2) c2(NP_001048) c3(11270) c4(37384, 50441, 63498, 24327, 76555) c5(jH, bao, bb, DM, f, ub, DI, fP, IW, I, cy, df, blz, jU); #c1(TACR3) c2(NP_001050) c3(11271) c4(37385, 50442, 63499, 24328, 76556) c5(bWQ, dd, GN, cJZ, cM, cy, BI, DM, bWm, oJ, I, aC, wh, P, UT, II, US, aMW, sS, aY, eQ, bCb, yy, DI, dc, di); #c1(TADA1) c2(NP_444281) c3(11272) c4(37386, 50443, 63500, 24329, 76557) c5(l, uJ, aC, di, at, aE, cp); #c1(TADA2A) c2(NP_001159577) c3(11273) c4(37387, 50444, 63501, 24330, 76558) c5(aC, at, bb, ae); #c1(TADA3) c2(NP_006345) c3(11274) c4(37388, 50445, 63502, 24331, 76559) c5(u, y); #c1(TAF15) c2(NP_631961) c3(11275) c4(37389, 50446, 63503, 24332, 76560) c5(aNH, ao, A, b, fr, h, B, PY, J, kB, aj, ai, bu, bo, QV); #c1(TAF1B) c2(NP_005671) c3(11276) c4(37390, 50447, 63504, 24333, 76561) c5(U); #c1(TAF1C) c2(NP_001230089) c3(11277) c4(37391, 50448, 63505, 24334, 76562) c5(cz); #c1(TAF1D) c2(NP_077021) c3(11278) c4(37392, 50449, 63506, 24335, 76563) c5(mk, Pz); #c1(TAF1) c2(NP_001273003) c3(11279) c4(37393, 50450, 63507, 24336, 76564) c5(oy, o, nV, b, B, hV, bpw, pW, afz, A, aKD, cV, bM, aUZ, ra, Yx, at); #c1(TAF2) c2(NP_003175) c3(11280) c4(37394, 50451, 63508, 24337, 76565) c5(cV, cKa, Dg, nU, v, sl); #c1(TAF3) c2(NP_114129) c3(11281) c4(37395, 50452, 63509, 24338, 76566) c5(bb, acg, ap, bq, at, fh); #c1(TAF4B) c2(NP_001280654) c3(11282) c4(37396, 50453, 63510, 24339, 76567) c5(fi, jw, T, b); #c1(TAF4) c2(NP_003176) c3(11283) c4(37397, 50454, 63511, 24340, 76568) c5(oH, bb); #c1(TAF5L) c2(NP_001020418) c3(11284) c4(37398, 50455, 63512, 24341, 76569) c5(bb, bf, u, aE, aM); #c1(TAF6) c2(NP_001177344) c3(11285) c4(37399, 50456, 63513, 24342, 76570) c5(aNS); #c1(TAF7) c2(NP_005633) c3(11286) c4(37400, 50457, 63514, 24343, 76571) c5(cy); #c1(TAF7L) c2(NP_001161946) c3(11287) c4(37401, 50458, 63515, 24344, 76572) c5(am); #c1(TAF8) c2(NP_612639) c3(11288) c4(37402, 50459, 63516, 24345, 76573) c5(u, lv, o); #c1(TAF9) c2(NP_003178) c3(11289) c4(37403, 50460, 63517, 24346, 76574) c5(ji, P, fl, q); #c1(TAGAP) c2(NP_001265662) c3(11290) c4(37404, 50461, 63518, 24347, 76575) c5(da, jH, gz, aC, aF, cKb, ig, aV, aE, dH); #c1(TAGLN2) c2(NP_001264153) c3(11291) c4(37405, 50462, 63519, 24348, 76576) c5(F, q, dB, bxG, i, ji, fx, u, y); #c1(TAGLN) c2(NP_001001522) c3(11292) c4(37406, 50463, 63520, 24349, 76577) c5(dx, B, anY, bW, b, vY, A, IW, bf, U, jh, co, cy, ag, bw, f, q, bu, ar, cs, nA, Ek, gg, fy, u, LR, V, du, j, ad, dv, T, x, by, et, aM, wU, ep, qd, ji, aA, eG, ap); #c1(TAL1) c2(NP_001277334) c3(11293) c4(37407, 50464, 63521, 24350, 76578) c5(b, asx, bo, qz, jz, cKc, pz, lv, eM, jy, zL, gZ, adr, nU, y, Ej, d, jT, aX, bYc, t, h, f, e, M, bdv, pn, fv, cM, iv, jQ, u, aqQ, fx, si, i, aC, gm, j, eu, bcL, G, QI, T, jl, J, pF, pq, Ew, pS, aY, ie, aQM, xe, ih, gR, dc, ew, aA, apT); #c1(TAL2) c2(NP_005412) c3(11294) c4(37408, 50465, 63522, 24351, 76579) c5(jz, jQ); #c1(TALDO1) c2(NP_006746) c3(11295) c4(37409, 50466, 63523, 24352, 76580) c5(d, em, e, aBi, ip, Iv, cKd, F, q, Dj, gv, bh, II, arA, bf, qt, yA, aV, bj, aBw, aM); #c1(TAMM41) c2(NP_620162) c3(11296) c4(37410, 50467, 63524, 24353, 76581) c5(pk); #c1(TANC1) c2(NP_203752) c3(11297) c4(37411, 50468, 63525, 24354, 76582) c5(at, cl); #c1(TANC2) c2(XP_005257260) c3(11298) c4(37412, 50469, 63526, 24355, 76583) c5(u, y); #c1(TANGO2) c2(NP_001270045) c3(11299) c4(37413, 50470, 63527, 24356, 76584) c5(bb); #c1(TANK)

c2(NP_004171) c3(11300) c4(37414, 50471, 63528, 24357, 76585) c5(pV, b, k, cY, w, yU, gE, bw, O, m, co, aX, Os, h, f, y, cs, u, fs, aC, qB, gL, ad, P, fO, cy, jT, ag, cT, ji, at); #c1(TADK1) c2(NP_079418) c3(11301) c4(37415, 50472, 63529, 24358, 76586) c5(ar, U, aeU, b); #c1(TADK2) c2(NP_001238972) c3(11302) c4(37416, 50473, 63530, 24359, 76587) c5(by, fU, ji, b, UK, h, f, Bg, aN, cz, UT, cbK, ar, bu, iv, o); #c1(TADK3) c2(NP_057365) c3(11303) c4(37417, 50474, 63531, 24360, 76588) c5(B, u, y); #c1 (TAP1) c2(NP_000584) c3(11304) c4(37418, 50475, 63532, 24361, 76589) c5(JH, aiW, dB, sJ, w, O, cy, aAo, kJ, AX, aDx, aD, Zv, gl, aC, sH, Xn, x, aCP, dH, tO, aeR, bk, asL, fl, cY, Kc, hS, ix, Ku, U, y, co, DM, f, vQ, cs, fy, iT, V, ae, nl, JY, cf, ne, iu, b, z, aem, alh, re, q, dQ, atT, aCK, u, aE, da, Dg, gL, ad, jr, jM, eQ, fl, Xl, di, iL, gE, al, m, bJz, aX, aCU, fq, F, qr, qB, aV, fU, be, P, ti, T, II, by, nk, cKe, bvx, DI, j, bh, at); #c1(TAP2) c2(NP_000535) c3(11305) c4(37419, 50476, 63533, 24362, 76590) c5(azt, asL, aDx, aw, b, vQ, ox, gE, Xl, mW, Kc, ig, sJ, ix, Ku, iL, z, U, re, al, m, bJz, aX, aCU, fq, AX, ak, JY, aem, qr, iT, axC, Dq, Zv, gl, o, bk, fl, nl, V, il, aC, Xn, sH, be, dB, gL, gn, da, P, nk, II, Io, pt, cy, ac, dH, aV, py, bvx, eQ, hn, aE, aeR, cT, DI, j, Bm, fl, iB, oM, jl, iu, DM); #c1(TAPBP) c2(NP_003181) c3(11306) c4(37420, 50477, 63534, 24363, 76591) c5(eu, cKf, w, gE, bw, U, m, co, aX, aCU, re, zm, ar, Zv, aE, iT, ax, V, bxO, nl, dB, P, T, II, cy, fU, dH, fy, bvx, bxG); #c1 (TAPBPL) c2(NP_060479) c3(11307) c4(37421, 50478, 63535, 24364, 76592) c5(o); #c1(TARBP1) c2(NP_005637) c3(11308) c4(37422, 50479, 63536, 24365, 76593) c5(bq, at); #c1(TARBP2) c2(NP_599150) c3(11309) c4(37423, 50480, 63537, 24366, 76594) c5(A, b, k, iR, jj, dB, P, T, ff, ny, yA, u, bfG); #c1(TARP) c2(XP_011513708) c3(11310) c4(37424, 50481, 63538, 24367, 76595) c5(A, alg, hS, lv, cy, aeT, col, t, ak, yh, B, oO, aC, Mi, Cq, J, as, G, aGJ, jT, mk, ie, cT, gR); #c1(TARS) c2(NP_001245366) c3(11311) c4(37425, 50482, 63539, 24368, 76596) c5(en); #c1 (TARSL2) c2(NP_689547) c3(11312) c4(37426, 50483, 63540, 24369, 76597) c5(en); #c1(TAS2R10) c2(NP_076410) c3(11313) c4(37427, 50484, 63541, 24370, 76598) c5(bL); #c1(TAS2R13) c2(NP_076409) c3(11314) c4(37428, 50485, 63542, 24371, 76599) c5(mz, A, Gt, I, f, B, Lc, xf, tE, bw, ey); #c1(TAS2R14) c2(NP_076411) c3(11315) c4(37429, 50486, 63543, 24372, 76600) c5(aA, V); #c1(TAS2R16) c2(NP_058641) c3(11316) c4(37430, 50487, 63544, 24373, 76601) c5(Yk, Gl, aOb, yo); #c1 (TAS2R1) c2(NP_062545) c3(11317) c4(37431, 50488, 63545, 24374, 76602) c5(cy, cz, bb, dA); #c1(TAS2R38) c2(NP_789787) c3(11318) c4(37432, 50489, 63546, 24375, 76603) c5(Dr, hV, aw, b, GL, Qv, ic, ku, iq, U, azq, cM, aOb, Bi, cKg, aBd, ra, FN, y, aCr, u, Bd, V, VD, Al, Dt, aow, xO, T, Gl, eg, nP, YU, aCq, nV, aei, aCp, jR, aY, kC, aFk, tl, dc, Sw, aA, at, yo); #c1(TAS2R50) c2(NP_795371) c3(11319) c4(37433, 50490, 63547, 24376, 76604) c5(hR, bb, ap, bq, at, fh); #c1(TAS2R60) c2(NP_803186) c3(11320) c4(37434, 50491, 63548, 24377, 76605) c5(aX); #c1(TAS2R9) c2(NP_076406) c3(11321) c4(37435, 50492, 63549, 24378, 76606) c5(GU); #c1(TASP1) c2(NP_060184) c3(11322) c4(37436, 50493, 63550, 24379, 76607) c5(q); #c1 (TATDN1) c2(NP_001139632) c3(11323) c4(37437, 50494, 63551, 24380, 76608) c5(q); #c1(TAT) c2(NP_000344) c3(11324) c4(37438, 50495, 63552, 24381, 76609) c5(QU, aiK, nU, kE, b, k, aF, In, dB, aiM, qa, Ku, O, UE, A, jD, cM, Ej, co, G, pp, jd, t, h, f, q, oE, qL, fv, y, cs, pB, av, fy, u, dh, da, mz, I, Ea, lb, be, v, gm, Fo, fl, aiL, cV, J, jT, aiN, mO, yG, P, ao, qp, aY, Dc, yC, bV, hn, fw, B, ag, dc, aC, Ri, cKh, ap); #c1(TAX1BP1) c2(NP_001073333) c3(11325) c4(37439, 50496, 63553, 24382, 76610) c5(aC, ip); #c1 (TAX1BP3) c2(NP_055419) c3(11326) c4(37440, 50497, 63554, 24383, 76611) c5(w, O); #c1(TAZ) c2(NP_000107) c3(11327) c4(37441, 50498, 63555, 24384, 76612) c5(ats, b, O, BJ, cO, U, y, aX, kW, aoW, hN, mg, cM, cg, cs, mR, av, fy, u, xc, V, fU, ad, dt, aNx, cmK, wt, asG, cK, et, sK, bgc, iw, aY, DO, aWz, Ql, dc, ael); #c1(TBATA) c2(XP_011537769) c3(11328) c4(37442, 50499, 63556, 24385, 76613) c5(P, aV, u, mi, y); #c1(TBC1DI5) c2(NP_001139685) c3(11329) c4(37443, 50500, 63557, 24386, 76614) c5(ak); #c1(TBC1DI6) c2(NP_001258774) c3(11330) c4(37444, 50501, 63558, 24387, 76615) c5(bb, aX); #c1(TBC1D1) c2(NP_001240841) c3(11331) c4(37445, 50502, 63559, 24388, 76616) c5(bSr, bb, rd, vY, aA, cM); #c1(TBC1D20) c2(NP_653229) c3(11332) c4(37446, 50503, 63560, 24389, 76617) c5(bb, cKi, am, cxX); #c1(TBC1D22A) c2(NP_001271232) c3(11333) c4(37447, 50504, 63561, 24390, 76618) c5(oy, bb, dA, cO, bq, bj); #c1(TBC1D22B) c2(NP_060242) c3(11334) c4(37448, 50505, 63562, 24391, 76619) c5(oy); #c1 (TBC1D24) c2(NP_00II86036) c3(11335) c4(37449, 50506, 63563, 24392, 76620) c5(zp, cKj, cKk, IC, beV, nU, hS, dZ, dV, Bx, IL, zk, byo, cKI, aep); #c1(TBC1D25) c2(NP_002527) c3(11336) c4(37450, 50507, 63564, 24393, 76621) c5(nU, ih, BW, Vw, cM, jx); #c1(TBC1D2) c2(NP_001254500) c3(11337) c4(37451, 50508, 63565, 24394, 76622) c5(Ns, aV, Nq); #c1(TBC1D32) c2(NP_689943) c3(11338) c4(37452, 50509, 63566, 24395, 76623) c5(dA); #c1(TBC1D3C) c2(XP_006721970) c3(11339) c4(37453, 50510, 63567, 24396, 76624) c5(A, B); #c1(TBC1D3F) c2(NP_115634) c3(11340) c4(37454, 50511, 63568, 24397, 76625) c5(A); #c1(TBC1D4) c2(NP_001273587) c3(11341) c4(37455, 50512, 63569, 24398, 76626) c5(oy, kF, I, fq, vY, gF); #c1(TBC1D5) c2(NP_001127853) c3(11342) c4(37456, 50513, 63570, 24399, 76627) c5(b, cO); #c1(TBC1D7) c2(NP_001137438) c3(11343) c4(37457, 50514, 63571, 24400, 76628) c5(co, iy, Qn, nU, ig, fy, ap); #c1(TBC1D8) c2(NP_001095896) c3(11344) c4(37458, 50515, 63572, 24401, 76629) c5(g, en, b, X, dB, jf, P, av, cp); #c1 (TBC1D9) c2(NP_055945) c3(11345) c4(37459, 50516, 63573, 24402, 76630) c5(f, aw, hx, dD, iX, dB, w, et, hJ, iq, e, O, M, gC, t, jn, hG, cl, o, g, fe, jH, aC, jt, cs, gm, bp, ft, iJ, fx, jT, jE, bm, hx, ie, ag, cT, bk, i, dc, bg, bT, ib, is, X, iP, jz, eu, jf, hS, bo, cA, U, cM, jb, co, js, gW, hg, N, bu, B, iv, bv, av, fy, hD, iT, cj, fi, jB, V, ae, gv, hi, bt, jC, iA, hs, hw, if, iY, aY, P, iV, gR, he, ij, fn, b, jg, j J, eR, iS, jy, eV, aO, d, jh, bb, jd, g, jV, es, jF, ar, ff, jG, u, jj, fs, il, ir, ht, ad, G, iD, iO, J, et, gQ, iw, ig, hX, iR, jS, fg, fl, hd, A, iL, fr, iM, jl, iH, jc, hi, jR, hA, iC, hP, iK, jQ, m, aX, bj, h, F, gT, cU, iZ, ik, y, fU, cV, bd, jo, hi, T, fU, by, ci, hq, hL, fP, iE, jU, jk, iB, bh, at, ja, hz); #c1(TBCA) c2(NP_001284667) c3(11346) c4(37460, 50517, 63574, 24403, 76631) c5(X, fq, DB, zX, yp, zT, C, av, Pk, aA, sK); #c1(TBCC) c2(NP_003183) c3(11347) c4(37461, 50518, 63575, 24404, 76632) c5(b, h, ak, J, jG, y); #c1(TBCD) c2(NP_005984) c3(11348) c4(37462, 50519, 63576, 24405, 76633) c5(bb, et); #c1(TBCE) c2(NP_001072983) c3(11349) c4(37463, 50520, 63577, 24406, 76634) c5(Pb, cKm, AP, f, cKn, P, fl, cKo, OA, aA, pi, HP, Pm); #c1(TBCEL) c2(NP_001123519) c3(11350) c4(37464, 50521, 63578, 24407, 76635) c5(f, ar, bk, sm); #c1(TBK1) c2(XP_005268867) c3(11351) c4(37465, 50522, 63579, 24408, 76636) c5(B, b, eW, A, dV, iL, gE, al, eV, y, m, co, aX, all, f, g, gr, dZ, Dg, Ig, fy, u, ez, hZ, gL, II, pi, aeq, er, fl, at); #c1(TBKBP1) c2(NP_055541) c3(11352) c4(37466, 50523, 63580, 24409, 76637) c5(nl, gL); #c1(TBL1X) c2(NP_001132938) c3(11353) c4(37467, 50524, 63581, 24410, 76638) c5(u, Wk, ja, eX, na, fN, dL, y); #c1(TBL1XR1) c2(XP_005247828) c3(11354) c4(37468, 50525, 63582, 24411, 76639) c5(EM, co, aw, b, t, re, B, ie, G, A, fl, eX, fN, aA, jT, dL, hd, iT); #c1(TBL1Y) c2(NP_599021) c3(11355) c4(37469, 50526, 63583, 24412, 76640) c5(dL, ja, eX, cz, na, fN, at, u, y); #c1(TBL2) c2(NP_036585) c3(11356) c4(37470, 50527, 63584, 24413, 76641) c5(l, dK); #c1(TBL3) c2(NP_006444) c3(11357) c4(37471, 50528, 63585, 24414, 76642) c5(bb, et); #c1(TBP) c2(NP_001165556) c3(11358) c4(37472, 50529, 63586, 24415, 76643) c5(aGP, nU, pV, cvm, b, oH, WA, H, IW, ckg, U, kV, y, aX, zo, VX, f, q, kr, ar, cEy, qB, RA, gg, Wy, u, aE, EX, GS, si, V, bK, bj, cs, FG, j, v, W, Ql, T, GR, bM, fx, kS, fp, ajQ, KL, KR, bm, od, zp, fP, o, i, n/v, akX); #c1(TBPL1) c2(NP_004856) c3(11359) c4(37473, 50530, 63587, 24416, 76644) c5(ake, by, A, b, qd, z, jz, wn, Iv, aun, cO, U, kV, GL, y, jQ, d, jT, aX, am, sG, wd, f, e, q, bu, IY, B, iv, fP, jC, fy, u, R, aNN, sz, xc, NT, V, nQ, cV, Ib, cs, cbf, v, fO, J, dt, P, T, Nh, cy, fx, ad, et, Jd, WZ, jH, aYm, vW, ic, i, oM, yA, dR, pt, ap); #c1(TBPL2) c2(NP_950248) c3(11360) c4(37474, 50531, 63588, 24417, 76645) c5(dx, em, wh, f, b, oJ, du, jz, ad, dv, Iv, cf, bf, jQ, eG, aM); #c1(TBR1) c2(NP_006584) c3(11361) c4(37475, 50532, 63589, 24418, 76646) c5(nU, V); #c1(TBRG1) c2(NP_116200) c3(11362) c4(37476, 50533, 63590, 24419, 76647) c5(po); #c1(TBX10) c2(NP_005986) c3(11363) c4(37477, 50534, 63591, 24420, 76648) c5(Ns, apU, aPe, Ng); #c1(TBX18) c2(NP_001073977) c3(11364) c4(37478, 50535, 63592, 24421, 76649) c5(fr, at, KM, ft); #c1(TBX19) c2(NP_005140) c3(11365) c4(37479, 50536, 63593, 24422, 76650) c5(WH, aVT, vO, nc, W, di, bmi, aVo, OS, cM, cp); #c1(TBX1) c2(NP_005983) c3(11366) c4(37480, 50537, 63594, 24423, 76651) c5(aw, cKr, EM, aCb, bV, oU, cy, aLv, aMO, Gs, aC, bp, jv, aJr, aLq, la, aA, Dr, ig, aiM, K, U, y, co, ak, mx, e, aUi, cKp, iv, bYE, pP, ahn, auP, V, bVH, afb, iY, aMQ, ap, wm, b, cKm, aiR, d, ahi, nU, ar, u, aQg, kF, ZA, qC, cKq, cz, Mw, Pr, rQ, acw, he, ih, aU, Xm, FY, ats, Pb, axV, iL, yw, Pm, qs, cr, xJ, cAV, cU, Ex, dj, hW, dt, T, aX, AP, to, Nq, jN, rb); #c1(TBX20) c2(NP_001071121) c3(11367) c4(37481, 50538, 63595, 24424, 76652) c5(dx, at, bb, cKs, acw, nW, du, dv, aal, ix, cr, rQ, bh, Mw, hR, cK, bq, bwS); #c1(TBX21) c2(NP_037483) c3(11368) c4(37482, 50539, 63596, 24425, 76653) c5(iq, cwY, yc, C, iL, eM, cA, m, cy, fq, DM, bu, aC, cKt, as, fH, aV, aE, an, TK, J, gL, aCE, BW, anf, qe, aY, Jh, bY, fG, fJ, Dl, j, fl, iu, rn, zD); #c1(TBX22) c2(NP_001103348) c3(11369) c4(37483, 50540, 63597, 24426, 76654) c5(kH, Nq, Ns, bYT, P, aVn, cKu, aVo, amR, bk); #c1(TBX2) c2(XP_011523460) c3(11370) c4(37484, 50541, 63598, 24427, 76655) c5(jj, aX, b, acw, u, f, ag, mx, T, Cd, i, fx, at, et, y); #c1(TBX3) c2(NP_005987) c3(11371) c4(37485, 50542, 63599, 24428, 76656) c5(nU, iq, b, X, di, y, oy, atj, aX, DH, F, q, bu, cs, u, o, jB, V, aC, po, bb, fx, et, jE, acw, bm, aJr, Fg, i, bq); #c1(TBX4) c2(NP_060958) c3(11372) c4(37486, 50543, 63600, 24429, 76657) c5(Yj, bhN, he, IR, IX, IS, cKv, aOt, u); #c1(TBX5) c2(NP_542448) c3(11373) c4(37487, 50544, 63601, 24430, 76658) c5(ats, wa, b, fr, arm, di, cO, aeC, bkK, atj, cr, q, do, mL, Gs, qY, HE, Fg, fU, fs, cV, sX, ft, P, T, fx, hR, Cd, rQ, hQ, acw, arJ, bhN, by, ag, mx, bq, at); #c1(TBXG) c2(NP_004599) c3(11374) c4(37488, 50545, 63602, 24431, 76659) c5(bga, qt, bBo, bZo, cC, IG, bxK); #c1(TBXA2R) c2(NP_963998) c3(11375) c4(37489, 50546, 63603, 24432, 76660) c5(A, b, k, Kc, xK, U, CD, bb, fq, wY, aD, av, o, V, bsb, TK, dv, cy, jG, qe, at, gs, ql, cKw, fw, ti, bq, eN); #c1(TBXAS1) c2(NP_001052) c3(11376) c4(37490, 50547, 63604, 24433, 76661) c5(A, iF, eC, di, cKx, y, gM, dv, bb, hU, do, wY, av, u, o, fh, tY, ma, sH, bp, Fk, cy, qs, vz, wK, fw, tO, i, bq);

c1(TCAIM) c2(NP_001025010) c3(11377) c4(37491, 50548, 63605, 24434, 76662) c5(da); #c1(TCAP) c2(NP_003664) c3(11378) c4(37492, 50549, 63606, 24435, 76663) c5(ml, kG, cKy, arh, cKz, mR, y, Bo, cK, u, xl, sK); #c1(TCEA1) c2(NP_006747) c3(11379) c4(37493, 50550, 63607, 24436, 76664) c5(ao, aX, b, ag, u, y); #c1(TCEA2) c2(NP_003186) c3(11380) c4(37494, 50551, 63608, 24437, 76665) c5(ag, h, u, y, b); #c1(TCEA3) c2(XP_011540358) c3(11381) c4(37495, 50552, 63609, 24438, 76666) c5(ag, u, y, b); #c1(TCEAL1) c2(NP_001006641) c3(11382) c4(37496, 50553, 63610, 24439, 76667) c5(X, re, hV, nZ, i, I, iA, iR); #c1(TCEAL2) c2(NP_525129) c3(11383) c4(37497, 50554, 63611, 24440, 76668) c5(bj); #c1(TCEAL4) c2(NP_001287830) c3(11384) c4(37498, 50555, 63612, 24441, 76669) c5(hV, T, nV, b); #c1(TCEAL7) c2(NP_689491) c3(11385) c4(37499, 50556, 63613, 24442, 76670) c5(A, b, X, bu, cU, av, by, JY); #c1(TCEB1) c2(NP_001191793) c3(11386) c4(37500, 50557, 63614, 24443, 76671) c5(A, Mi, B, dB, P, T, VP, u, y); #c1(TCEB2) c2(NP_009039) c3(11387) c4(37501, 50558, 63615, 24444, 76672) c5(VP, RX, q, y); #c1(TCEB3C) c2(NP_663628) c3(11388) c4(37502, 50559, 63616, 24445, 76673) c5(qp); #c1(TCERG1) c2(NP_001035095) c3(11389) c4(37503, 50560, 63617, 24446, 76674) c5(ig, si); #c1(TCERGIL) c2(NP_777597) c3(11390) c4(37504, 50561, 63618, 24447, 76675) c5(l, bb, V, b, ad, T, cs, bf, U, aA, aM); #c1(TCFl2) c2(NP_003196) c3(11391) c4(37505, 50562, 63619, 24448, 76676) c5(agu, Al, V, cV, t, aNH, G, cKA, sX, U, bj); #c1(TCFl5) c2(NP_004600) c3(11392) c4(37506, 50563, 63620, 24449, 76677) c5(kF); #c1(TCFl9) c2(XP_005249391) c3(11393) c4(37507, 50564, 63621, 24450, 76678) c5(da, m, f, aE, ix, x, mD, aA, aV, jZ); #c1(TCF20) c2(NP_005641) c3(11394) c4(37508, 50565, 63622, 24451, 76679) c5(aA, A, u, asj, I); #c1(TCF21) c2(NP_003197) c3(11395) c4(37509, 50566, 63623, 24452, 76680) c5(d, dx, CD, aX, ip, b, cY, jk, F, du, DO, oE, dv, T, fy, jj, ar, at, e); #c1(TCF25) c2(NP_055787) c3(11396) c4(37510, 50567, 63624, 24453, 76681) c5(bb); #c1(TCF3) c2(NP_001129611) c3(11397) c4(37511, 50568, 63625, 24454, 76682) c5(A, b, pD, D, U, gT, y, QV, aX, t, B, bu, iv, oO, av, Hs, u, da, V, cV, J, by, G, jT, fp, TY, wV, ie, pa, fG, wP); #c1(TCF4) c2(NP_001230155) c3(11398) c4(37512, 50569, 63626, 24455, 76683) c5(by, f, b, Yq, X, ak, ahS, dB, aQR, ns, nJ, w, nt, ng, nr, nn, ct, no, np, hP, U, y, bkC, co, aX, Oi, aua, LI, q, bu, cU, bml, ar, B, A, cs, hV, av, ji, u, yd, ff, g, LK, hW, V, I, jH, agw, IM, J, cKB, ad, W, jo, ahO, T, Qt, QZ, gC, fT, hR, AP, Yp, ac, yQ, G, pS, KG, bm, hT, P, he, ex, aY, k, nm, fP, fl, I, nU, aOB, O); #c1(TCF7) c2(NP_001128323) c3(11399) c4(37513, 50570, 63627, 24456, 76684) c5(b, Ka, ct, bf, U, jT, bb, bqT, t, q, bu, dl, bKp, cs, aE, fh, mz, V, I, ad, W, T, cy, by, aM, cf, at); #c1(TCF7L1) c2(NP_112573) c3(11400) c4(37514, 50571, 63628, 24457, 76685) c5(by, nV, b, cV, t, ak, J, pD, gT, G, ac, oO, av, bu, u, y, QV); #c1(TCF7L2) c2(NP_001139746) c3(11401) c4(37515, 50572, 63629, 24458, 76686) c5(dx, f, Yq, dB, eH, w, bf, Mn, O, dv, t, bmI, aQd, g, mz, mm, yL, du, bp, ahO, x, jv, Yp, Ew, jE, dS, fN, we, aA, Ah, X, ahS, he, U, Oh, y, co, mI, ak, LI, bu, k, B, cs, av, bm, V, Fy, bQ, eX, Qt, iA, W, nc, P, nJ, vH, gA, ji, ap, hV, b, bhr, z, ey, gF, bb, nU, q, ar, ff, yW, u, aE, o, kF, I, cKB, ad, G, ct, et, jH, RS, pS, hT, mA, ex, fl, A, gU, pR, aQR, di, wf, hP, aW, bkC, aX, cU, yd, LK, hW, J, dt, jo, T, fT, by, ac, aM, KG, agw, fP, Oi, at); #c1(TCFL5) c2(NP_006593) c3(11402) c4(37516, 50573, 63630, 24459, 76677) c5(bb, t, nJ, W, G, w, T, bk, bq, jw, ac, oT); #c1(TCHH) c2(NP_009044) c3(11403) c4(37517, 50574, 63631, 24460, 76688) c5(bdX); #c1(TCHP) c2(XP_011537139) c3(11404) c4(37518, 50575, 63632, 24461, 76689) c5(by, A, bum, b, X, dD, gE, dB, O, w, cO, zK, U, aNa, e, y, V, d, RX, fe, co, aX, LI, kH, jd, h, f, q, jV, bu, cU, fr, pn, B, cB, cs, pB, av, fy, u, pR, kq, ff, g, EM, fU, tI, I, cV, Ib, YR, ft, qq, J, ct, po, ad, T, VP, buq, aYw, azo, M, avY, yG, cW, jE, KK, iy, bm, Ic, Fr, jo, agm, iT, cZ, re); #c1(TCIRG1) c2(NP_006044) c3(11405) c4(37519, 50576, 63633, 24462, 76690) c5(bsL, Yj, cnk, ajf, I, aF, zI, sE, zM, IX, akg, hZ, Co, cp); #c1(TCL1A) c2(NP_001092195) c3(11406) c4(37520, 50577, 63634, 24463, 76691) c5(b, jz, pD, oH, Iv, cO, y, jQ, Ag, bb, pp, t, h, f, q, beL, n, u, J, fO, gm, aoS, G, cK, jT, pi, cq, if, wV, alt, wP, cT, cKC); #c1(TCL1B) c2(NP_004909) c3(11407) c4(37521, 50578, 63635, 24464, 76692) c5(b, jz, pD, aN, oH, Iv, y, jQ, pp, h, f, q, beL, u, J, fO, gm, aoS, jT, cq, if, nV, alt, wP, cT, wV, cKC); #c1(TCN1) c2(NP_001053) c3(11408) c4(37522, 50579, 63636, 24465, 76693) c5(dx, A, b, qd, qa, xf, bo, jI, B, Vd, aq, o, dA, du, gm, P, GW, jG, nh, aQM, ih, at); #c1(TCN2) c2(NP_000346) c3(11409) c4(37523, 50580, 63637, 24466, 76694) c5(dx, bL, IJ, A, vg, cr, iX, mk, w, xf, sF, tG, U, bu, eV, aO, at, fh, avt, jd, Ns, cKE, LB, vu, ar, gP, cKD, Vd, aq, o, tE, g, iP, V, ae, du, gL, cz, W, vc, cd, LA, bb, jT, Ut, jH, nh, Nq, mx, fD, aA, apU, ap); #c1(TCOF1) c2(NP_000347) c3(11410) c4(37524, 50581, 63638, 24467, 76695) c5(Nq, KC, Am, f, WH, vq, ahc, re, nU, ahS, yH, Id, aNb, aMZ, ahO, fP, iT, Xt, AP, CG, dI); #c1(TCP10) c2(NP_004601) c3(11411) c4(37525, 50582, 63639, 24468, 76696) c5(at); #c1(TCP10L2) c2(NP_001138593) c3(11412) c4(37526, 50583, 63640, 24469, 76697) c5(qf, di); #c1(TCP11L1) c2(NP_060863) c3(11413) c4(37527, 50584, 63641, 24470, 76698) c5(P); #c1(TCP1) c2(NP_001008897) c3(11414) c4(37528, 50585, 63642, 24471, 76699) c5(A, ro, V, Io, U, aq); #c1(TCTA) c2(NP_071503) c3(11415) c4(37529, 50586, 63643, 24472, 76700) c5(Iv, i); #c1(TCTE1) c2(XP_011512640) c3(11416) c4(37530, 50587, 63644, 24473, 76701) c5(akL); #c1(TCTN1) c2(NP_001076006) c3(11417) c4(37531, 50588, 63645, 24474, 76702) c5(cKF); #c1(TCTN2) c2(NP_001137322) c3(11418) c4(37532, 50589, 63646, 24475, 76703) c5(cKG, r, vU); #c1(TCTN3) c2(NP_001137445) C3(11419) c4(37533, 50590, 63647, 24476, 76704) c5(cKH, beA, at); #c1(TDGF1) c2(NP_001167607) c3(11420) c4(37534, 50591, 63648, 24477, 76705) c5(ck, aw, b, X, wy, O, U, e, y, cp, d, aX, bu, oJ, cs, HE, av, fy, u, V, ad, T, x, cr, fp, wh, aai, iK, acw, DO, Eo, ag, cKI, at, eG); #c1(TDG) c2(NP_003202) c3(11421) c4(37535, 50592, 63649, 24478, 76706) c5(by, V, b, Dj, bp, bu, ad, iL, i, cs, U, aV); #c1(TDO2) c2(NP_005642) c3(11422) c4(37536, 50593, 63650, 24479, 76707) c5(ux, ak, Gt, b, jJ, aN, Ey, cKJ, aWt, cA, aqL, gZ, aK, xI, TC, vW, xw, aqC, ahj, rr, f, vu, cM, qu, bmf, o, zb, g, dj, hW, aqQ, qA, sH, cz, rQ, xv, sG, aY, tW, he, ih, qc, aal, rv, dc, Ah, bMH, FY); #c1(TDP1) c2(XP_006720263) c3(11423) c4(37537, 50594, 63651, 24480, 76708) c5(iw, ao, co, kW, b, bK, f, v, cb, hN, cI, KX, fy, kV, cKK, cq); #c1(TDP2) c2(NP_057698) c3(11424) c4(37538, 50595, 63652, 24481, 76709) c5(co, yQ, b, do, nJ, zm, fy, aes); #c1(TDRD1) c2(NP_942090) c3(11425) c4(37539, 50596, 63653, 24482, 76710) c5(A, aw, B, am); #c1(TDRD3) c2(NP_001139542) c3(11426) c4(37540, 50597, 63654, 24483, 76711) c5(KK, f, ho); #c1(TDRD5) c2(NP_001186020) c3(11427) c4(37541, 50598, 63655, 24484, 76712) c5(di); #c1(TDRD6) c2(NP_001010870) c3(11428) c4(37542, 50599, 63656, 24485, 76713) c5(cs, ad); #c1(TDRD7) c2(NP_001289813) c3(11429) c4(37543, 50600, 63657, 24486, 76714) c5(en, zr, zu, zH, X, iP, dB, w, bu, A, eV, zw, d, co, am, B, e, zx, zB, zA, fU, ae, cKL, by, vM, zE, er, ag); #c1(TDRD9) c2(NP_694591) c3(11430) 63658, 24487, 76715) c5(I, aC, ak, di, at, aE); #c1(TDRKH) c2(NP_001077433) c3(11431) c4(37545, 50602, 63659, 24488, 76716) c5(jG); #c1(TDRP) c2(NP_001243042) c3(11432) c4(37546, 50603, 63660, 24489, 76717) c5(bb, cV); #c1(TEAD1) c2(NP_068780) c3(11433) c4(37547, 50604, 63661, 24490, 76718) c5(ck, b, X, Lv, wy, w, VX, y, cfh, qs, co, aX, wP, re, f, q, v, O, A, av, fy, u, cKM, J, fO, FC, wV, P, od, bb, Lx, ao, aYm, QG, ag, aUt, bq); #c1(TEAD2) c2(NP_001243587) c3(11434) c4(37548, 50605, 63662, 24491, 76719) c5(kF); #c1(TEAD3) c2(NP_003205) c3(11435) c4(37549, 50606, 63663, 24492, 76720) c5(bb); #c1(TEAD4) c2(NP_003204) c3(11436) c4(37550, 50607, 63664, 24493, 76721) c5(wa, by, aq, bu); #c1(TEC) c2(XP_011512038) c3(11437) c4(37551, 50608, 63665, 24494, 76722) c5(aNH, pw, cV, q, dB, kB, P, do, T, n, iB, fP, VJ, u, ci, y); #c1(TECPR2) c2(NP_001166102) c3(11438) c4(37552, 50609, 63666, 24495, 76723) c5(cKN, v, bN); #c1(TECR) c2(NP_612510) c3(11439) c4(37553, 50610, 63667, 24496, 76724) c5(cKO, b, nU, bV, ss, hR); #c1(TECRL) c2(NP_001010874) c3(11440) c4(37554, 50611, 63668, 24497, 76725) C5(Io); #c1(TECTA) c2(NP_005413) c3(11441) c4(37555, 50612, 63669, 24498, 76726) c5(na, cKR, cKQ, cKP, Bx); #c1(TEF) c2(NP_001138870) c3(11442) c4(37556, 50613, 63670, 24499, 76727) c5(cA, ckP, bkm); #c1(TEFM) c2(NP_078959) c3(11443) c4(37557, 50614, 63671, 24500, 76728) c5(xr, xJ, AP, or); #c1(TEK) c2(NP_000450) c3(11444) c4(37558, 50615, 63672, 24501, 76729) c5(jK, aw, dB, vB, bf, ps, O, dv, mR, n, gD, og, aC, sH, gm, fx, FG, YA, i, bq, pJ, X, eu, IW, Fh, Iw, U, y, ed, mI, f, N, bu, cs, IS, av, fy, qw, V, Bs, IR, be, aH, gt, P, xe, b, aF, cKS, bb, eA, hV, q, fv, VM, jG, u, dh, fh, da, fs, I, bDv, by, IX, jU, nV, yC, Cr, cKT, fg, fl, g, A, k, tp, bDu, JC, bw, Ct, eb, cr, VD, h, sB, M, iZ, oJ, IP, mc, J, dU, jo, T, aX, fM, LI, qp, cKU, fP, at, eG, gf); #c1(TEKT1) c2(NP_444515) c3(11445) c4(37559, 50616, 63673, 24502, 76730) c5(iu); #c1(TEKT5) c2(NP_653275) c3(11446) c4(37560, 50617, 63674, 24503, 76731) c5(ck, cs, b, ad); #c1(TELO2) c2(NP_057195) c3(11447) c4(37561, 50618, 63675, 24504, 76732) c5(jh, jT, b, aC, nU, N, J, fO, bu, pt, oM, by); #c1(TENM1) c2(NP_055068) c3(11448) c4(37562, 50619, 63676, 24505, 76733) c5(V, b, ad, mk, cs, U, kD); #c1(TENM2) c2(NP_001116151) c3(11449) c4(37563, 50620, 63677, 24506, 76734) c5(IV, cV, b, cO); #c1(TENM3) C2(NP_001073946) c3(11450) c4(37564, 50621, 63678, 24507, 76735) c5(aw, V, b, kD, dd, bq, U, u, y, cKV); #c1(TENM4) C2(NP_001092286) c3(11451) c4(37565, 50622, 63679, 24508, 76736) c5(oy, bb, I, dA, u, ak, cy, di, o, cO, bf, et, Fg, ap); #c1(TEP1) c2(XP_005268084) c3(11452) c4(37566, 50623, 63680, 24509, 76737) c5(A, b, X, dB, w, z, e, O, d, co, bb, I, q, Mr, Dd, y, av, u, aO, ae, bp, jo, T, ca, nV, YQ, i, I, ap); #c1(TEPP) c2(NP_950247) c3(11453) c4(37567, 50624, 63681, 24510, 76738) c5(fP); #c1(TERF1) c2(NP_003209) c3(11454) c4(37568, 50625, 63682, 24511, 76739) c5(dM, b, k, Lq, jz, sJ, di, Iv, aun, eM, O, bRB, y, jQ, c, co, aX, iI, t, h, f, q, vQ, bu, cU, xI, iv, pB, jG, fy, u, n, g, I, Ib, ss, fO, J, bp, by, pr, G, Hq, T, II, bb, iA, cq, WZ, aYm, bm, B, cT, i, I, yA, eG, ap); #c1(TERF2) c2(NP_005643) c3(11455) c4(37569, 50626, 63683, 24512, 76740) c5(A, b, qd, eM, jz, Iv, aun, cO, U, fx, y, jQ, d, co, aX, f, e, q, bu, cU, B, iv, fP, fy, u, R, sz, V, I, cV, Ib, cs, J, fO, ad, P, T, Nh, bb, iA, by, WZ, jH, jT, aYm, ic, i, I, oM, yA, pt, ap); #c1(TERF2IP) c2(NP_061848) c3(11456) c4(37570, 50627, 63684, 24513, 76741) c5(f, b, X, w, A, e, aW, d, co, aX, ae, h, ak, F, q, nv, bu, arR, y, cs, av, fy, u, mz, og, I, cV, aC, cM, by, T, bb, pF, nV, st, sS, aY, byf, B, ag, cT, fP, dc, aA, pv, ap); #c1(TERT) c2(NP_001180305) c3(11457) c4(37571, 50628, 63685, 24514, 76742) c5(dx, f, aw, aAB, bx, cKY, dB, Ip, w, PM, CP, O, e, xI, jR, dv, cy, iR, t, dI, ji, tE, Rh, bsP, Zv, R, g, fe, aeM, ajc, Ib, zv, du, aow, bp, ft, fx, jT, gg, pq, pb, Lz, bm, ie, ag, cT, iT, i, jC, Dr, cKW, iI, X, DO, oa, jz, eu, kB, fU, cjY, IW, cq, bw, U, y, yt, co, pp, ss, hg, vQ, bu, QP, k, B, cs, av, fy, pP, cKZ, QD, jM, V, aXd, sn, n, gv, pr, Hq, bt, Qt, cl, iA, YU, GB, aen, py, QG, kJ, nJ, ajG, tI, ar, ci, ap, gG, WH, ck, b, GL, cKX, cjX, oi, ic, z, d, jh, bb, aJB, fv, jd, re, hV, q, jV, ra, bTt, ff, pB, dQ, jG, u, cl, jj, VD, LR, gL, ad, auF, aHG, nk, aZ, ct, aeC, Dd, et, Lt, WZ, jH, nV, Eu, hX, eT, mA, fI, I, yA, A, IO, aun, qd, fr, Lv, gE, BY, og, xf, C, iL, eM, bRB, jQ, QV, Ez, aX, or, h, F, cU, aC, ik, oJ, cB, aYQ, ma, cV, YR, J, gm, W, P, T, fO, Oi, jI, nP, by, fM, VF, qp, st, ip, G, amS, fP, Lr, bh, cLa, at, eG, Bi); #c1(TESC) c2(NP_001161797) c3(11458) c4(37572, 50629, 63686, 24515, 76743) c5(dx, aEg, b, w, di, e, y, d, qs, dv, aX, h, f, ff, iv, fy, u, g, fU, ze, du, J, dt, ME, co, T, iy, fx, et, Xw, iY, Xu, jo, jR, aeP, i, ji); #c1(TES) c2(NP_056456) c3(11459) c4(37573, 50630, 63687, 24516, 76744) c5(dx, fe, A, b, du, jI, J, in, bu, by, dv, G, w, jT, B, at, u, y); #c1(TESPA1) c2(NP_001129502) c3(11460) c4(37574, 50631, 63688, 24517, 76745) c5(bb); #c1(TET1) c2(NP_085128) c3(11461) c4(37575, 50632, 63689, 24518, 76746) c5(azt, wh, V, b, aC, h, N, q, he, J, o, u, y, oJ); #c1(TET2) c2(NP_001120680) c3(11462) c4(37576, 50633, 63690, 24519, 76747) c5(afE, aw, b, zh, dB, pz, A, NH, pK, eM, JE, aiF, ps, y, yt, M, Vh, aX, kT, t, h, B, N, n, jV, gT, cU, O, iv, Tr, kX, jG, hD, Eg, pH, cj, aiH, JI, fe, aKq, G, hf, pF, gm, fO, J, P, bM, Q, acb, Vm, Tp, iA, oV, wd, pc, pq, iw, jT, NG, hX, u, MP, pj, cT, qP, fg, aqn, ej, pJ, jI, ci, pv); #c1(TET3) c2(XP_005264244) c3(11463) c4(37577, 50634, 63691, 24520, 76748) c5(qf, b, h, N, q, oJ, wh); #c1(TEX101) c2(NP_001123483) c3(11464) c4(37578, 50635, 63692, 24521, 76749) c5(bb, b, tI); #c1(TEX11) c2(NP_001003811) c3(11465) c4(37579, 50636, 63693, 24522, 76750) c5(wn, NT); #c1(TEX14) c2(NP_001188386) c3(11466) c4(37580, 50637, 63694, 24523, 76751) c5(wn, NT, u, Lt, y); #c1(TEX15) c2(NP_112561) c3(11467) c4(37581, 50638, 63695, 24524, 76752) c5(wn, NT); #c1(TEX264) c2(NP_001230655) c3(11468) c4(37582, 50639, 63696, 24525, 76753) c5(fI); #c1(TEX29) c2(NP_689537) c3(11469) c4(37583, 50640, 63697, 24526, 76754) c5(at, ho, cO); #c1(TEX30) c2(NP_001273705) c3(11470) c4(37584, 50641, 63698, 24527, 76755) c5(W, Oi, T); #c1(TEX35) c2(NP_001164193) c3(11471) c4(37585, 50642, 63699, 24528, 76756) c5(q); #c1(TEX40) c2(NP_001034585) c3(11472) c4(37586, 50643, 63700, 24529, 76757) c5(av); #c1(TFAM) c2(NP_001257711) c3(11473) c4(37587, 50644, 63701, 24530, 76758) c5(gB, b, JS, X, awR, IM, aoJ, dk, hM, cO, bf, U, bj, y, co, bb, kW, f, oD, av, buB, u, o, aNN, iF, ma, V, I, acU, awT, aIa, eX, HL, Nh, cK, jT, aM, aO, QJ, uJ, fN, hT, ay, I, bq, vL); #c1(TFAP2A) c2(NP_001027451) c3(11474) c4(37588, 50645, 63702, 24531, 76759) c5(IJ, mI, Ir, b, k, X, dB, A, O, U, e, y, d, aX, kJ, AP, h, f, F, eE, cY, ar, bVr, cB, bVs, av, pq, u, iF, V, cs, ct, ad, jG, T, x, Fr, et, Yp, JY, wz, DO, cK, B, ag, Ns, XG, od, zg); #c1(TFAP2B) c2(NP_003212) c3(11475) c4(37589, 50646, 63703, 24532, 76760) c5(ats, eX, dB, gZ, y, co, aX, ak, AK, NJ, ar, cM, cB, fy, cLb, I, dA, bp, AP, EE, aY, u, arJ, DO, ih, XH, dc, ji, aA, at); #c1(TFAP2C) c2(NP_003213) c3(11476) c4(37590, 50647, 63704, 24533, 76761) c5(wh, aX, f, wV, bu, cU, wP, BY, T, oJ, bb, u, y); #c1(TFAP4) c2(NP_003214) c3(11477) c4(37591, 50648, 63705, 24534, 76762) c5(U, q, V); #c1(TFB1M) c2(NP_057104) c3(11478) c4(37592, 50649, 63706, 24535, 76763) c5(bj, o, I, k); #c1(TFB2M) c2(NP_071761) c3(11479) c4(37593, 50650, 63707, 24536, 76764) c5(bj, o, k); #c1(TFCP2) c2(NP_001166924) c3(11480) c4(37594, 50651, 63708, 24537, 76765) c5(cA, P, agw, v, o); #c1(TFDP1) c2(XP_005268384) c3(11481) c4(37595, 50652, 63709, 24538, 76766) c5(d, co, jI, X, q, bp, aN, o, ct, fy, u, e, y); #c1(TFDP2) c2(NP_001171609) c3(11482) c4(37596, 50653, 63710, 24539, 76767) c5(Dr, V, X, re, q, cB, U, et, fD, iT); #c1(TFDP3) c2(NP_057605) c3(11483) c4(37597, 50654, 63711, 24540, 76768) c5(ck, bm, q); #c1(TFE3) c2(NP_006512) c3(11484) c4(37598, 50655, 63712, 24541, 76769) c5(b, pR, dB, bPd, aHJ, bf, ey, azD, hh, bPc, QV, eX, apB, ar, ff, VM, em, fe, nQ, cV, jo, T, BW, Vw, jT, aM, aiw, sg, zI, adu, bOT, kD, yC); #c1(TFEB) c2(NP_001161299) c3(11485) c4(37599, 50656, 63713, 24542, 76770) c5(Vw, aX, Kz, eX, dB, LG, aN, wz, jo, w, T, kD, z, bi, aA, at, aK, ff); #c1(TFEC) c2(NP_001018068) c3(11486) c4(37600, 50657, 63714, 24543, 76771) c5(m, fI, kD); #c1(TFF1) c2(NP_003216) c3(11487) c4(37601, 50658, 63715, 24544, 76772) c5(sa, A, ahd, b, bx, X, gG, Dm, aN, ig, Em, U, aK, e, y, Ne, d, ag, bb, pp, eA, ja, B, q, bu, hN, ar, Mr, cB, cs, bv, gg, u, o, jH, pS, E, iI, iw, MT, ct, ad, BZ, ee, P, uF, T, gN, aZ, cl, nP, by, et, zp, XR, W, IZ, py, kJ, eB, XP, zk, fP, Af, i, I, af, jU); #c1(TFF2) c2(NP_005414) c3(11488) c4(37602, 50659, 63716, 24545, 76773) c5(Ir, bt, b, bx, gG, bw, e, y, d, cy, eA, bu, ar, cs, aD, kN, u, o, iI, gL, by, BZ, T, aZ, x, JY, jH, ag, fP); #c1(TFF3) c2(NP_003217) c3(11489) c4(37603, 50660, 63717, 24546, 76774) c5(by, f, b, ig, A, gE, U, iA, y, gO, d, Wp, Dx, Bi, hV, e, q, bu, cU, aoe, B, cs, qj, u, qy, V, iI, ad, W, I, T, Bd, Oi, x, ct, aVd, BV, et, jU, jH, aH, nV, ag, og, fP, i, abE, zS, af, bT); #c1(TFG) c2(NP_001007566) c3(11490) c4(37604, 50661, 63718, 24547, 76775) c5(qZ, jT, nV, aX, cN, cG, cY, hV, aNH, QV, qP, cLc, kB, w, fI, B, z, cLd, og, A, O); #c1(TF) c2(XP_011511402) c3(11491) c4(37605, 50662, 63719, 24548, 76776) c5(gK, A, b, fN, ia, aN, w, eO, aK, aW, yK, Ag, aX, Iz, zo, bn, bj, cLe, B, q, jV, cy, aC, y, aNC, fy, u, dh, o, bk, yJ, fh, bm, I, Ib, yO, v, gV, J, W, T, bp, bq, bb, bd, cz, pi, mO, pq, nV, g, ch, aY, fP, Af, VT, I, ji, aA, Vs, Xe, ap); #c1(TFIP11) c2(XP_011528381) c3(11492) c4(37606, 50663, 63720, 24549, 76777) c5(da, hW, V, b, fq, Tp, uB, W, ag, kC, T, cs, fP, U, ad); #c1(TFPI2) c2(NP_001257933) c3(11493) c4(37607, 50664, 63721, 24550, 76778) c5(dx, by, A, b, cY, Lv, wy, jc, w, J, O, bw, U, VX, y, qs, co, aX, kJ, jd, Lx, re, f, q, bu, X, ik, B, hb, cs, ar, av, fy, u, o, wP, g, fs, V, iI, cV, aC, du, FC, bp, v, W, afz, P, dv, T, fO, bb, fT, ad, fv, ao, wV, aJV, ck, os, ag, bkt, iT, od, ap); #c1(TFPI) c2(NP_001027452) c3(11494) c4(37608, 50665, 63722, 24551, 76779) c5(dx, mi, dN, dB, Eh, e, dv, cy, azb, Me, sL, Pv, R, sH, du, Ej, YT, fx, bpY, dS, Yw, sS, DO, vK, i, bq, bP, id, iP, hS, U, y, co, rY, fm, f, cs, bm, iT, V, fC, Tn, gv, aR, tj, mF, pi, fD, vj, ake, b, ia, qz, qa, sU, ey, pI, d, bb, kW, re, q, ar, u, dh, be, ad, jU, eQ, fI, aMI, iL, bj, jx, aX, F, aJQ, Fs, bd, gV, P, T, gF, cz, at, YX, Ic, cLf, bh, eN, gf); #c1(TFPT) c2(NP_037474) c3(11495) c4(37609, 50666, 63723, 24552, 76780) c5(mI); #c1(TFR2) c2(NP_001193784) c3(11496) c4(37610, 50667, 63724, 24553, 76781) c5(bm, b, k, aHH, att, bGx, di, z, aI, aW, yK, qf, t, h, q, n, iv, jG, pP, aJe, aC, yO, J, G, pq, u, uH, bk, yM, bh, aVh, ci); #c1(TFRC) c2(NP_003225) c3(11497) c4(37611, 50668, 63725, 24554, 76782) c5(dx, jK, aHH, dB, KF, cO, cLh, bf, ps, e, O, dv, iy, t, sL, cl, kX, pq, g, cLi, Ib, yL, iv, yO, bp, asH, fx, jT, cq, qt, pP, yE, cT, i, aA, sa, fI, X, ig, kY, U, y, V, co, f, N, cc, cs, av, bm, ye, iT, cj, d, vR, CZ, ae, Bs, Xo, Oj, cLg, gv, yN, er, jR, gA, yM, ci, b, jL, yK, jh, Ro, jd, re, q, jV, jG, u, kF, I, ad, rw, pD, jU, hX, Ck, fI, I, aU, Vs, aVh, A, k, gN, ea, iL, gE, asQ, aI, awK, aX, aci, h, F, M, n, cB, pE, du, nQ, cV, J, W, dU, P, fO, jI, aM, bQ, aBz, bh, at, oT); #c1(TGFA)

c2(NP_001093161) c3(11498) c4(37612, 50669, 63726, 24555, 76783) c5(B, iD, dB, vB, Ip, w, e, xI, PP, Be, auW, LN, zH, bjD, btJ, fe, Ib, nI, sH, bp, ft, zU, od, cV, x, fx, jT, av, atn, jE, aEs, DO, ag, aA, Dr, azz, fI, fi, X, aY, iP, ig, kY, IW, bw, U, y, co, ip, aof, aAa, f, vQ, bu, gX, O, cs, gg, fy, bm, iT, d, jB, vR, V, Dp, VP, iA, pi, gt, P, jd, QI, tI, ji, apU, ck, b, NB, kN, jV, hh, jh, bb, Ox, eA, Be, hV, q, aVM, vu, ar, ff, as, HE, u, rX, da, bkD, iI, qL, LR, ad, aKO, Lc, cLj, aZ, et, Eu, agb, gd, Ns, bL, A, k, fr, pR, og, HS, iL, gE, aI, hP, MT, aX, qn, F, cU, aC, Gs, rR, jZ, bpz, Lg, oS, an, yE, W, jo, uF, T, nP, by, qp, hq, Nq, amS, fP, Yv, bh, rr, Ga); #c1(TGFB1) c2(NP_000651) c3(11499) c4(37613, 50670, 63727, 24556, 76784) c5(mI, dB, aPi, Ip, baB, JH, pz, e, cp, gM, vr, amY, LL, kJ, dI, asA, mR, zb, TP, xc, fe, aC, ft, cFm, bdS, JN, AL, vz, Dz, tO, ag, axC, pH, bk, fD, acM, bq, aA, asL, if, X, vD, eu, ig, sF, bw, vI, cM, bBZ, bi, yX, ps, aoM, ak, aFQ, av, CX, fY, zO, is, fi, vR, V, ae, nI, cd, IR, aDI, bxI, jC, J, aRS, fJ, xd, aY, aSm, rr, ji, bwi, aG, ck, cLm, Hr, vY, Ag, Xy, tg, oO, cbS, pY, aE, cl, da, Jn, fs, iI, Mi, bc, gL, ad, bIF, wL, fH, ao, nV, mA, zX, Ns, fg, aOB, zD, vd, fr, pR, Jo, gn, gN, EN, IE, jc, C, iL, gE, zK, PI, jw, jQ, fG, aso, or, aQk, tL, amK, aHY, oJ, bRS, Jk, HP, NO, dj, Ea, aZd, be, bd, bR, aAa, Zw, ED, bnn, Jh, Ic, a km, fP, E, dx, jK, dM, vk, sd, ud, cLo, eH, vp, adL, O, at, cU, bQ, aca, yh, Cp, Zv, Oe, ng, aeM, du, yO, gm, bp, x, aCP, fp, wh, qt, adr, aWQ, cLk, mD, te, bT, sU, bP, wa, fI, iP, LM, oH, mk, ix, Ku, U, Di, aTF, co, BL, sT, f, aDD, fh, bu, tv, azi, bOB, NZ, gv, ny, cl, gH, aH, eF, hp, SR, bkU, VW, pv, WH, wj, anh, am, Pv, z, IS, d, bb, jd, q, ra, mL, ff, Dq, ar, aM, iR, o, kF, VD, qL, jz, LR, dT, aZ, ct, wd, Ut, jU, jH, Eu, ch, GM, apt, gd, fl, ws, bRq, gU, xj, 1k, JC, aI, Ir, bn, wN, hN, pN, cLq, aq, ez, tp, atI, T, II, bgw, nk, vW, DI, iB, gf, eX, aw, Fk, dN, DT, Ka, eD, aDx, aKf, aD, kX, ha, p, fO, iU, vc, vM, fx, hR, fy, rS, bhN, bY, m, cT, xb, sa, fE, cLn, kB, aer, NH, bf, aSh, bC, Ei, DM, B, bv, oD, gg, iT, yJ, v, bt, aGa, cy, iA, fw, zS, iu, adJ, bW, b, aF, tN, tG, Fr, aem, aiT, re, hV, vu, n, ri, Zz, brq, IX, wx, et, Lt, hU, hT, Bg, ex, IS, Bm, rC, aKO, adK, xf, Iv, vg, eM, wf, qs, sG, biG, HY, pC, ik, sV, wo, Be, GS, Dw, W, ti, jI, cft, NG, bgV, Yv, ap, eG, ja, gK, iq, zw, bx, aGV, gG, aN, sJ, w, bV, cO, Ux, Na, dv, hH, oS, t, Si, bPP, JF, Hs, cLI, cB, sH, gJ, Ij, gY, od, Lz, jT, dL, dH, ata, fN, os, cLp, yE, i, dc, aRK, azR, id, anY, LD, ma, IW, Co, aaV, jb, ip, cV, vQ, bQy, cs, bm, em, ali, jh, sw, cK, pi, wu, er, aDL, TQ, Im, ci, An, QB, vh, yU, ic, Df, td, ey, gZ, aO, Iz, zJ, bX, jV, Zx, se, dQ, aRY, jG, Tv, u, nj, wR, PJ, bU, a J, I, by, BZ, Io, rd, aos, eQ, Bu, he, cC, I, vf, bL, A, xa, HJ, Sf, di, gG, oy, e, aX, kn, fq, h, F, atx, qr, Dd, y, sX, nA, aV, jZ, fU, si, abA, GB, P, j, Oi, pw, qe, arD, Lc, Nq, avl, axg, bh, aT); #c1(TGFB111) c2(NP_001035919) c3(11500) c4(37614, 50671, 63728, 24557, 76785) c5(pM, A, aw, b, LD, Mi, B, wn, Qj, eG); #c1(TGFB2) c2(NP_001129071) c3(11501) c4(37615, 50672, 63729, 24558, 76786) c5(dx, B, aw, sd, ud, eG, eW, sJ, w, bV, Ux, e, O, bQ, cy, iR, fp, mR, aD, aC, wo, ft, cLr, jT, av, AL, bbb, ag, fD, ch, bq, aA, bP, X, vD, ig, xU, y, atj, sT, DM, f, cs, gg, fy, azi, apN, ae, du, er, jR, tI, aFf, wI, aG, cLt, b, cpp, Hr, xg, ha, eV, Mr, d, Qu, gz, aZV, q, ar, DY, aos, fs, ad, wL, Io, et, jH, ao, kB, u, DR, Bu, eo, A, fr, HJ, IE, bry, xa, aI, DK, m, aX, Qm, fU, ez, cV, AD, T, mk, cr, cfi, AP, rM, eG, DLI, bh, cLs, LQ, ID rZ); #c1(TGFB3) c2(NP_003230) c3(11502) c4(37616, 50673, 63730, 24559, 76787) c5(dx, A, td, b, cpp, X, sd, vD, ud, xj, kB, sJ, di, bW, aw, aI, y, at, m, aX, or, gz, aG, cU, ar, B, av, aoj, u, azi, oJ, fU, V, aC, sH, du, cLv, bp, cBh, cLu, T, cd, ji, fy, Bh, et, gg, jH, wh, nV, ig, eQ, Nq, eo, Ns, amS, tl, bh, aA, apU, bwi, rZ); #c1(TGFB1) c2(NP_000349) c3(11503) c4(37617, 50674, 63731, 24560, 76788) c5(dx, A, b, X, pR, gw, cLz, fI, cLD, bw, U, ha, bXs, bFL, O, jh, co, cLx, sG, aK, vf, q, Iq, cLB, Mr, B, av, cLw, cLA, LK, adK, cV, aC, du, cLC, Ij, j, gv, T, bol, eq, ji, aX, et, gg, aOB, aPK, iR, Jh, Ic, vH, cLy, bwo, bh, aT, at, bp); #c1(TGFBR1) c2(NP_001124388) c3(11504) c4(37618, 50675, 63732, 24561, 76789) c5(gK, dN, ud, Tw, bV, bf, ajf, e, cy, kJ, t, zb, Hs, n, aC, Xc, wo, bp, ft, vc, x, fx, jT, su, AL, wh, brP, cT, i, jI, id, X, eu, mk, ix, sF, IW, Iw, U, y, co, ag, DM, B, bu, brO, cs, av, fy, azi, iT, yJ, V, cd, bfx, YU, er, gO, T, CA, ap, aua, bW, b, DJ, ic, z, d, bh, re, nU, q, ar, ff, u, amO, wR, P J, j, ad, et, Bm, I, yA, bL, A, fr, ate, di, bw, alm, al, yw, m, cr, or, h, F, Ex, oJ, fU, be, yE, W, My, yk, aX, by, rM, Jh, Nq, DI, brK, bh, cLs); #c1(TGFBR2) c2(NP_001020018) c3(11505) c4(37619, 50676, 63733, 24562, 76790) c5(gK, B, aw, sd, gG, ud, dB, bbb, Ty, bV, vp, pz, e, xI, brF, cy, kJ, t, zb, ik, aeM, Xc, wo, gm, bp, vc, Ce, x, jT, gg, su, AL, aXz, K, brP, cT, fD, nU, jI, bT, XH, iI, X, jj, fU, sF, IW, bw, U, Co, y, co, pp, ag, cLF, f, bu, O, brJ, cs, av, fy, azi, is, Ke, V, cd, IR, bav, AF, Qt, iA, pi, W, dP, fw, cLG, tl, ji, ci, ap, bhI, afE, bW, b, GK, cLE, AK, d, jh, bh, aiT, jd, aua, q, es, ar, u, amO, PJ, I, j, ad, IX, rw, aYw, et, os, jU, yG, jH, nV, tW, jc, GM, Sk, IS, Bm, gl, vf, brL, bL, A, BY, di, al, yw, oy, c, aX, or, sG, ja, F, cU, Ex, n, cB, qB, Ek, QJ, ma, qO, m, J, GB, My, T, cr, by, AP, ip, ON, bq, Jh, Nq, zM, brK, bh, at, rZ); #c1(TGFBRAP1) c2(NP_001136093) c3(11506) c4(37620, 50677, 63734, 24563, 76791) c5(jh, il, V, b, f, jD, ik, uz, vp, U, u, al, y); #c1(TG) c2(NP_003226) c3(11507) c4(37621, 50678, 63735, 24564, 76792) c5(Dr, bzf, aw, cLI, b, xO, Sc, LF, mW, ig, cLJ, hM, Bd, cLM, cDc, bf, jw, G, cLL, m, fl, og, cDb, t, hV, asY, dl, ra, FN, ar, aE, cB, fP, cLH, aq, nj, biT, pE, Dt, yV, VD, jH, bxJ, pk, gL, cz, W, bfE, bxD, nV, T, aYz, auA, nP, Ap, aM, iw, aCq, baa, Lz, ii, xL, auH, P, iq, gl, IN, boD, cLK, abE, bfy, iu); #c1(TGIF1) c2(NP_001265611) c3(11508) c4(37622, 50679, 63736, 24565, 76793) c5(d, bC, bU, aso, Ym, aai, FR, bPw, aCb, he, W, cc, i, bPL, Bu, fx, e, Rb); #c1(TGIF2-C20orf24) c2(NP_001186464) c3(11509) c4(37623, 50680, 63737, 24566, 76794) c5(Oi, jR, aai); #c1(TGIF2) c2(NP_001186444) c3(11510) c4(37624, 50681, 63738, 24567, 76795) c5(Oi, jR, aai); #c1(TGIF2LX) c2(NP_620410) c3(11511) c4(37625, 50682, 63739, 24568, 76796) c5(oy, jw, A, B, wp); #c1 (TGM1) c2(NP_000350) c3(11512) c4(37626, 50683, 63740, 24569, 76797) c5(acE, A, aw, sd, mk, cLN, z, yi, e, d, co, dw, pp, TF, B, je, jV, bty, Me, TG, cLP, NB, fy, o, da, cLQ, fU, si, buV, bjB, v, bp, fq, bnH, mF, JI, i, btH, I, aEQ, rZ, iE, cLO); #c1(TGM2) c2(NP_945189) c3(11513) c4(37627, 50684, 63741, 24570, 76798) c5(f, aw, dB, w, bV, bf, ca, xl, IB, cy, kJ, t, mR, apz, g, mz, bK, fx, dL, ag, PG, cY, eu, bJI, ig, bw, U, y, co, BL, ak, e, O, av, fy, V, v, VP, Fr, aaa, er, nJ, B, cf, iu, wj, biZ, b, Hr, Qv, cLR, BQ, d, bh, jd, asn, gz, q, jV, X, ar, jG, u, dh, fs, ZA, I, G, JI, jH, ao, iR, aE, Xm, QU, acE, A, Ik, HJ, di, aX, aBd, qr, ik, Jk, QJ, LK, si, ez, cV, btI, W, T, II, nP, hW, aM, Y, btO, pZ, PS, bh); #c1(TGM3) c2(NP_003236) c3(11514) c4(37628, 50685, 63742, 24571, 76799) c5(d, da, si, il, b, fq, e, mk, ik, tl, u, JI); #c1(TGM4) c2(NP_003232) c3(11515) c4(37629, 50686, 63743, 24572, 76800) c5(wn, vl, A, B); #c1(TGM5) c2(NP_004236) c3(11516) c4(37630, 50687, 63744, 24573, 76801) c5(da, mi, cLS, fq, bp, mk, rw, aGa, kV); #c1 (TGMG) c2(NP_001241663) c3(11517) c4(37631, 50688, 63745, 24574, 76802) c5(cLT, mi, bK, h, bJI, m bb, kV); #c1(TGM7) c2(NP_443187) c3(11518) c4(37632, 50689, 63746, 24575, 76803) c5(u, y); #c1(TGOLN2) c2(NP_001193770) c3(11519) c4(37633, 50690, 63747, 24576, 76804) c5(dj, iq, aeq, cM); #c1(TGS1) c2(NP_079107) c3(11520) c4(37634, 50691, 63748, 24577, 76805) c5(co, eu, b, cV); #c1(THADA) C2(NP_001077422) c3(11521) c4(37635, 50692, 63749, 24578, 76806) c5(cU, A, kF, I, bvY, Ns, W, P, bQ, T, Bd, bf, aA, aM); #c1 (THAP10) c2(NP_064532) c3(11522) c4(37636, 50693, 63750, 24579, 76807) c5(u, y); #c1(THAP11) c2(NP_065190) c3(11523) c4(37637, 50694, 63751, 24580, 76808) c5(cs, bm, q, ad); #c1(THAP1) c2(NP_060575) c3(11524) c4(37638, 50695, 63752, 24581, 76809) c5(bAq, aOX, bA, cLU, WA, bj, aGR, bAu, akD, bDS, aVk, bM, Wy, aVc, Wz); #c1(THAP2) c2(NP_113623) c3(11525) c4(37639, 50696, 63753, 24582, 76810) c5(at); #c1 (THAP6) c2(NP_653322) c3(11526) c4(37640, 50697, 63754, 24583, 76811) c5(cO); #c1(THBD) c2(NP_000352) c3(11527) c4(37641, 50698, 63755, 24584, 76812) c5(dx, gK, B, iU, Eh, fR, e, cp, dv, cy, AX, aDx, eE, tE, aUM, sH, du, Ej, gs, fx, hR, buh, qt, hx, tO, i, mD, qD, DR, rn, id, X, vD, ix, iG, bC, co, amo, f, bu, av, fy, iT, wK, fD, cd, bqw, aR, bq, cLV, xd, ahT, aH, dO, Eb, fw, ap, b, aF, jL, pi, aO, d, bb, re, q, jV, cLW, dQ, dh, o, wY, bU, ob, bc, by, et, eV, ch, eQ, vP, fl, xf, bL, A, TQ, di, iV, JC, eM, m, aX, I, h, aC, Cz, be, T, Ic, aGB, bh, at, gf); #c1(THBS1) c2(NP_003237) c3(11528) c4(37642, 50699, 63756, 24585, 76813) c5(dx, B, sd, sE, dB, sA, Ip, w, Dy, Eh, aJE, e, O, bQ, jD, iR, aZv, eE, aJP, Xi, kX, Hs, mz, og, ajc, lb, bK, sH, du, fO, bp, ft, aiL, fx, hR, Iq, rS, tO, ag, cT, i, aCQ, bq, aA, afd, cY, cO, jz, bf, bw, U, y, co, pp, yX, f, bu, gX, aaZ, cs, vo, oD, av, fy, bm, iT, QD, V, Bs, IR, dv, jC, iA, PJ, xd, kJ, cLX, nb, aen, er, P, jR, vH, Xk, aEQ, ap, b, zH, Xj, oi, DX, ey, BQ, d, jh, bb, ra, jd, re, hV, q, jV, Cu, ar, VM, fv, u, dh, Id, qL, j, ad, IX, cW, nV, Eu, ch, DR, cLY, Sk, gd, IS, dn, Jh, aiX, bL, fr, A, asx, bBV, IW, gn, BY, Iv, JC, wf, ji, JK, jQ, pA, aX, Tq, aOT, cU, aC, oJ, aV, Xc, ma, cV, be, J, W, jo, T, II, bh, aHJ, by, ciu, aM, jT, DG, eG, atJ, Ic, Af, XO, X, at, Nu, rZ); #c1(THBS2) c2(NP_003238) c3(11529) c4(37643, 50700, 63757, 24586, 76814) c5(dx, jp, A, aw, b, X, aiu, Dn, eu, aDg, di, bV, cO, O, aEe, e, y, d, aX, pp, Bc, re, f, cU, gX, EA, B, cs, ar, av, fy, u, fY, oJ, I, du, fO, ad, W, T, eX, bq, iA, dS, aRz, sS, iT, fD, aiL, yA, at, rC); #c1(THBS3) c2(NP_001239537) c3(11530) c4(37644, 50701, 63758, 24587, 76815) c5(fr, ft); #c1(THBS4) c2(NP_003239) c3(11531) c4(37645, 50702, 63759, 24588, 76816) c5(dx, b, X, aN, di, U, aK, ed, dv, bb, f, ar, o, V, sH, du, W, bkX, T, cy, aUd, tO, fD, bq, at, ap); #c1(THEG) c2(NP_057669) c3(11532) c4(37646, 50703, 63760, 24589, 76817) c5(pM, g, US, ck, aX, cqR, b, cV, X, t, G, bu, by, wn, am, rv, iv, bb, av, PX); #c1(THEM4) c2(NP_444283) c3(11533) c4(37647, 50704, 63761, 24590, 76818) c5(co, I, q, w, fv, O); #c1 (THEM5) c2(NP_872384) c3(11534) c4(37648, 50705, 63762, 24591, 76819) c5(fN); #c1(THEM6) c2(NP_057731) c3(11535) c4(37649, 50706, 63763, 24592, 76820) c5(O, V); #c1(THEMIS2) c2(XP_011540747) c3(11536) c4(37650, 50707, 63764, 24593, 76821) c5(b, X, J, cU, Bc, av, u, iA, y); #c1(THEMIS) c2(NP_001010923) c3(11537) c4(37651, 50708, 63765, 24594, 76822) c5(b, bF, iU, aE, ig, cK, aA, u, Mp); #c1(THG1L) c2(NP_060342) c3(11538) c4(37652, 50709, 63766, 24595, 76823) c5(Hs, f); #c1(TH) c2(NP_000351) c3(11539) c4(37653, 50710, 63767, 24596, 76824) c5(gK, ak, pV, ns, nm, nt, ng, nr, cO, bf, no, np, vr, jT, cy, GL, zb, bfi, Qx, aOb, bK, sH, bmh, Jj, hR, AA, K, dc, pt, aA, nn, hS, bmf, cM, f, bu, B, adf, ajs, yY, la, nu, cx, eX, afb, bq, VP, rK, aum, QG, cf, aXb, oM, bAp, ap, b, acE, bg, wZ, bb, adv, nU, q, es, Pc, sR, aM, aE, o, fh, kF, I, qA, Jt, KL, cz, aAF, Tv, aOO, ch, hT, fl, di, wR, a kD, QU, de, A, Pb, ds, HS, pu, bj, oy, qs, Tq, sG, xJ, avW, bAr, tF, qB, aV, dj, hW, tP, cV, P, cIB, II, by, Sp, vu, bM, Fp); #c1(THNSL1) c2(NP_079114) c3(11540) c4(37654, 50711, 63768, 24597, 76825) c5(di); #c1(THNSL2) c2(NP_001231605) c3(11541) c4(37655, 50712, 63769, 24598, 76826) c5(aC, zv, vl); #c1(THOC1) c2(NP_005122) c3(11542) c4(37656, 50713, 63770, 24599, 76827) c5(co, aw, b, fv, X, Qf, ak, gL, ag, A, ar, B, bw, av, u, y); #c1(THOC2) c2(NP_001075019) c3(11543) c4(37657, 50714, 63771, 24600, 76828) c5(DH, cM); #c1(THOC5) c2(NP_001002878) c3(11544) c4(37658, 50715, 63772, 24601, 76829) c5(jG, J); #c1(THOC6) c2(NP_001135822) c3(11545) c4(37659, 50716, 63773, 24602, 76830) c5(cLZ); #c1(T) c2(NP_001257413) c3(11546) c4(37660, 50717, 63774, 24603, 76831) c5(d, iY, cMb, cMa, T, e); #c1 (THOPI) c2(NP_003240) c3(11547) c4(37661, 50718, 63775, 24604, 76832) c5(fe, gk, b, B, ak, iZ, cd, xs, cT, aaS, T, co, fK, OG, aV, A); #c1(THP0) c2(NP_001276932) c3(11548) c4(37662, 50719, 63776, 24605, 76833) c5(gK, jK, f, iq, hM, bLr, pz, kT, t, AX, kX, sH, bp, nV, jT, cMe, pq, xO, ie, tO, cT, fD, afK, bq, X, eu, yV, Ei, i, Wn, ak, N, vQ, Em, JX, iv, fg, bm, cj, jB, CZ, gv, pt, cK, arJ, oM, iu, ci, pv, b, aGk, aF, z, CL, hV, q, ap, biU, jG, nj, biT, VD, pF, bPb, G, iw, L, pe, cMd, Sc, gE, pu, eM, brx, al, h, M, hN, n, HP, dj, Ea, hZ, J, P, T, bKF, ii, cMc, bh, at); #c1(THRA) c2(NP_001177847) c3(11549) c4(37663, 50720, 63777, 24606, 76834) c5(b, X, Hk, EM, hM, C, iL, y, hV, wN, q, jV, bu, av, fy, u, o, qL, nl, by, W, bfP, dt, nV, cMf, bm, qO, di, aA, at, eG); #c1(THRB) c2(NP_001239563) c3(11550) c4(37664, 50721, 63778, 24607, 76835) c5(Dr, iq, b, cMg, eu, og, cMh, bf, y, am, re, hV, wN, q, ra, do, ik, ff, tg, ar, u, bzf, o, iF, fU, yV, il, J, bp, dB, dt, jo, xO, T, VP, AP, aM, atn, nV, ii, cMi, iu, nc, Bg, cMj, aA, pO, pR); #c1(THRSP) c2(NP_003242) c3(11551) c4(37665, 50722, 63779, 24608, 76836) c5(Ag, aw, q, T, Af, aA, u, y); #c1(THSD1) c2(NP_061146) c3(11552) c4(37666, 50723, 63780, 24609, 76837) c5(jh, U, il, V, b); #c1(THSD4) c2(NP_001273358) c3(11553) c4(37667, 50724, 63781, 24610, 76838) c5(ho, yU, I, IV, DF, cp); #c1(THSD7A) c2(NP_056019) c3(11554) c4(37668, 50725, 63782, 24611, 76839) c5(dA, ak, acg, yU, Fg, cp); #c1(THYN1) c2(NP_001032381) c3(11555) c4(37669, 50726, 63783, 24612, 76840) c5(A); #c1(TIAI) c2(NP_071320) c3(11556) c4(37670, 50727, 63784, 24613, 76841) c5(lr, b, Ik, vZ, iL, mL, zL, jl, f, q, bjn, kz, OA, aC, gm, gL, II, jT, ao, ape, cT, BK); #c1(TIAF1) c2(NP_004731) c3(11557) c4(37671, 50728, 63785, 24614, 76842) c5(f, o, b); #c1(TIAL1) c2(NP_001029097) c3(11558) c4(37672, 50729, 63786, 24615, 76843) c5(f, gL, fP, II, vZ, u); #c1(TIAM1) c2(XP_005261095) c3(11559) c4(37673, 50730, 63787, 24616, 76844) c5(A, b, cY, dB, ic, iL, bw, U, y, jh, aX, h, q, bu, cB, cs, aq, bm, V, cV, by, P, T, Qt, x, jT, ao, aZn, u, PY, ag, aA); #c1(TIAM2) c2(NP_036586) c3(11560) c4(37674, 50731, 63788, 24617, 76845) c5(jE, b, ak, q, IV, bm); #c1(TICAM1) c2(NP_891549) c3(11561) c4(37675, 50732, 63789, 24618, 76846) c5(vg, en, aF, ig, gE, bb, ag, DM, dQ, cMI, dh, fh, aBs, hZ, pF, Fo, II, cMk, sS, Oa, gd, fl, atR); #c1(TICAM2) c2(NP_067681) c3(11562) c4(37676, 50733, 63790, 24619, 76847) c5(dx, B, aw, gG, dB, w, e, O, yg, dv, iy, Hs, og, du, gm, fO, gY, fx, jT, wh, yE, cT, i, bT, iF, X, iP, jz, Ku, iG, U, y, co, ag, f, N, bu, cs, av, fy, bm, iT, d, jB, V, gg, Qz, ad, aEw, Hh, iA, dY, vq, b, hh, jh, apl, re, hV, q, OC, jG, u, o, by, Fo, et, aoO, nV, kC, fg, bL, A, k, EN, jR, iL, jw, jQ, aX, h, F, cU, n, cB, cV, J, W, P, T, Ap, fM, E, Oi); #c1(TICRR) c2(NP_689472) c3(11563) c4(37677, 50734, 63791, 24620, 76848) c5(ac); #c1(TIFA) c2(NP_443096) c3(11564) c4(37678, 50735, 63792, 24621, 76849) c5(dA); #c1 (TIGD2) c2(NP_663761) c3(11565) c4(37679, 50736, 63793, 24622, 76850) c5(at); #c1(TIGIT) c2(NP_776160) c3(11566) c4(37680, 50737, 63794, 24623, 76851) c5(bq); #c1(TIMD4) c2(NP_001140198) c3(11567) c4(37681, 50738, 63795, 24624, 76852) c5(m, aoC, cy, or, dP, aC, eW); #c1(TIMELESS) c2(NP_003911) c3(11568) c4(37682, 50739, 63796, 24625, 76853) c5(oC, A, b, sJ, fl, C, amh, z, O, NL, y, m, co, cy, fq, re, ak, q, NJ, cM, aD, jG, aV, u, iT, fU, aC, be, P, II, aeV, cq, fy, dP, aY, uH, eX, gd, dc); #c1(TIMM10) c2(NP_036588) c3(11569) c4(37683, 50740, 63797, 24626, 76854) c5(cl); #c1(TIMM17A) c2(NP_006326) c3(11570) c4(37684, 50741, 63798, 24627, 76855) c5(u, y, kW); #c1(TIMM21) c2(NP_054896) c3(11571) c4(37685, 50742, 63799, 24628, 76856) c5(aW); #c1(TIMM22) c2(NP_037469) c3(11572) c4(37686, 50743, 63800, 24629, 76857) c5(aPu); #c1(TIMM23) c2(NP_006318) c3(11573) c4(37687, 50744, 63801, 24630, 76858) c5(aeV); #c1(TIMM44) c2(NP_006342) c3(11574) c4(37688, 50745, 63802, 24631, 76859) c5(bf, hV, aM); #c1(TIMM50) c2(NP_001001563) c3(11575) c4(37689, 50746, 63803, 24632, 76860) c5(fy, u, y); #c1(TIMM8A) c2(NP_004076) c3(11576) c4(37690, 50747, 63804, 24633, 76861) c5(by, b, X, U, y, jh, co, aX, ag, re, jT, F, q, bu, fv, bht, cs, av, fy, u, iT, ff, V, cV, fl, v, cMm, jo, aeV, ji, fx, ad, wh, bm, vU, na, Kl, i, Bx, bM, iE); #c1(TIMM8B) c2(NP_036591) c3(11577) c4(37691, 50748, 63805, 24634, 76862) c5(bq); #c1(TIMMDC1) c2(NP_057673) c3(11578) c4(37692, 50749, 63806, 24635, 76863) c5(bqW, bT); #c1(TIMP1) c2(NP_003245) c3(11579) c4(37693, 50750, 63807, 24636, 76864) c5(dx, gK, ml, aw, aNg, dB, HG, w, vl, cU, bf, O, Aq, e, xl, vr, dv, LL, t, pq, gB, alz, fP, dl, ayE, FN, asA, mR, fH, Hs, R, g, mz, fe, mm, aC, bK, sH, du, is, gm, fO, ft, m, od, BW, x, hU, fx, hR, gg, dH, aFN, YA, tO, ag, k, aSe, iT, i, aUt, bq, aA, jI, Mq, bP, yJ, fl, il, cMn, pD, cY, rq, cAa, eu, py, ig, sF, bW, bw, U, y, bC, co, RD, yE, ml, f, bu, gX, ky, B, JX, cs, av, fy, bm, fY, bNa, em, be, V, nl, cd, gv, IR, rT, cy, iA, gH, fJ, sT, uJ, Oa, P, ne, vH, ji, FG, aG, vq, hV, b, aGk, aF, eR, AA, vY, ic, z, aTF, ha, fD, d, aeQ, bb, Iz, Dx, sO, jd, re, vd, PA, q, zx, X, pn, ar, wT, n, jG, u, dh, o, RG, bU, tw, kF, VD, iE, LR, gL, ad, IX, G, MD, Io, aeC, et, M, bzv, ao, nV, bMt, cff, bkZ, ch, yC, Bt, Du, xU, gd, sj, IS, I, avn, cK, Jh, bL, A, pF, qd, fr, gN, BY, og, ds, xa, wf, c, DK, xe, hP, al, aW, cfh, a HA, Ez, aX, I, ty, fq, h, aBd, bjp, cU, aE, qP, Jk, UF, a V, kd, jZ, jH, yO, HI, wF, wo, ez, nQ, cMo, hZ, xf, me, J, W, bEC, T, II, Oi, bgw, di, by, aYw, qe, aM, wU, jT, An, mb, Ic, QJ, j, alw, cfh, bh, aT, at, eG, DM, Ik); #c1(TIMP2) c2(NP_003246) c3(11580) c4(37694, 50751, 63808, 24637, 76865) c5(dx, B, aw, F, dB, w, ku, cO, bf, e, xl, cp, vr, Vx, t, dl, fH, oJ, g, aC, nW, du, gm, fO, ft, od, x, FW, fx, jT, mO, wh, aFN, tO, ag, iT, i, bq, X, eu, sF, yn, bW, bw, U, y, V, bC, co, aAa, hg, cs, bu, O, JX, Us, vE, av, fy, bm, fY, is, Ke, NW, cd, cK, iA, qH, f J, JY, uJ, P, xe, vH, bH, ji, b, sH, aF, jL, AA, vY, ic, ha, fD, aO, d, bb, jd, re, hV, q, mL, ar, n, jG, sK, u, o, PJ, bU, tw, fs, sX, j, ad, G, Io, aeC, et, bzv, ao, Eu, cff, ch, Bu, Du, Ns, cC, kC, I, TP, Xm, bL, A, iG, k, fr, gN, jc, di, eO, al, sx, vl, c, Ez, aX, ty, h, wN, aBd, cU, Ex, Gw, aV, kd, jZ, wo, si, cV, be, J, dU, bEC, T, Oi, jl, by, aM, Nq, ajv, fP, bh, at, eG, iE); #c1(TIMP3) c2(NP_000353) c3(11581) c4(37695, 50752, 63809, 24638, 76866) c5(dx, by, B, aw, gG, ud, dB, w, bV, cO, bf, arI, e, xl, wo, dv, cy, kJ, nv, FN, mR, Uy, og, aC, nW, du, bp, vc, od, fx, gg, gs, sg, dX, i, bq, aA, X, eu, mk, dV, bW, GV, vl, y, ed, co, btS, ml, f, cs, vQ, bu, dZ, O, bkd, av, fy, bm, iT, aNY, V, v, cd, arf, jG, aJX, rK, py, PY, nJ, vH, bGj, ard, T, re, b, anb, q, vY, tG, z, ha, d, jh, bb, jd, bX, hV, je, DC, zx, ar, ff, u, aE, da, I, qL, LR, gL, hep, Ca, rO, et, jU, an, eQ, Bu, bng, Ns, di, sF, bL, A, TQ, pR, rp, ea, cMp, jR, vg, eO, wf, al, Xv, U, aW, aX, F, Ag, cU, aV, bJy, HI, ma, tP, nQ, Be, W, bR, SF, j, jl, ad, aM, ayr, Jh, Nq, fP, bh, at); #c1(TIMP4) c2(NP_003247) c3(11582) c4(37696, 50753, 63810, 24639, 76867) c5(f, bf, vg, b, qd, vh, gE, HG, O, mk, w, tG, cO, vp, al, Y, at, fe, DB, q, cd, FN, k, B, hV, u, dh, fY, be, I, aC, Bs, LR, Fs, gL, vc, j, Io, bq, aM, aDb, nV, uJ, Du, P, dY, bh, aG, gl); #c1(TINAG) c2(NP_055279) c3(11583) c4(37697, 50754, 63811, 24640, 76868) c5(et); #c1(TINF2) c2(NP_001092744) c3(11584) c4(37698, 50755, 63812, 24641, 76869) c5(cKW, cMr, jz, Iv, aun, eM, Nw, jQ, aX, or, bu, ss, R, ajc, aYk, aXd, ajG, pr, T, cMq, byr, xr); #c1(TIPARP) c2(NP_001171646) c3(11585) c4(37699, 50756, 63813, 24642, 76870) c5(fr, f, b, Yq, cY, ig, w, C, iL, O, bf, U, bu, A, e, y, cy, d, aX, Ob, re, hV, q, es, X, B, cs, HE, av, u, dh, cnX, V, cV, aC, ct, ft, W, P, axM, bb, by, ao, nV, ag, fl, bq); #c1(TIPIN) c2(NP_001276915) c3(11586) c4(37700, 50757, 63814, 24643, 76871) c5(f); #c1(TIPRL) c2(NP_001026970) c3(11587) c4(37701, 50758, 63815, 24644, 76872) c5(di, q, cp); #c1(TIRAP) c2(XP_005271456) c3(11588) c4(37702, 50759, 63816, 24645, 76873) c5(vq, bTi, A, cMs, b, X, aF, iU, II, BH, U, hP, eV, y, aCV, m, il, OH, h, F, q, bu, abh, jK, ik, bm, fH, av, u, iT, ale, ae, aDu, Uv, V, qm, aC, J, gL, by, BZ, Fo, T, Zr, Jp, pi, fJ, ale, aq, aAd, P, a YE, gd, kC, fP, fq, aA, gf); #c1(TJPI) c2(NP_003248) c3(11589) c4(37703, 50760, 63817, 24646, 76874) c5(bL, gE, ig, BY, xa, cO, y, aX, gB, q, u, aE, fh, ma, zv, atr, cy, nV, ch, hT, K, ex, agw, rn, gl); #c1(TJP2) c2(NP_001163885) c3(11590) c4(37704, 50761, 63818, 24647, 76875) c5(gD, ax, aX, fv, Be, dE, ang, gL, BY, sL, T, Bx, di, aA, dH); #c1(TJP3) c2(NP_001254489) c3(11591) c4(37705, 50762, 63819, 24648, 76876) c5(MT, A); #c1(TKI) c2(NP_003249) c3(11592) c4(37706, 50763, 63820, 24649, 76877) c5(b, X, aoJ, O, btO, aEa, h, y, oD, fy, u, n, g, iF, gm, bp, btl, P, Q, HE, wy, fM, gt, ag, cT, fl, T); #c1(TK2) c2(NP_001166114) c3(11593) c4(37707, 50764, 63821, 24650, 76878) c5(aNN, awQ, aoJ, hS, aqX, kV, bb, kz, n, bgW, oD, aqY, cJE, el, v, btl, pH Q, HE, wy, kS, fM, btO, zp, T); #c1(TKT) c2(NP_001128527) c3(11594) c4(37708, 50765, 63822, 24651, 76879) c5(ake, GC, b, bf, ey, Ag, re, aqU, q, jG, aV, bm, iT, yJ, v, Xr, T, Gl, cCS, aM, acj, Af, mD); #c1(TKTL1) c2(NP_001139405) c3(11595) c4(37709, 50766, 63823, 24652, 76880) c5(EO, f, b, wy, w, e, U, pl, y, d, aX, re, hV, F, q, bu, oJ, jG, u, iT, og, V, btl, by, T, Ca, jT, fM, pb, wh, nV, bm, btO); #c1(TKTL2) c2(NP_115512) c3(11596) c4(37710, 50767, 63824, 24653, 76881) c5(pb, re, iT); #c1(TLDC1) c2(XP_005256131) c3(11597) c4(37711, 50768, 63825, 24654, 76882) c5(ali); #c1(TLE1) c2(NP_001290032) c3(11598) c4(37712, 50769, 63826, 24655, 76883) c5(QV, co, V, b, aY, h, J, mA, iD, iZ, I, cM, y, dc, ji, u, yd, jx); #c1(TLE2) c2(NP_001138233) c3(11599) c4(37713, 50770, 63827, 24656, 76884) c5(jd, bEy, k); #c1(TLE3) c2(NP_001098662) c3(11600) c4(37714, 50771, 63828, 24657, 76885) c5(A, jd, ak, PY, aC, u); #c1(TLE4) c2(NP_001269677) c3(11601) c4(37715, 50772, 63829, 24658, 76886) c5(Ag, at, cy, h, ak, W, T, Af, y, aA, ho, u, OT, Eg); #c1(TLE6) c2(NP_001137458) c3(11602) c4(37716, 50773, 63830, 24659, 76887) c5(x, hP); #c1(TLKI) c2(NP_001130026) c3(11603) c4(37717, 50774, 63831, 24660, 76888) c5(gG, A, aX, b, f, MS, fl, B, ny, fl, ho, u, alQ, rb); #c1(TLK2) c2(NP_001271262) c3(11604) c4(37718, 50775, 63832, 24661, 76889) c5(A, cV, u, B, q, bm, y); #c1(TLLI) c2(NP_001191689) c3(11605) c4(37719, 50776, 63833, 24662, 76890) c5(oy, nX, I, fr, zF, ft, cMt, cO, at); #c1(TLL2) c2(NP_036597) c3(11606) c4(37720, 50777, 63834, 24663, 76891) c5(ak); #c1(TLNI) c2(NP_006280) c3(11607) c4(37721, 50778, 63835, 24664, 76892) c5(yJ, d, A, aw, b, f, q, B, kY, u, e, y, cp); #c1(TLN2) c2(XP_011520408) c3(11608) c4(37722, 50779, 63836, 24665, 76893) c5(iZ, ac); #c1(TLR10) c2(XP_011512064) c3(11609) c4(37723, 50780, 63837, 24666, 76894) c5(jl, wF, A, nk, jM, DM, B, fO, og, ti, cy, aV, u, y, DI); #c1(TLR1) c2(NP_003254) c3(11610) c4(37724, 50781, 63838, 24667, 76895) c5(sE, iU, e, cy, aDx, aZB, Pv, acy, cMv, aBs, og, Uv, aC, sH, fO, dB, Ce, jT, oh, pq, jE, aOS, aAd, tO, aZD, aWj, fl, cY, eu, U, cMx, y, DM, B, bu, av, fy, bm, SA, V, ae, aSz, Dp, bt, aDL, vq, b, aF, hr, eV, d, jh, eA, jd, q, X, ar, u, aAf, aDu, kt, gL, aFy, Fo, Yz, jH, aDq, Bm, aNu, A, cMu, xa, aX, fq, cU, n, fP, aV, yd, wF, Ea, be, cMw, P, T, aDA, jl, by, nk, ale, tA, Dl, cMy, at); #c1(TLR2) c2(XP_011530518) c3(11611) c4(37725, 50782, 63839, 24668, 76896) c5(dx, gK, en, pV, bPH, dN, WH, aDD, sE, rr, iU, VG, eW, sJ, j, bzL, axx, rF, OH, O, gF, aDo, dv, cy, Ob, cMd, bx, yh, fP, iT, dl, jm, sO, Pv, aD, Hs, aoh, g, mz, baH, Uv, jH, aC, ol, sH, du, gJ, po, cpQ, bRV, bv, vc, Q, aAA, jT, oh, gg, su, akn, azM, gs, BX, iL, fc, bm, LR, Ox, tO, iV, cT, yc, pH, bk, i, bq, aA, jl, bT, aWj, Zm, bnK, aAd, Al, aFz, kN, X, aFy, Kc, mk, cME, NH, afo, II, bf, bw, O, sN, cMx, y, V, aOr, yi, aoR, ag, Mn, DM, f, bPv, cs, bu, Db, bxF, Em, JX, aDM, a EX, aFk, av, fy, aOS, pW, Bm, is, aBv, Dp, ali, aog, ae, eE, BS, ajl, it, Zr, gv, IR, aem, aFs, eX, bt, qX, bb, iA, BV, pi, dO, dP, py, TP, P, dY, fO, aDL, cMF, abs, zS, bn, Xe, re, Dg, II, vg, Ig, ny, b, LX, aF, ak, HK, vY, id, tG, z, hr, ey, Bb, aO, aCV, aDD, qH, Xy, bOm, eA, cMD, vj, asx, blE, q, ap, baz, ago, vu, ajJ, cMG, aBI, se, DY, u, dh, o, aZ, aNu, aDu, Zz, I, bNU, kt, BT, UG, gL, ad, IX, Fo, wu, Za, aZZ, Fk, et, jU, Yz, cMG, eV, ig, fD, ch, eQ, kh, mA, aE, yr, gd, kC, ix, IS, zO, aFp, fl, I, di, bRq, cK, Ku, azt, da, A, vq, cMA, qd, xa, In, aBs, gN, axA, jc, cMB, tA, cMz, gE, al, vl, eh, iy, m, bNQ, xT, LS, ty, kn, wG, h, IE, cd, aNw, n, gB, sV, cMy, Io, aV, jZ, aFc, wF, ma, be, bKa, fl, atR, axl, ti, T, bNt, aDA, aX, cmX, by, qe, aM, wT, nk, ip, zE, NG, Ic, Rd, ajv, aQk, Dl, bOs, fq, aEW, bh, aT, at, fF, gl); #c1(TLR3) c2(NP_003256) c3(11612) c4(37726, 50783, 63840, 24669, 76897) c5(en, aw, sE, dB, w, vp, yi, e, aXC, cy, AX, aDO, mR, nB, fH, Uy, gl, aBs, og, aC, sH, vc, jT, FG, pq, xO, Lz, sS, LR, bY, tO, ag, dc, aA, bT, Zm, fl, bkw, nF, rq, ig, dV, cMH, GV, U, aEe, cM, V, BL, nQ, DM, f, dZ, B, cs, gg, fy, bm, ali, NW, aCG, akT, cK, iA, pi, fJ, py, aY, Oa, fW, bNt, bn, b, aF, XF, yc, tG, z, d, bb, q, dQ, ar, u, aE, BT, gL, ad, aDv, aZ, jU, nV, hU, mk, hT, kh, qd, fl, A, iL, ZP, Ik, gn, mW, di, xa, vq, gE, al, aW, m, aX, kn, h, y, aV, jZ, aPI, wF, ma, apx, cV, hZ, bNw, be, P, T, II, aDA, pF, ac, nk, bvS, aeg, ale, aEb, Dl, fP, Oi, ap, eG, gf, gl); #c1(TLR4) c2(NP_003257) c3(11613) c4(37727, 50784, 63841, 24670, 76898) c5(en, dD, ak, rF, OH, e, uA, aDo, Pn, dl, aFA, mR, TP, JP, bPq, aC, cMJ, JN, kN, pq, jE, aei, bm, ie, tO, ag, bk, fD, bq, aA, aWj, em, X, AsL, vD, eu, ig, II, vl, cM, fm, rr, gb, av, fy, pW, zO, is, aBv, V, ae, nl, cMK, fJ, Cs, uJ, To, dY, cMF, abs, ji, bTf, aG, aFI, bn, dk, vY, BH, pi, Xy, yN, ap, yp, dh, aAf, gL, ad, wL, iw, py, ash, bOo, rj, eZ, In, gN, jc, vZ, xa, iL, gE, m, IE, aQk, wG, aBa, abh, qB, ev, wF, Ea, be, J, cMw, bR, Pk, Jh, Ic, fP, dx, WH, iU, Ig, bzL, bf, aK, O, at, LN, AX, yh, jm, jM, og, aeM, du, yO, gm, bp, MO, fp, gs, BX, dS, fc, bMf, iV, bT, bP, fl, mk, ix, afo, U, cMI, co, f, aDD, bbG, bu, Zn, Bs, Zr, gv, ny, Hh, qH, qD, aH, Oa, cMM, wT, vq, wj, atU, z, hr, d, bb, jd, vj, q, baz, ago, ar, o, fh, bNQ, kt, BT, CM, aDO, aZ, jU, jH, Eu, ch, xU, gd, bOK, aFp, bRq, bNT, MZ, PJ, asE, bPx, qX, eO, al, aW, bbE, aWi, hN, ax, hW, ez, aMH, sj, T, II, Bb, nk, bay, Dl, iB, bPF, bPA, gf, eX, aw, Fk, sE, DT, eW, aDx, eE, aD, fH, ha, aBs, asM, fO, vc, fx, rn, nX, wK, NW, pp, hm, DM, B, Db, JX, bv, hj, iT, yJ, SA, rN, Hg, bt, gC, iA, bjQ, cMN, dO, fw, zS, aCL, adJ, b, LX, aF, Of, jL, au, tG, Fr, bsa, re, gz, vu, Zz, Dg, atr, da, Fo, et, aAn, hU, aJA, hT, ex, kC, aFi, aMI, adK, mW, Lu, axA, Iv, vg, wf, ckl, LS, GS, W, ti, aDA, jl, aM, Y, ty, PB, ajv, eN, eG, h, gK, pV, Ym, bx, aN, sJ, bV, cU, gO, dv, cy, t, JF, Hs, gl, R, Uv, gm, aDk, ol, sH, gJ, gY, jT, dL, dH, fN, Ox, yE, I, id, td, Kt, oh, aFy, hS, ma, IW, bkc, xw, y, ed, ip, Em, cs, zQ, DF, aOS, iF, fz, aZC, dA, ajl, Dp, pi, Eb, dP, Bm, er, aDL, Im, Xe, vl, eR, ic, ey, eV, aO, yK, Iz, bX, blE, dQ, qe, u, nj, chw, aDu, I, im, qC, by, BZ, G, tA, yG, Yz, eQ, aE, aFk, I, Ku, azt, bL, A, aZZ, di, bj, oy, aX, sS, cML, fq, qn, F, gr, az, n, aV, jZ, bax, wE, P, j, bh, ac, zE, IJ, aBz, Oi, aT); #c1(TLR5) c2(XP_006711569) c3(11614) c4(37728, 50785, 63842, 24671, 76899) c5(aWj, vq, by, en, aZ, b, xa, aF, gN, DJ, bNK, qX, bf, vp, U, mW, vl, y, kE, m, qH, sH, DM, im, bu, do, Em, A, cs, cMw, aV, u, gl, wF, le, Uv, V, I, Ea, aC, aSz, nl, gL, ad, Fo, T, cMO, bt, x, cy, Aj, hR, oh, jU, aM, jH, jT, fy, P, tO, yr, qd, Dl, fP, bk, aA, ap, gl); #c1(TLR6) c2(NP_006059) c3(11615) c4(37729, 50786, 63843, 24672, 76900) c5(aWj, aAf, A, vq, aF, sE, wF, og, di, Ku, hr, DK, cy, fq, DM, B, vu, n, cwP, aV, u, aNu, aBs, aDu, ae, aC, kt, sH, Dp, gL, iU, I, Fo, ti, T, fD, jl, Vv, aFy, jH, nk, P, tA, tO, aDL, Dl, fP, atR, xa); #c1(TLR7) c2(NP_057646) c3(11616) c4(37730, 50787, 63844, 24673, 76901) c5(dx, WH, en, Kt, b, Ik, mW, mk, A, ic, tG, gE, al, OH, O, aO, RR, d, m, dv, aX, aeM, ip, yX, kn, DM, B, e, q, cy, eE, aOx ar, aW, as, fH, FG, aV, bm, gl, da, wF, LR, vq, an, Dg, jU, BT, gL, vc, II, jT, BL, Pk, fJ, jU, du, fy, hU, yN, iL, ig, amJ, kM, P, aC, ag, cT, DL fP, tl, fl, gj, aA, C); #c1(TLR8) c2(NP_619542) c3(11617) c4(37731, 50788, 63845, 24674, 76902) c5(A, tG, Zq, LX, Pv, iU, mk, fl, ic, vg, gE, e, aO, RR, d, m, aX, b, Ey, DM, B, fP, fH, FG, aV, hip, gl, da, wF, aeM, aC, Dg, BT, asM, gL, vc, II, pt, cy, Pk, ajd, fJ, ig, P, Dl, j, fl, oM, at, alg); #c1(TLR9) c2(NP_059138) c3(11618) c4(37732, 50789, 63846, 24675, 76903) c5(dx, en, aw, aZ, bx, sE, DT, eW, sJ, w, bzL, Eh, vp, ps, e, O, cy, yh, mR, aD, gl, q, aBs, jH, aC, sH, du, fO, gm, bp, gY, vc, vM, aCP, jT, iU, pq, aoC, Ox, ie, tO, ag, cT, iT, fD, bq, aA, bT, bP, fl, Al, Kt, cY, eu, mk, ix, kY, bf, bw, U, y, co, px, yX, DM, f, vQ, bu, Db, B, JX, cs, av, fy, aOS, fY, aBv, SA, V, ae, aSz, NZ, ajl, aGS, vm, eV, bt, cMP, gC, iA, pi, d, Eh, dP, ji, ap, WH, b, aF, tG, aYA, TH, yK, jh, aem, yN, re, q, jU, aCF, X, dQ, ar, u, nj, o, da, adK, Zz, I, kt, LR, gL, ad, bkw, IJ, Fk, et, jU, cMC, hU, blp, aE, ih, qd, fl, I, bRq, aCL, bNT, A, iL, In, mW, IE, xa, vq, gE, vl, m, bKa, jl, wG, h, cU, ik, n, aV, jZ, wF, cV, be, dB, J, asM, P, ti, T, II, aFt, by, aM, nk, aDl, Ic, tA, 01, fP, fq, at); #c1(TLX1) c2(NP_001182446) c3(11619) c4(37733, 50790, 63847, 24676, 76904) c5(pA, NQ, b, afq, t, ie, gm, J, jz, iZ, Iv, iv, jT, G, jfl); #c1(TLX2) c2(NP_057254) c3(11620) c4(37734, 50791, 63848, 24677, 76905) c5(b, X, jz, hS, di, Iv, cO, cM, jQ, bb, vC, f, av, JT, fM, cMQ, clJ, fc, bY, aY, bka, dc); #c1(TLX3) c2(NP_066305) c3(11621) c4(37735, 50792, 63849, 24678, 76906) c5(pA, b, t, ie, J, G, Iv, i, iv, fx); #c1(TM4SFI) c2(NP_055035) c3(11622) c4(37736, 50793, 63850, 24679, 76907) c5(A, aX, b, B, ag, ar, u, y); #c1(TM4SF20) c2(NP_079071) c3(11623) c4(37737, 50794, 63851, 24680, 76908) c5(CT, cMR, KH); #c1(TM4SF4) c2(NP_004608) c3(11624) c4(37738, 50795, 63852, 24681, 76909) c5(jE, bQ, kF, b, q, z, bm); #c1 (TM4SF5) c2(NP_003954) c3(11625) c4(37739, 50796, 63853, 24682, 76910) c5(bp, q, b); #c1(TM6SF2) c2(NP_001001524) c3(11626) c4(37740, 50797, 63854, 24683, 76911) c5(bg); #c1(TM7SF2) c2(NP_001264162) c3(11627) c4(37741, 50798, 63855, 24684, 76912) c5(dx, bL, ji, id, gE, b, k, X, z, Vz, kB, w, ds, Vy, cO, bf, xl, co, ae, bw, ml, eX, IW, q, bu, gX, fv, y, cs, vo, av, cq, u, dh, g, sB, VD, IP, aC, kt, me, dB, bp, gv, IR, dU, dv, T, bh, fy, ad, et, be, aM, VF, du, gp, IX, VG, bm, fw, aE, ag, oi, IS, bg, di, at, sF); #c1(TM9SF2) c2(NP_004791) c3(11628) c4(37742, 50799, 63856, 24685, 76913) c5(bq, Wo, fl); #c1(TM9SF4) c2(NP_055557) c3(11629) c4(37743, 50800, 63857, 24686, 76914) c5(aX, b); #c1(TMBIM4) c2(NP_001269535) c3(11630) c4(37744, 50801, 63858, 24687, 76915) c5(A, I, cMS, sE, B, om, II, z, bf, aA, oG, aM); #c1(TMBIM6) c2(NP_003208) c3(11631) c4(37745, 50802, 63859, 24688, 76916) c5(o, ma, bb, f, b, h, LR, J, sB, ME, A, T, B, ar, Oi, gg, u, y, js); #c1(TMC1) c2(NP_619636) c3(11632) c4(37746, 50803, 63860, 24689, 76917) c5(cMT, bCN, by, na, Bx, cMO); #c1(TMC2) c2(NP_542789) c3(11633) c4(37747, 50804, 63861, 24690, 76918) c5(m); #c1(TMC3) c2(NP_001074001) c3(11634) c4(37748, 50805, 63862, 24691, 76919) c5(ao); #c1(TMC5) c2(NP_001098718) c3(11635) c4(37749, 50806, 63863, 24692, 76920) c5(d, ik, e); #c1(TMC6) c2(NP_009198) c3(11636) c4(37750, 50807, 63864, 24693, 76921) c5(d, re, Ip, pu, yA, e, iT); #c1(TMC8) c2(NP_689681) c3(11637) c4(37751, 50808, 63865, 24694, 76922) c5(d, re, Ip, pu, yA, e, iT); #c1(TMCCI) c2(XP_006713615) c3(11638) c4(37752, 50809, 63866, 24695, 76923) c5(lp, apG, re, iT); #c1(TMCC2) c2(NP_001229854) c3(11639) c4(37753, 50810, 63867, 24696, 76924) c5(ae0); #c1(TMCC3) c2(NP_065749) c3(11640) c4(37754, 50811, 63868, 24697, 76925) c5(di, cO); #c1(TMC01) c2(NP_061899) c3(11641) c4(37755, 50812, 63869, 24698, 76926) c5(cMV, ez, er, nU, qr, dt, aPu, di, AP); #c1(TMC04) c2(XP_011539488) c3(11642) c4(37756, 50813, 63870, 24699, 76927) c5(cy); #c1(TMC05A) c2(XP_005254225) c3(11643) c4(37757, 50814, 63871, 24700, 76928) c5(vY, ak, dA); #c1(TMED10) c2(NP_006818) c3(11644) c4(37758, 50815, 63872, 24701, 76929) c5(A, avb, alY, b, Pv, f, v, Dm, alW, B, cB, fs, alX, u); #c1(TMED1) c2(NP_006849) c3(11645) c4(37759, 50816, 63873, 24702, 76930) c5(dx, du, dv, cy, sE, P, fv, at, ap); #c1(TMED2) c2(NP_006806) c3(11646) c4(37760, 50817, 63874, 24703, 76931) c5(en, kE, jz, EN, fl, Iv, iL, zL, jD, jQ, jl, re, CR, aEU, cs, iT, dj, hW, SV, ae, kt, J, P, od, Il, Oa, at, alg, aEN); #c1(TMED3) c2(NP_001288132) c3(11647) c4(37761, 50818, 63875, 24704, 76932) c5(P, A, B); #c1(TMED4) c2(NP_872353) c3(11648) c4(37762, 50819, 63876, 24705, 76933) c5(ar); #c1(TMED7) c2(NP_861974) c3(11649) c4(37763, 50820, 63877, 24706, 76934) c5(dx, B, aw, gG, dB, w, e, O, yg, dv, iy, Hs, og, du, gm, fO, gY, fx, jT, wh, yE, cT, i, bT, X, iP, jz, Ku, iG, O, y, co, ag, f, N, bu, cs, av, fy, bm, iT, iF, jB, V, qq, Qz, ad, aEw, Hh, iA, d, dY, b, hh, jh, apl, re, hV, q, DC, jG, u, o, by, et, aoO, nV, kC, fg, bL, A, k, EN, jR, iL, jw, jQ, aX, h, F, cU, n, cB, cV, J, W, P, T, Ap, fM, E, Oi); #c1(TMED7-TICAM2) c2(NP_001157940) c3(11650) c4(37764, 50821, 63878, 24707, 76935) c5(dx, B, aw, gG, dB, w, e, O, yg, dv, iy, Hs, og, du, gm, fO, gY, fx, jT, wh, yE, cT, i, bT, X, iP, jz, Ku, iG, U, y, co, ag, f, N, bu, cs, av, fy, bm, iT, iF, jB, V, qq, Qz, ad, aEw, Hh, iA, d, dY, b, hh, jh, apl, re, hV, q, OC, jG, u, o, by, et, aoO, nV, kC, fq, bL, A, k, EN, jR, iL, jw, jQ, aX, h, F, cU, n, cB, cV, J, W, P, T, Ap, fM, E, Oi); #c1(TMED9) c2(NP_059980) c3(11651) c4(37765, 50822, 63879, 24708, 76936) c5(ae, bb, bK, HN, v, dB, P, hw); #c1(TMEFFI) c2(NP_003683) c3(11652) c4(37766, 50823, 63880, 24709, 76937) c5(g, Ns, Nq, b); #c1(TMEFF2) c2(NP_057276) c3(11653) c4(37767, 50824, 63881, 24710, 76938) c5(B, pV, b, amF, x, A, hM, JE, bf, U, zY, y, jh, Zd, zJ, kT, hV, q, bu, ik, qB, ar, u, iq, Jl, kF, V, aC, nl, by, W, bt, aif, et, fx, nV, ii, py, nJ, fP, i, Mp, eN); #c1(TMEM100) c2(NP_060756) c3(11654) c4(37768, 50825, 63882, 24711, 76939) c5(co, fl); #c1(TMEM101) c2(XP_011523653) c3(11655) c4(37769, 50826, 63883, 24712, 76940) c5(aA); #c1(TMEM105) c2(NP_848615) c3(11656) c4(37770, 50827, 63884, 24713, 76941) c5(bb); #c1(TMEM106B) c2(XP_005249846) c3(11657) c4(37771, 50828, 63885, 24714, 76942) c5(ao, bS, aj, OA, Wo, ai); #c1(TMEM108) c2(NP_001269794) c3(11658) c4(37772, 50829, 63886, 24715, 76943) c5(aA, bj, I); #c1(TMEM114) c2(NP_001277026) c3(11659) c4(37773, 50830, 63887, 24716, 76944) c5(aru); #c1(TMEM115) c2(NP_008955) c3(11660) c4(37774, 50831, 63888, 24717, 76945) c5(W);
c1(TMEM117) c2(NP_001273141) c3(11661) c4(37775, 50832, 63889, 24718, 76946) c5(oy, dA); #c1(TMEM11) c2(NP_003867) c3(11662) c4(37776, 50833, 63890, 24719, 76947) c5(nP, cfH, I, xX); #c1(TMEM126A) c2(NP_001231664) c3(11663) c4(37777, 50834, 63891, 24720, 76948) c5(cMW, awS, vL); #c1(TMEM127) c2(NP_001180233) c3(11664) c4(37778, 50835, 63892, 24721, 76949) c5(Hq, b, anG, dB, dt, qp); #c1(TMEM128) c2(NP_001284480) c3(11665) c4(37779, 50836, 63893, 24722, 76950) c5(bj); #c1(TMEM132A) c2(NP_060340) c3(11666) c4(37780, 50837, 63894, 24723, 76951) c5(at, f, b); #c1(TMEM132B) c2(NP_443139) c3(11667) c4(37781, 50838, 63895, 24724, 76952) c5(bj, eO, aX, cp); #c1(TMEM132C) c2(NP_001129575) c3(11668) c4(37782, 50839, 63896, 24725, 76953) c5(bf); #c1(TMEM132D) c2(NP_597705) c3(11669) c4(37783, 50840, 63897, 24726, 76954) c5(abu, b, jz, tR, Ip, Iv, wX, y, jQ, cy, t, h, iv, bm, iT, fU, cV, J, P, pw, aeq, u, ie, G, ih, cT, bq, re); #c1(TMEM132E) c2(NP_001291367) c3(11670) c4(37784, 50841, 63898, 24727, 76955) c5(bb, at, u, y); #c1(TMEM134) c2(NP_001072118) c3(11671) c4(37785, 50842, 63899, 24728, 76956) c5(aW); #c1(TMEM135) c2(NP_001162195) c3(11672) c4(37786, 50843, 63900, 24729, 76957) c5(fl, bb, nU, bq, aV, ajt, cp); #c1(TMEM138) c2(NP_057548) c3(11673) c4(37787, 50844, 63901, 24730, 76958) c5(cMX); #c1(TMEM150B) c2(XP_011525158) c3(11674) c4(37788, 50845, 63902, 24731, 76959) c5(ho); #c1(TMEM15IA) c2(NP_694998) c3(11675) c4(37789, 50846, 63903, 24732, 76960) c5(kF); #c1(TMEM151B) c2(NP_001131032) c3(11676) c4(37790, 50847, 63904, 24733, 76961) c5(kF); #c1(TMEM154) c2(NP_689893) c3(11677) c4(37791, 50848, 63905, 24734, 76962) c5(dA); #c1(TMEM158) c2(NP_056259) c3(11678) c4(37792, 50849, 63906, 24735, 76963) c5(u, y, b, dA); #c1(TMEM160) c2(NP_060324) c3(11679) c4(37793, 50850, 63907, 24736, 76964) c5(aA); #c1(TMEM161B) c2(NP_699185) c3(11680) c4(37794, 50851, 63908, 24737, 76965) c5(cy); #c1(TMEM163) c2(NP_112185) c3(11681) c4(37795, 50852, 63909, 24738, 76966) c5(bj); #c1(TMEM165) c2(NP_060945) c3(11682) c4(37796, 50853, 63910, 24739, 76967) c5(cMY, arD, eq, KG); #c1(TMEM169) c2(NP_001135784) c3(11683) c4(37797, 50854, 63911, 24740, 76968) c5(l, at); #c1(TMEM170A) c2(NP_660297) c3(11684) c4(37798, 50855, 63912, 24741, 76969) c5(at); #c1(TMEM171) c2(NP_001154814) c3(11685) c4(37799, 50856, 63913, 24742, 76970) c5(eJ); #c1(TMEM173) c2(NP_938023) c3(11686) c4(37800, 50857, 63914, 24743, 76971) c5(jh, AX, UE, Il, gE, n); #c1(TMEM175) c2(NP_001284354) c3(11687) c4(37801, 50858, 63915, 24744, 76972) c5(bj); #c1(TMEM176B) c2(NP_001094784) c3(11688) c4(37802, 50859, 63916, 24745, 76973) c5(aK, dB, aN); #c1(TMEM178A) c2(NP_689603) c3(11689) c4(37803, 50860, 63917, 24746, 76974) c5(nu); #c1(TMEM182) c2(NP_653233) c3(11690) c4(37804, 50861, 63918, 24747, 76975) c5(oy, bq, er, ak, Eg); #c1(TMEM183A) c2(NP_612400) c3(11691) c4(37805, 50862, 63919, 24748, 76976) c5(di); #c1(TMEM184C) c2(NP_060711) c3(11692) c4(37806, 50863, 63920, 24749, 76977) c5(hV, nV); #c1(TMEM185A) c2(NP_001167563) c3(11693) c4(37807, 50864, 63921, 24750, 76978) c5(nz, nU); #c1(TMEM187) c2(XP_011529501) c3(11694) c4(37808, 50865, 63922, 24751, 76979) c5(m); #c1(TMEM189) c2(NP_001155977) c3(11695) c4(37809, 50866, 63923, 24752, 76980) c5(fn, A, b, k, eu, bg, w, iL, xw, aoa, h, B, q, M, Xi, Cp, Qx, jB, wB, v, j, J, P, T, Il, avY, cq, ao, f, PY, Dj, fl); #c1(TMEM189-UBE2V1) c2(NP_954673) c3(11696) c4(37810, 50867, 63924, 24753, 76981) c5(fn, A, b, k, eu, bg, w, iL, xw, aoa, h, B, q, M, do, Xi, Cp, Qx, jB, wB, v, j, J, P, T, II, avY, og, ao, f, PY, Dj, fl); #c1(TMEM18) c2(NP_690047) c3(11697) c4(37811, 50868, 63925, 24754, 76982) c5(cy, I, dA, rh, w, bf, aA, D, aM); #c1(TMEM199) c2(NP_689677) c3(11698) c4(37812, 50869, 63926, 24755, 76983) c5(u, y); #c1(TMEM200A) c2(NP_001245206) c3(11699) c4(37813, 50870, 63927, 24756, 76984) c5(jR, dA); #c1(TMEM205) c2(NP_001138888) c3(11700) c4(37814, 50871, 63928, 24757, 76985) c5(b); #c1(TMEM207) c2(NP_997199) c3(11701) c4(37815, 50872, 63929, 24758, 76986) c5(YY, at, b); #c1(TMEM209) c2(NP_001288092) c3(11702) c4(37816, 50873, 63930, 24759, 76987) c5(co); #c1(TMEM213) c2(NP_001078898) c3(11703) c4(37817, 50874, 63931, 24760, 76988) c5(bw, pR); #c1(TMEM215) c2(NP_997723) c3(11704) c4(37818, 50875, 63932, 24761, 76989) c5(oy); #c1(TMEM216) c2(NP_001167461) c3(11705) c4(37819, 50876, 63933, 24762, 76990) c5(cNa, dt, r, vU, cMZ, zW); #c1(TMEM217) c2(NP_001273330) c3(11706) c4(37820, 50877, 63934, 24763, 76991) c5(o); #c1(TMEM219) c2(NP_001077082) c3(11707) c4(37821, 50878, 63935, 24764, 76992) c5(A, cy, b, B, co, u, y); #c1(TMEM220) c2(NP_001004313) c3(11708) c4(37822, 50879, 63936, 24765, 76993) c5(bq); #c1(TMEM229A) c2(NP_001129474) c3(11709) c4(37823, 50880, 63937, 24766, 76994) c5(dA); #c1(TMEM231) c2(NP_001070884) c3(11710) c4(37824, 50881, 63938, 24767, 76995) c5(cNb, r, cNc); #c1(TMEM233) c2(NP_001130006) c3(11711) c4(37825, 50882, 63939, 24768, 76996) c5(at, ix); #c1(TMEM237) c2(NP_001037850) c3(11712) c4(37826, 50883, 63940, 24769, 76997) c5(cNd); #c1(TMEM24l) c2(NP_116322) c3(11713) c4(37827, 50884, 63941, 24770, 76998) c5(bb); #c1(TMEM244) c2(NP_001010876) c3(11714) c4(37828, 50885, 63942, 24771, 76999) c5(aA, cO); #c1(TMEM245) c2(NP_14401) c3(11715) c4(37829, 50886, 63943, 24772, 77000) c5(A); #c1(TMEM259) c2(NP_001028198) c3(11716) c4(37830, 50887, 63944, 24773, 77001) c5(T); #c1(TMEM25) c2(NP_001137507) c3(11717) c4(37831, 50888, 63945, 24774, 77002) c5(u, y); #c1(TMEM26l) c2(NP_219500) c3(11718) c4(37832, 50889, 63946, 24775, 77003) c5(alF, A); #c1(TMEM27) c2(NP_065716) c3(11719) c4(37833, 50890, 63947, 24776, 77004) c5(Lm, amJ, et, si); #c1(TMEM2) c2(NP_001129292) c3(11720) c4(37834, 50891, 63948, 24777, 77005) c5(oy, A, B); #c1(TMEM30A) c2(NP_001137430) c3(11721) c4(37835, 50892, 63949, 24778, 77006) c5(fl); #c1(TMEM30B) c2(NP_001017970) c3(11722) c4(37836, 50893, 63950, 24779, 77007) c5(jd, aX, bjq); #c1(TMEM37) c2(NP_899063) c3(11723) c4(37837, 50894, 63951, 24780, 77008) c5(Ag, T); #c1(TMEM38A) c2(NP_076979) c3(11724) c4(37838, 50895, 63952, 24781, 77009) c5(qs, di); #c1(TMEM38B) c2(NP_060582) c3(11725) c4(37839, 50896, 63953, 24782, 77010) c5(zF, cNe, aA); #c1(TMEM39A) c2(NP_060736) c3(11726) c4(37840, 50897, 63954, 24783, 77011) c5(m, aV, bb); #c1(TMEM40) c2(NP_001271335) c3(11727) c4(37841, 50898, 63955, 24784, 77012) c5(ai); #c1(TMEM43) c2(NP_077310) c3(11728) c4(37842, 50899, 63956, 24785, 77013) c5(cNf, cAs, cK, xj, EM, cO, oD); #c1(TMEM45A) c2(NP_060474) c3(11729) c4(37843, 50900, 63957, 24786, 77014) c5(jE, b, u, q, bm, y); #c1(TMEM47) c2(NP_13630) c3(11730) c4(37844, 50901, 63958, 24787, 77015) c5(nz); #c1(TMEM50B) c2(NP_006125) c3(11731) c4(37845, 50902, 63959, 24788, 77016) c5(b); #c1(TMEM55A) c2(NP_061180) c3(11732) c4(37846, 50903, 63960, 24789, 77017) c5(bj); #c1(TMEM57) c2(XP_011540006) c3(11733) c4(37847, 50904, 63961, 24790, 77018) c5(at); #c1(TMEM5) c2(NP_055069) c3(11734) c4(37848, 50905, 63962, 24791, 77019) c5(cNg, UR, T, Ct, wp); #c1(TMEM60) c2(NP_16325) c3(11735) c4(37849, 50906, 63963, 24792, 77020) c5(fD); #c1(TMEM62) c2(NP_079232) c3(11736) c4(37850, 50907, 63964, 24793, 77021) c5(cy); #c1(TMEM63A) c2(NP_055513) c3(11737) c4(37851, 50908, 63965, 24794, 77022) c5(bu); #c1(TMEM67) c2(NP_001135773) c3(11738) c4(37852, 50909, 63966, 24795, 77023) c5(cqu, xc, r, cNi, eF, cO, KQ, vU, z, bh, cNh, aCd, asa, TD, vt, zW, KV); #c1(TMEM70) c2(NP_001035703) c3(11739) c4(37853, 50910, 63967, 24796, 77024) c5(aNN, pQ, kW, all, cmJ, IR, IX, cmK, IS, cNj, cK, oD, PH, u, akZ, y); #c1(TMEM74B) c2(NP_001291677) c3(11740) c4(37854, 50911, 63968, 24797, 77025) c5(aV); #c1(TMEM79) c2(NP_15699) c3(11741) c4(37855, 50912, 63969, 24798, 77026) c5(fg); #c1(TMEM87A) c2(NP_001103973) c3(11742) c4(37856, 50913, 63970, 24799, 77027) c5(bb); #c1(TMEM88) c2(NP_981956) c3(11743) c4(37857, 50914, 63971, 24800, 77028) c5(co); #c1(TMEM89) c2(NP_001008270) c3(11744) c4(37858, 50915, 63972, 24801, 77029) c5(oy); #c1(TMEM8B) c2(NP_001036055) c3(11745) c4(37859, 50916, 63973, 24802, 77030) c5(by, V, b, bu, cs, U, ad, u, y); #c1(TMEM95) c2(NP_001307365) c3(11746) c4(37860, 50917, 63974, 24803, 77031) c5(afB); #c1(TMEM97) c2(NP_055388) c3(11747) c4(37861, 50918, 63975, 24804, 77032) c5(X, av, fy, U, V); #c1(TMEM98) c2(NP_001288675) c3(11748) c4(37862, 50919, 63976, 24805, 77033) c5(ak, q, ac); #c1(TMF1) c2(NP_009045) c3(11749) c4(37863, 50920, 63977, 24806, 77034) c5(kF, f, A); #c1(TMIE) c2(NP_671729) c3(11750) c4(37864, 50921, 63978, 24807, 77035) c5(bCC, bCh, cNk, beT, Bx); #c1(TMIGD2) c2(NP_653216) c3(11751) c4(37865, 50922, 63979, 24808, 77036) c5(f); #c1(TMIGD3) c2(NP_001289609) c3(11752) c4(37866, 50923, 63980, 24809, 77037) c5(gd, fP, I, jH); #c1(TMLHE) c2(NP_001171726) c3(11753) c4(37867, 50924, 63981, 24810, 77038) c5(cNl, nU, rQ, cz); #c1(TMOD1) c2(NP_001159588) c3(11754) c4(37868, 50925, 63982, 24811, 77039) c5(A, iR); #c1(TMOD2) c2(NP_001136357) c3(11755) c4(37869, 50926, 63983, 24812, 77040) c5(oy, iR); #c1(TMOD3) c2(NP_055362) c3(11756) c4(37870, 50927, 63984, 24813, 77041) c5(oy, iR); #c1(TMOD4) c2(NP_037485) c3(11757) c4(37871, 50928, 63985, 24814, 77042) c5(b); #c1(TMPO) c2(NP_001027454) c3(11758) c4(37872, 50929, 63986, 24815, 77043) c5(co, b, Y, aC, bp, aE, fl, mR, jR, cNm, fl, et, at, bT); #c1(TMPRSS11A) c2(NP_001107859) c3(11759) c4(37873, 50930, 63987, 24816, 77044) c5(d, jh, ik, e, il); #c1(TMPRSS11B) c2(NP_872308) c3(11760) c4(37874, 50931, 63988, 24817, 77045) c5(bb, il, ap, ik, bq, at, fh); #c1(TMPRSS11D) c2(NP_004253) c3(11761) c4(37875, 50932, 63989, 24818, 77046) c5(fl, en, JH, ae, b, aXh, B, DT, fO, Yl, A, iL, aDe, sQ, cy, aDF); #c1(TMPRSS11E) c2(NP_054777) c3(11762) c4(37876, 50933, 63990, 24819, 77047) c5(d, aof, F, e); #c1(TMPRSS13) c2(NP_001070731) c3(11763) c4(37877, 50934, 63991, 24820, 77048) c5(A, kE, b, F, DQ, dB, Ip, w, rv, Fh, U, Uq, vl, y, jh, cKR, co, aX, Ob, re, B, bOx, q, bu, ar, oJ, qw, OA, fy, u, iT, PJ, fU, V, ae, kt, wh, by, T, II, an, qp, eV, qG, PY, dY, ag, agw, xX, VT, at, eG); #c1(TMPRSS15) c2(NP_002763) c3(11764) c4(37878, 50935, 63992, 24821, 77049) c5(b, cNn, ar, T, aA, Eg); #c1(TMPRSS2) c2(NP_001128571) c3(11765) c4(37879, 50936, 63993, 24822, 77050) c5(en, aw, b, Hk, eu, A, Bg, h, B, gT, ar, aJ, jG, fO, sQ, hb, qL, T, Fr, nJ, bnX, af); #c1(TMPRSS3) c2(NP_001243246) c3(11766) c4(37880

50937, 63994, 24823, 77051) c5(alH, Pb, b, cNo, ag, X, cNp, bCN, ahd, na, dZ, hC, dV, Bx, zk, av, zp); #c1 (TMPRSS4) c2(NP_001077416) c3(11767) c4(37881, 50938, 63995, 24824, 77052) c5(alH, b, X, jc, dV, U, e, d, co, hV, bu, dZ, ar, cs, av, fy, is, V, B, ap, ad, by, nV, cNp, ag, Bx, bg); #c1(TMPRSS6) c2(NP_705837) c3(11768) c4(37882, 50939, 63996, 24825, 77053) c5(yK, qf, awK, kY, b, Rr, aVh, bj, f, yo, pP, gU, A, I, B, yM, di, pq, u, y, oT); #c1(TMPRSS7) c2(NP_001036040) c3(11769) c4(37883, 50940, 63997, 24826, 77054) c5(IV); #c1(TMPRSS9) c2(NP_892018) c3(11770) c4(37884, 50941, 63998, 24827, 77055) c5(ga); #c1(TMSB10) c2(NP_066926) c3(11771) c4(37885, 50942, 63999, 24828, 77056) c5(dx, f, b, X, gG, iU, ak, dv, aX, hV, FN, av, u, og, il, cV, du, bp, T, DO, ag, gj); #c1(TMSB15B) c2(NP_919305) c3(11772) c4(37886, 50943, 64000, 24829, 77057) c5(A, cV, B, ad, P, kY, cs); #c1(TMSB4X) c2(NP_066932) c3(11773) c4(37887, 50944, 64001, 24830, 77058) c5(id, b, In, dB, kB, w, C, bw, al, A, U, O, V, aX, t, f, bu, cs, aCH, fy, iR, fs, yV, cd, ad, bfE, G, T, fO, by, ch, PY, bte, we, ag, rw, at); #c1(TMTC1) c2(NP_001180380) c3(11774) c4(37888, 50945, 64002, 24831, 77059) c5(ZF, ak, hW, dA); #c1(TMTC2) c2(NP_689801) c3(11775) c4(37889, 50946, 64003, 24832, 77060) c5(A, fP, qr, dA); #c1(TMTC3) c2(NP_861448) c3(11776) c4(37890, 50947, 64004, 24833, 77061) c5(iw, jT, hN); #c1(TMX1) c2(NP_10382) c3(11777) c4(37891, 50948, 64005, 24834, 77062) c5(m, fl); #c1(TMX2) c2(NP_001137484) c3(11778) c4(37892, 50949, 64006, 24835, 77063) c5(u, y); #c1(TMX3) c2(NP_061895) c3(11779) c4(37893, 50950, 64007, 24836, 77064) c5(kD, kH); #c1(TNC) c2(NP_002151) c3(11780) c4(37894, 50951, 64008, 24837, 77065) c5(dx, B, aw, EM, gG, dB, sJ, w, cU, bW, rF, adr, e, O, gO, dv, cy, LN, kJ, ban, dl, FN, aD, Hs, cNq, g, xc, aC, Dt, bp, ft, ME, zU, aiL, fx, hR, gg, su, rE, ag, qP, iT, bq, aA, kM, X, iP, eu, mk, iG, IW, U, y, co, f, aFQ, k, cs, av, fy, fY, Bs, Tn, IR, Fr, xd, dP, jR, ap, b, zH, Jg, jq, oi, cNs, ic, d, jh, jd, hV, es, ar, qT, u, da, fs, qL, LR, j, ad, nd, IX, iD, nV, kB, ch, aiJ, Ns, IS, OI, Bx, bL, A, sO, fr, zF, cNr, BY, ds, wf, nT, a HA, aX, ajn, kn, fq, F, gT, Ex, rR, HI, du, si, cV, Be, be, J, P, T, awi, nP, LI, cNt, qp, alA, Jh, Ng, pZ, bh, at, eG); #c1(TNFAIP1) c2(NP_066960) c3(11781) c4(37895, 50952, 64009, 24838, 77066) c5(m, fl, bb, aC, mS, by, sJ, y, cy, aA, u, o); #c1(TNFAIP2) c2(NP_006282) c3(11782) c4(37896, 50953, 64010, 24839, 77067) c5(BO, by, fy, ip, b, GK, X, re, F, GM, bu, GB, jV, ik, iT, at, o); #c1(TNFAIP3) c2(NP_006281) c3(11783) c4(37897, 50954, 64011, 24840, 77068) c5(dx, A, b, zH, X, iX, gn, Kc, ig, w, fH, nl, vp, U, HQ, m, cy, yX, dl, UM, aV, aE, o, da, ax, V, I, aC, du, gm, j, gY, vM, jT, fJ, be, dH, jH, ie, xe, fG, cT, ix, fP, iB, at); #c1(TNFAIP6) c2(NP_009046) c3(11784) c4(37898, 50955, 64012, 24841, 77069) c5(Kc, en, Pz, V, b, X, be, LM, dl, mk, A, sR, aZ, gj, gC, U, R); #c1(TNFAIP8) c2(NP_001071122) c3(11785) c4(37899, 50956, 64013, 24842, 77070) c5(A, aw, b, dB, fl, y, oy, jh, co, re, B, F, ar, cs, av, fy, u, jZ, iT, ad, jo, jT); #c1(TNFAIP8L2) c2(NP_078851) c3(11786) c4(37900, 50957, 64014, 24843, 77071) c5(C, m, jZ, iL, Kt); #c1(TNFAIP8L3) c2(NP_997264) c3(11787) c4(37901, 50958, 64015, 24844, 77072) c5(b); #c1(TNF) c2(NP_000585) c3(11788) c4(37902, 50959, 64016, 24845, 77073) c5(ml, dD, rr, dB, vB, aDg, en, hM, YH, aDH, JH, OH, e, uA, cp, gM, vr, it, LL, Zq, kJ, aDw, bJq, Pn, dl, nm, anY, aFA, ul, cl, asa, Id, TP, aNq, mz, oz, ajc, aC, zv, jD, aYt, wV, ft, ME, PL, aPi, hU, JN, acG, kN, awY, bly, pb, Iq, jE, aHc, aei, bjF, DO, tO, ag, axC, pH, bk, fD, aCQ, pt, aA, wz, aAp, asL, mZ, se, vi, X, Zl, vD, qG, eu, azp, ig, aZO, sF, iG, Ou, bw, vl, Oh, cM, yV, baR, pC, rY, fm, yX, aZX, aoM, hg, N, IC, av, CX, DL, fY, aFi, is, Hb, wJ, V, ae, bJR, bx, nl, cd, Dp, IR, hi, Fy, aDI, bAH, ar, jC, yA, xd, pk, bPQ, aY, ju, aGx, dY, ajM, aSm, HB, bJN, Xc, bNO, Dm, abs, oM, wl, aG, aFI, ck, Dr, bRT, Hr, tV, dk, aBt, bLv, bQO, cl, bOb, BH, LP, Ag, qH, bOm, cNu, pi, Qi, fw, bVj, ap, akP, fv, tg, aBI, wM, mR, atr, pY, dh, aNN, wK, adK, aP, il, cNK, Mi, aiU, bc, oK, gL, ad, aD, aFz, Za, rB, aZE, Eh, ahX, Jl, eF, iw, an, nV, eV, awH, aWi, aLQ, py, aZP, mA, ash, CL, qt, VT, bOO, Vs, cNN, zD, pE, jJ, IU, aED, kb, vd, fr, pR, In, gn, gN, QV, NA, jc, cNy, vZ, C, iL, DM, caX, Pl, jw, auC, fG, xT, cr, ajn, aQk, wG, aBa, aDQ, bQC, oE, RQ, qB, Jk, jQ, aeS, NO, aPI, dj, Ea, aZd, me, J, arx, bR, axl, My, yf, On, or, VF, bQA, aeq, mb, Ic, bOq, asx, jh, hz, gl, dx, vk, alz, WH, ox, iU, HG, eH, aWm, wj, aEO, bzL, Dy, aJE, eP, aK, fx, O, aDi, bQ, aAo, AX, gB, yh, jm, ik, IV, Zv, gd, oN, aoh, Ad, aeM, rV, bQI, nl, ZY, yO, gm, bp, MO, GI, x, aCP, fp, su, cNz, wh, aoC, gs, Vb, aZg, dS, fc, cNF, bPO, bMf, QD, nG, QI, sN, avb, Yh, RK, bRP, sU, bP, wa, fl, Jy, ie, aqu, aAb, aFu, Ps, bY, rd, mk, pX, aFm, ur, afo, kY, cA, Iw, U, Wl, amx, co, BL, aoR, IS, f, aDD, fb, bu, tv, aHa, iJ, UM, Zn, ago, aFZ, bRL, be, aog, Ov, HJ, Bs, aSz, NZ, byO, gv, zJ, YS, ny, hg, Hh, bd, vF, qD, cnc, hV, aH, nb, cuT, aMQ, aAG, Oa, jo, jd, ard, aGl, tl, aLP, apT, bX, vf, Ig, cNv, am, nX, Pv, ak, qz, atU, qk, oi, oR, z, hr, Al, vn, aYA, d, ec, Pk, bb, kW, Zk, MX, PA, q, zx, age, ky, ff, hb, Dq, bes, dQ, yW, gT, iR, o, fh, RG, alh, kF, YL, nb, kt, LR, wF, aDv, aDU, aZ, aKe, aLy, wd, jG, jU, na, jH, rQ, jR, cNP, uc, ch, Y, GM, xU, a of, xY, aer, bQv, OI, HV, wR, Xm, anE, Jh, cNA, MZ, xZ, qd, Ik, pD, HS, eQ, sQ, al, aSh, sb, bbE, bJz, aci, bn, wN, IE, oJ, bnA, aEU, hN, azx, aqz, fP, cNB, aq, bJy, ax, ez, aMH, ww, Oq, sB, Fs, gV, dt, dU, T, II, Ez, hi, ya, tf, ce, hq, G, arr, sE, ajx, Dl, auy, iB, rw, cNE, gf, Nv, aw, aAB, dN, zX, rR, aiu, bRw, DT, iC, Ka, eW, bwo, aoL, et, iq, fR, eD, sX, iy, Vx, aDx, bJJ, Li, aGV, nB, fH, oP, g, ha, aBs, aAL, bK, cnV, iv, po, fO, Yl, vc, Re, aZY, vM, aqg, hR, FG, bnb, aDb, fy, OR, YA, hn, BX, m, cT, xb, pW, vJ, aZD, rn, EO, aEq, sa, kM, gE, bjA, cG, cY, sj, bJA, jz, kB, cGA, NH, aRZ, vp, acM, ai, Jo, rN, tp, bQL, px, pp, hm, lb, ml, B, ja, k, Us, bv, oD, qq, pP, iT, yJ, SA, azd, bQE, yY, bj, fl, v, BV, alf, bap, eX, bt, By, gC, iA, hw, JY, cf, QE, in, vH, bJm, aNw, cNM, bxn, iu, fW, cNG, aHB, fn, ach, ad J, bW, b, LX, aF, jL, lb, wA, tN, au, Ny, tG, bat, NY, bPP, wZ, aem, ZR, aiT, gR, zc, re, gU, do, fJ, vu, WN, hip, ri, sz, cNH, Zz, wp, ir, bAC, ht, vS, fz, cz, bOp, IX, IJ, aGn, wx, et, M, Lt, axM, alH, xL, pS, aFw, DR, hT, SJ, ex, kC, IS, zO, D, IA, GK, oC, bMZ, aMI, cLL, SS, rp, mW, axA, og, xf, Iv, rj, h, wf, xe, eh, jx, aDE, qs, bdr, sG, hP, cU, tF, iZ, aoQ, aW, cNO, afp, sV, bFX, yd, nk, du, yM, jM, GS, Ej, ti, xS, ji, aDA, jl, aM, bpG, bmV, da, NG, MP, ajv, zM, cND, gu, aPd, at, eG, ajD, cxl, cNJ, gK, vW, pV, Ob, Gm, F, gG, aN, eC, Zs, sJ, w, bV, cO, yi, Mn, gO, QJ, aXC, dv, cy, qc, t, pq, Bk, aZv, caV, aLG, Mu, sO, tE, JF, Hs, blz, gl, R, xy, cB, qm, fK, aDk, ol, sH, gJ, bEk, tz, gY, Lz, xO, od, PZ, jT, dL, dH, azM, ata, LW, ro, fN, Ox, acs, aV, aFX, we, IN, i, dc, bnn, bsZ, awg, gk, td, Kt, aHb, aFy, mE, Kc, fU, os, cNw, IW, Co, y, cNL, ed, aCy, ip, un, fi, cV, bPv, vQ, pl, Em, aFL, cc, cs, mm, qJ, bm, ye, uO, Be, cj, em, jB, ali, agS, qb, eM, afB, Tn, Xr, pr, WM, azD, Io, bQV, cK, aol, wu, aaa, dP, Bm, er, PY, aNp, bT, aDL, vC, gA, TQ, HL, Im, apD, ci, aFP, vl, gz, tr, vh, eR, DJ, Ey, id, yU, ic, Og, xg, axg, ey, gZ, Bb, aO, yK, Fp, xi, Iz, aDO, azo, iW, jV, es, acO, eA, cNx, boq, ac, bQo, gu, bf, aOo, u, nj, cNC, TO, PJ, qy, Pz, I, im, qA, el, by, BZ, GZ, qp, aYz, tA, GW, yG, bPT, QN, pe, cNI, eQ, aE, ih, wP, ix, aFk, dn, I, aff, ccB, Ku, azt, bL, A, DB, xa, Sc, Mj, sv, zz, BY, NT, di, Vy, bJv, fs, sx, aCX, c, xw, aX, sS, ty, kn, fq, aEz, bQJ, eE, qr, az, Vr, n, Dg, alb, brr, jZ, aFc, amT, aAq, ma, si, vg, aQr, cfb, wE, GB, gj, P, bkt, j, bh, HK, pw, gF, SB, qe, ceZ, Lc, zE, xk, MU, zl, Fo, bbB, iD, bHV, XO, aT, Nu, iE, oT); #c1(TNFRSF10A) c2(NP_003835) c3(11789) c4(37903, 50960, 64017, 24846, 77074) c5(dx, by, A, jT, b, k, X, gE, jz, dB, eR, O, cNQ, w, z, ct, U, al, aW, jQ, gM, co, aX, h, B, F, q, jV, bu, fr, do, hN, ik, y, cs, ar, av, jM, u, aE, e, d, iP, V, afW, ft, du, fO, gm, gL, J, W, HQ, Ei, T, II, x, aC, fx, ad, fp, ac, pq, jE, py, cz, bm, P, jR, xe, cT, qP, i, I); #c1(TNFRSF10B) c2(NP_003833) c3(11790) c4(37904, 50961, 64018, 24847, 77075) c5(da, fr, A, kE, b, X, iP, jz, dB, cNQ, w, kY, O, bw, U, y, jQ, fG, co, aX, kJ, E, AX, f, F, q, vQ, bu, gX, ar, B, cs, av, fy, u, cl, g, V, I, m, aC, ft, fO, gm, gL, J, W, dU, P, T, II, x, cy, fx, ad, fp, ct, gt, bm, by, ag, cT, jT, i, fl, bp, h, ap); #c1(TNFRSF10C) c2(NP_003832) c3(11791) c4(37905, 50962, 64019, 24848, 77076) c5(f, b, X, gG, eR, A, NH, Em, O, Ne, m, S, h, nU, q, jV, hN, ar, B, cs, av, ag, ans, cV, fO, ad, aos, aX, iw, NG, u, ag, pH); #c1(TNFRSF10D) c2(NP_003831) c3(11792) c4(37906, 50963, 64020, 24849, 77077) c5(A, b, eR, O, aAH, co, aX, iP, h, B, jV, y, cs, fy, u, cV, aC, gL, by, T, fO, ny, ad, BX, ag); #c1(TNFRSF11A) c2(NP_001257880) c3(11793) c4(37907, 50964, 64021, 24850, 77078) c5(dx, en, b, qd, fr, id, cNT, kB, w, yU, bZ, zK, vl, A, yw, y, cp, d, m, co, aX, Zq, zJ, h, B, e, aG, cNU, bdT, mL, k, O, mm, fy, u, aE, o, ax, cNR, ae, aC, sj, du, fO, ft, dv, pi, be, dH, jH, sS, mb, zM, qd, cT, cNS, aA, at, zl, ap); #c1(TNFRSF11B) c2(NP_002537) c3(11794) c4(37908, 50965, 64022, 24851, 77079) c5(dx, jK, B, aw, dB, eH, HC, hM, cO, aZu, bf, pz, O, gO, dv, iy, kJ, axd, bdT, mR, dH, bQe, aC, zv, afh, fO, bp, azo, FW, pq, jE, fy, abv, O, sS, rJ, ag, fD, cNs, aA, wz, id, Al, akL, vD, jz, eu, NF, cNW, bW, vl, y, f, N, bu, cp, bm, vR, V, nl, cd, gv, eX, rT, pi, wR, du, dO, vH, ap, b, mn, vY, yU, z, ey, aO, bb, zJ, bX, sO, q, zx, cNV, mL, aRY, u, aE, o, fh, I, by, pF, aZE, afj, hU, LO, azr, aG, bq, I, D, TP, zl, bL, A, qd, fr, cNT, zz, di, pu, bZ, zK, al, aFx, rH, jQ, oy, uK, yw, aV, HP, ax, m, sj, be, bR, T, II, aGN, ft, aM, qp, mb, zM, agc, bh, at, eG, gl); #c1(TNFRSF12A) c2(NP_057723) c3(11795) c4(37909, 50966, 64023, 24852, 77080) c5(dx, bm, A, aw, b, X, Ik, eC, w, iL, Fr, vp, O, sx, aO, iy, vr, co, aX, DG, ml, f, q, bu, cU, mR, y, hb, ar, aV, u, dh, cc, g, du, jE, I, sB, UG, gm, fO, J, dv, fy, bb, iA, by, jU, eH, aH, Lc, py, iR, hT, fw, B, bq, aA, Xe, aG); #c1(TNFRSF13B) c2(NP_036584) c3(11796) c4(37910, 50967, 64024, 24853, 77081) c5(fn, WH, en, Zq, zH, cNX, oz, eu, sJ, sF, IS, e, O, d, m, aem, bb, b, pp, eX, Em, cNZ, cr, zQ, gl, aFM, Jo, aC, awD, J, fO, asM, da, ee, cOa, cy, jT, pi, uf, aei, bjF, eB, cT, cNY); #c1(TNFRSF13C) c2(NP_443177) c3(11797) c4(37911, 50968, 64025, 24854, 77082) c5(fn, WH, b, fr, mW, m, jl, t, aAJ, Em, oO, aV, gl, da, fs, im, aC, gm, fO, ft, G, eR, jT, fJ, fc, cOb, cT, zD); #c1(TNFRSF14) c2(NP_001284534) c3(11798) c4(37912, 50969, 64026, 24855, 77083) c5(dx, b, ig, y, jh, cy, fq, xY, ik, aV, u, aE, du, il, m, aC, bK, be, gL, fO, jT, jH, iY, fc, rq, bY, xU, akm, fP, qO, fl, bq); #c1(TNFRSF19) c2(NP_001191388) c3(11799) c4(37913, 50970, 64027, 24856, 77084) c5(co, aX, V, bp, w, ic, Qt, U, aV); #c1(TNFRSF1A) c2(NP_001056) c3(11800) c4(37914, 50971, 64028, 24857, 77085) c5(dx, eX, ig, Io, bx, rR, gG, cOc, eW, sJ, w, bzL, cO, bf, e, dv, LL, LN, t, Bk, DM, Pn, dl, do, mR, pq, gl, RQ, mz, aBs, aC, bkx, du, gm, fO, cdF, vc, aE, od, aPi, x, Lz, jT, dL, qq, dH, huh, qt, Vh, aHc, fc, bjF, tO, ag, axC, bk, i, dc, bq, aA, jl, bT, rn, aWj, mZ, il, bQO, X, jz, mk, ix, ag J, vl, cM, co, DM, f, bu, av, bm, ye, be, ae, nl, v, gv, Fy, bxn, cl, anf, aY, iV, xe, fG, nj, Dm, ij, aFI, asL, b, fN, yU, tG, z, NY, LP, cy, d, bb, zc, Qi, gz, CR, q, dQ, tg, pB, n, u, dh, o, fh, da, fs, I, Dg, LR, gL, by, cOd, Fo, rw, aZ, qV, MO, jH, an, alH, ch, aLQ, xU, gd, aFi, I, TP, Jh, bL, aBt, iL, k, agH, pR, Ik, axA, vZ, vq, gE, al, bj, jQ, m, aX, or, aQk, h, qr, y, aV, aq, sH, pE, ma, sB, dt, P, j, cr, gF, On, aM, nk, eG, gJ, Ic, HM, Dl, fP, al at, Nu, rr, gl); #c1(TNFRSF1B) c2(XP_011540365) c3(11801) c4(37915, 50972, 64029, 24858, 77086) c5(dx, by, eX, WH, dD, aN, eW, bzL, cO, vp, aK, e, O, cp, bQ, cy, ago, Pn, dl, do, mR, wY, Dc, pq, gl, TP, mz, aBs, aqO, aFP, bK, sH, du, fO, tz, MO, vc, jT, dH, Lz, Vb, tO, ag, cT, dc, aCQ, bg, aA, jl, rn, aWj, anY, X, rd, mk, ix, afo, iG, bf, cA, If, U, cM, tp, BL, DM, f, N, cs, bu, Us, oD, bBM, ye, zO, QD, em, V, ae, nl, Fy, cl, anf, rK, aY, jR, xe, aC, tl, iu, ap, aFI, aEg, Bk, b, eR, Hr, boE, yU, tG, z, aYA, d, jh, bb, zc, vj, gz, ar, n, jG, u, dh, o, fh, da, kF, I, qA, el, LR, gL, ad, qV, jU, jH, ao, hU, aE, gd, aFi, gl, I, Xm, y, bL, pR, gE, HJ, mW, axA, di, vg, eM, fs, vl, m, qs, aX, LI, kn, fq, h, M, bjP, ik, RQ, Dg, aV, pE, ax, cV, sj, be, J, vF, W, P, T, j, LS, cz, iv, aM, bQA, nk, Y, eG, aQk, DI, fP, bh, at, Nu, oT); #c1(TNFRSF21) c2(NP_055267) c3(11802) c4(37916, 50973, 64030, 24859, 77087) c5(ao, A, BX, ip, sG, v, fl, ny, wX, eG); #c1(TNFRSFGB) c2(NP_003814) c3(11803) c4(37917, 50974, 64031, 24860, 77088) c5(da, fl, aw, b, k, X, OC, jz, dB, pD, BY, w, bf, U, e, y, jQ, d, jh, jT, jl, fv, kn, q, bu, anY, ik, O, cs, iJ, ar, av, u, o, NO, g, V, il, m, aC, be, gm, fO, ad, T, x, by, cjQ, aM, jH, hU, bm, zM, ag, fP); #c1(TNFRSF8) c2(XP_011540743) c3(11804) c4(37918, 50975, 64032, 24861, 77089) c5(WH, gz, anh, b, asx, ig, bWw, jz, eu, pD, wy, mk, aeD, NH, Iv, bWv, as, al, G, jD, y, jQ, m, aem, aX, ajn, wP, fB, t, zL, f, zh, Lo, cy, M, apP, Zs, jU, iv, Tr, fH, Ah, DY, u, sH, ctZ, zH, wF, aC, Cq, fO, gm, gL, J, cOe, GIF, fp, T, j, Tp, jT, Lx, yW, aph, f J, P, TY, wV, NG, cOf, Ck, asM, aE, fG, gd, cT, pH, gR, fq, bh, jl, TA, yh); #c1(TNFSF10) c2(NP_001177871) c3(11805) c4(37919, 50976, 64033, 24862, 77090) c5(dx, en, aw, gG, dB, w, fh, bf, oU, O, M, dv, cy, iR, t, AX, aDx, e, FN, mR, rb, oP, g, awV, lb, nl, du, fO, gm, bp, ft, x, fx, jT, pq, jE, QJ, oQ, BX, YA, Nv, OJ, ag, cT, i, vJ, pt, jC, bT, axq, cY, aiE, jz, kB, kY, bTn, bw, U, y, co, pp, f, cs, vQ, bu, B, JX, iv, av, fy, bm, iT, fi, V, Ov, nl, bt, Fr, iA, cOg, JY, py, kJ, P, jR, aoD, fG, qO, oM, ci, ap, ny, b, eR, oi, z, ey, zx, Mr, d, jh, bb, re, hV, q, jV, es, X, ar, ff, pB, jG, u, aE, o, iP, kF, Zz, il, iE, gL, ad, vS, jU, iw, nV, ch, kM, Ou, fl, aff, BK, C, A, iG, k, fr, Ik, bgW, pD, bry, lv, iL, eM, fs, JK, Ir, pF, m, MT, aX, I, Qm, h, F, jQ, yw, cU, aC, hN, ik, n, aV, aq, jZ, cV, be, J, W, dU, jo, QI, T, ll, ji, aos, gF, by, aM, ip, aAu, G, zM, j, Af, gE, eG, ja, aAv); #c1(TNFSF11) c2(NP_003692) c3(11806) c4(37920, 50977, 64034, 24863, 77091) c5(dx, A, jT, cwD, qd, fr, cjK, akL, vD, jz, dB, cNT, cNW, yU, lv, nl, z, zK, bf, vl, bu, yw, y, cp, oy, m, qf, co, aX, b, zJ, amK, B, F, q, bEe, zx, sO, fy, aRY, Dg, ar, mm, dH, u, aE, Fg, zH, hh, o, be, jQ, aC, adh, zM, du, arD, fO, azo, dt, dv, T, bAH, bq, aZE, ft, aM, bPT, ao, qp, sS, mb, bX, aV, xU, fG, cT, aFi, cNS, cC, D, aA, zl, cxI, ap); #c1(TNFSF12) c2(NP_003800) c3(11807) c4(37921, 50978, 64035, 24864, 77092) c5(dx, A, w, O, m, dv, B, bu, aC, aO, cs, u, I, qL, du, by, ad, pS, hT, aA, y, aG); #c1(TNFSF12-TNFSF13) c2(NP_742086) c3(11808) c4(37922, 50979, 64036, 24865, 77093) c5(dx, m, by, du, I, qL, hT, B, O, dv, ad, w, aO, A, cs, aC, aA, bu, u, y); #c1(TNFSF13B) c2(NP_001139117) c3(11809) c4(37923, 50980, 64037, 24866, 77094) c5(iX, sJ, cO, vp, e, O, cy, Os, kJ, t, dZ, cl, aMq, fH, gl, lb, sH, gm, fO, ft, BW, vM, jT, aOo, OR, fc, bY, ag, cT, axC, aA, fl, eu, cOh, mk, ix, dV, Ou, II, Ov, aoR, yX, B, Em, aFL, ae, bTu, aGa, f J, acS, acR, apD, bAH, fn, WH, kE, b, zH, eR, d, cOi, jV, fr, zm, dQ, gL, G, pD, Io, jH, an, xU, zO, A, aoG, gn, mW, gE, cOj, m, jl, aC, aV, be, J, P, j, pp, iB, at, eG); #c1(TNFSF13) c2(NP_001185552) c3(11810) c4(37924, 50981, 64038, 24867, 77095) c5(dx, WH, fl, b, zH, eu, ig, w, fH, U, e, O, WI, d, m, co, cy, Zq, pp, fq, h, bu, dQ, cs, ar, aV, u, gl, V, aC, Oq, du, fO, gm, j, J, W, P, dv, T, Il, Io, vM, gn, jl, by, fJ, jU, jT, dS, fc, ie, cT, bq, at); #c1(TNFSF14) c2(NP_003798) c3(11811) c4(37925, 50982, 64039, 24868, 77096) c5(b, cG, dD, Jd, EN, xb, NH, jL, IW, bf, DK, U, y, cy, aX, fq, re, q, vQ, bu, lY, do, aO, fP, gg, aV, iT, vR, V, I, aC, sj, be, gm, fO, by, P, T, bb, jT, jU, aM, ao, qt, NG, xU, cT, pH, fl, rw, aA); #c1(TNFSF15) c2(NP_001191273) c3(11812) c4(37926, 50983, 64040, 24869, 77097) c5(dx, Jy, b, qd, X, Dy, acO, hm, rr, px, eE, av, aE, da, be, cOk, aC, du, gY, aGU, jH, acN, xU, fP, Bm, hT); #c1(TNFSF18) c2(NP_005083) c3(11813) c4(37927, 50984, 64041, 24870, 77098) c5(fq, h, J, fO, ig, cT, fP, gE, u); #c1(TNFSF4) c2(NP_001284491) c3(11814) c4(37928, 50985, 64042, 24871, 77099) c5(dx, en, b, gE, jz, eR, ig, di, iL, eO, cOI, bf, baF, aO, jQ, m, dv, bb, h, do, fH, aE, aFc, qO, du, J, j, IR, P, fO, x, cy, fJ, jU, yG, fw, fP, fD, fl, bq, bT, ap); #c1(TNFSF8) c2(NP_001235) c3(11815) c4(37929, 50986, 64043, 24872, 77100) c5(b, asx, wy, mk, baF, oy, co, jl, fq, h, fp, jU, fH, aE, aFc, da, si, UG, J, fO, GlF, T, jT, fJ, ac, DO, zM, cT); #c1(TNFSF9) c2(NP_003802) c3(11816) c4(37930, 50987, 64044, 24873, 77101) c5(dx, en, b, X, A, di, baF, dv, bb, kn, B, bu, ar, RF, aV, aFc, cV, aC, du, gm, fO, J, P, wA, cT, bT, aG); #c1(TNIK) c2(NP_001155032) c3(11817) c4(37931, 50988, 64045, 24874, 77102) c5(Pz, V, b, mk, U, at, u, y); #c1(TNIPl) c2(NP_001239315) C3(11818) c4(37932, 50989, 64046, 24875, 77103) c5(da, m, nl, aWM, aC, aF, ss, gn, j, cy, I, i, Us, iB, JH, xe, u); #c1(TNIP2) c2(NP_001154999) c3(11819) c4(37933, 50990, 64047, 24876, 77104) c5(aC, J); #c1(TNIP3) c2(NP_001122315) c3(11820) c4(37934, 50991, 64048, 24877, 77105) c5(aF, aAb, dA); #c1(TNK1) c2(XP_011522347) c3(11821) c4(37935, 50992, 64049, 24878, 77106) c5(ag, J, o); #c1(TNK2) c2(NP_001010938) c3(11822) c4(37936, 50993, 64050, 24879, 77107) c5(BO, A, Ll, b, bm, B, dB, bu, hS, jo, ar, ff, hb, fy, ji, by, u, y); #c1(TNKS2) c2(NP_079511) c3(11823) c4(37937, 50994, 64051, 24880, 77108) c5(d, co, aw, re, e, cU, iT, tl, bb, yA, u, iA, y, ap); #c1(TNKS) c2(NP_003738) c3(11824) c4(37938, 50995, 64052, 24881, 77109) c5(aw, Ob, k, y, co, cy, b, bu, O, iR, aO, cV, fO, by, aNS, T, bb, fx, u, i, fl, I, aA, ap); #c1(TNMD) c2(NP_071427) c3(11825) c4(37939, 50996, 64053, 24882, 77110) c5(em, LS, I, mz, eX, et, O, vc, aFm, o, baZ, bf, bb, aA, fy, aW, aM); #c1(TNNC1) c2(NP_003271) c3(11826) c4(37940, 50997, 64054, 24883, 77111) c5(ml, aw, b, zF, w, aYv, Bo, rF, e, y, aoa, cy, kJ, cK, f, mR, cOm, ar, gg, fy, u, d, cOn, j, awi, sK, ag); #c1(TNN) c2(NP_071376) c3(11827) c4(37941, 50998, 64055, 24884, 77112) c5(u); #c1(TNNI1) c2(NP_003272) c3(11828) c4(37942, 50999, 64056, 24885, 77113) c5(mm, cy, fz); #c1(TNNI2) c2(NP_001139313) c3(11829) c4(37943, 51000, 64057, 24886, 77114) c5(oD, chH); #c1(TNNI3) c2(NP_000354) c3(11830) c4(37944, 51001, 64058, 24887, 77115) c5(ml, cOp, HD, dE, cOr, id, cO, cM, ana, c, akK, bb, sO, akP, mR, cOq, oD, hj, dh, o, wY, aYv, sj, tz, YS, ar, cK, hR, Bn, sK, aY, cOo, fD, dc, bg); #c1(TNNT1) C2(NP_001278703) c3(11831) c4(37945, 51002, 64059, 24888, 77116) c5(AC, el, cOs, cK); #c1(TNNT2) c2(NP_001001430) c3(11832) c4(37946, 51003, 64060, 24889, 77117) c5(dx, cuq, ml, sO, dE, cOr, cyG, cO, cOu, aoa, bb, cOt, sL, mR, hj, du, aYv, mc, dt, cK, hR, cOv, sK, bgc, I, bq, at, gw, ap); #c1(TNNT3) c2(NP_001036245) c3(11833) c4(37947, 51004, 64061, 24890, 77118) c5(Yj, chI, chH); #c1(TNP1) c2(NP_003275) c3(11834) c4(37948, 51005, 64062, 24891, 77119) c5(NT, am, b, Ho, be, wn, aC, u, y); #c1(TNP2) c2(NP_005416) c3(11835) c4(37949, 51006, 64063, 24892, 77120) c5(wn, NT, aE, am); #c1(TNP01) c2(NP_002261) c3(11836) c4(37950, 51007, 64064, 24893, 77121) c5(aXG, bL, bW, b, bx, jz, eu, kW, D, Iv, pu, cO, bf, U, ceq, aO, jQ, cy, aoR, h, f, q, Vl, dQ, y, cs, gg, aM, u, jH, sB, V, ae, bwk, aC, aWj, LR, fO, J, j, dB, nd, P, fl, T, ll, jT, aXp, DM, ao, hU, caN, pS, bm, mb, aDH, xU, zM, gd, xP, fP, aBz, bLV, QP, at, BK); #c1(TNP02) c2(NP_001129667) c3(11837) c4(37951, 51008, 64065, 24894, 77122) c5(bj, kF); #c1(TNP03) c2(NP_001177957) c3(11838) c4(37952, 51009, 64066, 24895, 77123) c5(m, hg, kG, aC, cOw, j, P, ll, oD, bT); #c1(TNRCI8) c2(NP_001073964) c3(11839) c4(37953, 51010, 64067, 24896, 77124) c5(bg); #c1(TNRC6A) c2(NP_055309) c3(11840) c4(37954, 51011, 64068, 24897, 77125) c5(V, b, bu); #c1(TNRC6B) c2(NP_001020014) c3(11841) c4(37955, 51012, 64069, 24898, 77126) c5(wh, A, kF, oJ); #c1(TNR) c2(XP_011508249) c3(11842) c4(37956, 51013, 64070, 24899, 77127) c5(oy, ak, b, sH, nU, Fs, v, jR, tO, w, ds, fl, Lw, HG, u); #c1(TNSI) c2(NP_072174) c3(11843) c4(37957, 51014, 64071, 24900, 77128) c5(A, b, jE, mW, O, w, iG, cO, U, y, m, aX, ni, f, q, bu, ra, B, av, DF, u, gl, ff, V, J, by, jo, ca, ao, fy, bm, Nq, TX, I); #c1(TNS2) c2(NP_056134) c3(11844) c4(37958, 51015, 64072, 24901, 77129) c5(aSV, w, cc); #c1(TNS3) c2(XP_011513778) c3(11845) c4(37959, 51016, 64073, 24902, 77130) c5(IZ, lw, u, bzf); #c1(TNS4) c2(NPJI6254) c3(11846) c4(37960, 51017, 64074, 24903, 77131) c5(co, aX, V, b, cY, B, bp, bu, ag, A, pw, U, by); #c1(TNXB) c2(NP_061978) c3(11847) c4(37961, 51018, 64075, 24904, 77132) c5(b, EM, iP, iG, y, cOy, yg, pp, Ex, aW, sV, oD, av, aE, o, da, m, aC, afh, vc, T, cOx, cOz, aeC, afj, qT, aiJ, P, aSM, JO); #c1(TOB1) c2(NP_001230806) c3(11848) c4(37962, 51019, 64076, 24905, 77133) c5(mZ, co, b, eG, bp, bu, aOQ, kB, NB, by, u, y, oP); #c1(TOB2) c2(NP_057356) c3(11849) c4(37963, 51020, 64077, 24906, 77134) c5(gB); #c1(TOLLIP) c2(NP_061882) c3(11850) c4(37964, 51021, 64078, 24907, 77135) c5(aF, aoC, bb, xa, jO); #c1(TOM1) c2(NP_001129201) c3(11851) c4(37965, 51022, 64079, 24908, 77136) c5(dj, ak, ns, G, nm, nt, nq, nr, nn, no, np); #c1(TOM1L1) c2(NP_005477) c3(11852) c4(37966, 51023, 64080, 24909, 77137) c5(A); #c1(TOMM20) c2(NP_055580) c3(11853) c4(37967, 51024, 64081, 24910, 77138) c5(f); #c1(TOMM34) c2(NP_006800) c3(11854) c4(37968, 51025, 64082, 24911, 77139) c5(x, aW); #c1(TOMM40) c2(NP_001122389) c3(11855) c4(37969, 51026, 64083, 24912, 77140) c5(gk, vQ, aY, cbk, he, eX, tF, aaZ, o, dc, cA, u, cM, ap); #c1(TOMM70A) c2(NP_055635) c3(11856) c4(37970, 51027, 64084, 24913, 77141) c5(cbJ, sE); #c1(TONSL) c2(NP_038460) c3(11857) c4(37971, 51028, 64085, 24914, 77142) c5(dx, du, f, kF, b); #c1(TOP1) c2(NP_003277) c3(11858) c4(37972, 51029, 64086, 24915, 77143) c5(A, aw, b, fr, QB, hS, w, U, y, co, aX, t, h, f, q, nZ, gX, hN, gP, cs, gg, fy, u, fU, kF, V, cV, fO, J, gL, ad, G, Jc, j, pt, fx, et, pq, iw, rQ, aum, Jh, ie, B, cb, i, oM, bp); #c1(TOP2A) c2(NP_001058) c3(11859) c4(37973, 51030, 64087, 24916, 77144) c5(A, aw, b, X, afY, gw, atK, w, jj, bo, O, U, e, y, d, fe, co, aX, hm, jd, t, h, f, q, bu, dl, ar, B, iv, fv, av, cq, u, iT, is, iF, fU, kF, V, I, qL, J, by, G, T, iD, fH, x, fx, oV, f J, JY, jT, fy, auK, DO, agb, ag, cT, fl, i, jk, Ez, apT, hd, rb, ap); #c1(TOP2B) c2(NP_001059) c3(11860) c4(37974, 51031, 64088, 24917, 77145) c5(co, dn, b, k, PL, h, B, J, jV, M, cT, A, cV, cO, fy, Eg); #c1(TOP3A) c2(NP_004609) c3(11861) c4(37975, 51032, 64089, 24918, 77146) c5(b, k, h, P, cl, i, Nh, fx, u, y); #c1(TOP3B) C2(NP_001269042) c3(11862) c4(37976, 51033, 64090, 24919, 77147) c5(bg); #c1(TOPBPI) c2(NP_008958) c3(11863) c4(37977, 51034, 64091, 24920, 77148) c5(ar, V, b, ag, X, fj, f, IX, cT, T, OI, bw, asa, av, Co, u, U, y); #c1(TOPORS) c2(NP_001182551) c3(11864) c4(37978, 51035, 64092, 24921, 77149) c5(A, nQ, fr, nW, B, cOA, co, T, yn, fy); #c1(TOR1A) c2(NP_000104)

c3(11865) c4(37979, 51036, 64093, 24922, 77150) c5(akC, lb, bA, ig, WA, cOD, bf, cOC, bj, pi, bfe, bfJ, aGT, pL, wr, f, aiY, Wz, zb, cEy, qu, Wy, ec, bAq, afx, ayv, bK, cOE, rV, aVc, bAv, aGR, Ww, xM, cOB, bDS, aVk, bM, at); #c1 (TOR1A1P1) c2(NP_056417) c3(11866) c4(37980, 51037, 64094, 24923, 77151) c5(bM, xl, fl); #c1(TOR1A1P2) c2(NP_071742) c3(11867) c4(37981, 51038, 64095, 24924, 77152) c5(bM); #c1(TOR1B) c2(NP_055321) c3(11868) c4(37982, 51039, 64096, 24925, 77153) c5(en, bM, at, bDS); #c1(TOR2A) c2(NP_001078816) c3(11869) c4(37983, 51040, 64097, 24926, 77154) c5(dx, ed, aDb, dv, cV, du, at); #c1(TOX2) C2(NP_001092266) c3(11870) c4(37984, 51041, 64098, 24927, 77155) c5(co, GF, bp, b, cV); #c1(TOX3) c2(NP_001073899) c3(11871) c4(37985, 51042, 64099, 24928, 77156) c5(Ag, ao, b, cHc, X, fE, ak, dT, afn, age, kY, zo, PT, av, u, y); #c1(TOX4) C2(NP_001290452) c3(11872) c4(37986, 51043, 64100, 24929, 77157) c5(aw, V, b, gm, ad, cU, T, cB, cs, U); #c1(TOX) c2(NP_055544) c3(11873) c4(37987, 51044, 64101, 24930, 77158) c5(fh, bb, b, dA, cV, bq, qt, at, u, Fg, ap); #c1(TP53A1P1) c2(NP_001182123) c3(11874) c4(37988, 51045, 64102, 24831, 77159) c5(by, co, b, f, q, gL, bu, A, T, B, bt, fy, bp, bm); #c1(TP53BP1) c2(NP_001135451) c3(11875) c4(37989, 51046, 64103, 24932, 77160) c5(f, aw, b, X, mW, kB, w, NH, ic, kY, aud, bw, O, A, e, y, d, m, co, pp, re, hV, F, bu, azu, ik, B, ar, av, u, gl, iT, Bd, dn, aeM, gm, fO, T, avd, jT, jG, cq, nV, ip, NG, kM, ag, cT, pH, tl, I, Bi); #c1(TP53BP2) c2(NP_001026855) c3(11876) c4(37990, 51047, 64104, 24933, 77161) c5(by, jT, b, ie, q, J, od, o, iL, iv, Dd, ZU, aol, bu, y); #c1(TP53) c2(NP_000537) c3(11877) c4(37991, 51048, 64105, 24934, 77162) c5(jp, ml, Zy, Vz, Tw, Ip, en, bbG, bkJ, Ir, aoK, pz, anW, bvN, QQ, buW, apw, nZ, dl, kz, mR, cl, xl, EM, aHK, cc, fe, asQ, cOG, aC, cOY, HH, aow, ft, ME, fl, aiL, bug, aJT, aMJ, hue, aEY, pq, pb, jE, JD, bm, hx, DO, OJ, ag, bkQ, fD, cPg, pt, aA, Mg, avz, cU, mZ, cOP, aal, X, oa, eu, atK, afR, dV, iG, bo, ajw, bw, vl, Oh, avA, cM, pC, rY, cPk, bxG, ajx, aAy, AZ, hg, N, e, aFQ, Mp, avf, Qw, av, CX, OT, fY, is, fi, cOW, V, ae, hO, Cq, cd, aEP, aJs, cOR, ar, aif, QJ, bkO, fJ, ahT, if, aYM, bXr, aY, af, cPy, kJ, To, dY, xe, aAN, gR, bXc, oM, qh, kD, ap, cPn, afE, cOL, aGv, cgc, Hr, dk, cuj, Lq, aoi, ceX, azn, cOF, js, Ag, qH, Be, oB, auE, fv, tg, oO, aJF, da, fs, bEg, il, Mi, agR, gL, ad, bUm, GQ, rB, bkR, aeC, aJQ, aen, WZ, iw, ao, nV, agQ, Yg, hp, aoA, agb, fg, yA, cS, zD, QU, aBx, rj, fr, pR, gn, gN, IY, jc, C, iL, gE, zK, nT, aJi, jQ, Zh, cdg, awz, SI, vS, cen, oE, oJ, apb, Jk, jx, bfG, bbF, m, an, YR, be, dB, J, aJF, cq, pc, VF, bEy, Zb, YX, Jh, Ic, cOX, OW, bkB, fP, Af, E, rb, gl, bck, YZ, jK, cOM, cOV, awh, ctB, HG, auJ, aVG, Ig, hC, YB, avY, cPd, cOT, oU, xl, RR, bnm, Wp, DE, XZ, tF, kT, yh, bkr, axd, Gp, FN, jm, Xi, QB, ik, IV, Zv, rR, aHi, og, cOQ, aeM, asr, nl, du, yO, gm, bov, Ce, ra, asz, x, avi, cPq, fp, bfD, amq, MS, wh, Lz, BX, dS, fc, bbH, QD, adr, iH, aex, jB, a KG, bT, ib, PG, fl, gN, cjJ, ie, afY, iP, py, oH, mk, Xc, Ku, kY, et, act, O, WY, aQu, BL, sT, f, Zg, aJS, bu, tv, cPc, iJ, aye, cPh, aEs, aJW, d, auP, fC, bku, Bs, gv, wV, acM, Os, YS, yF, bks, ny, Qt, cl, mF, cuh, pJ, aH, gt, anG, aYm, QG, zJ, jo, Le, bkU, tl, pv, Dr, cOS, ahU, am, GD, PA, Qy, QR, oi, jj, z, vn, QE, cPe, ec, biX, bb, Dx, eA, jd, aiq, bfM, aBG, q, zx, nF, RF, hb, fE, hV, aM, iR, o, ff, aWU, Ji, Xp, VD, qL, Fw, LR, dT, bub, aZ, aJP, rO, Ut, jU, Tz, bru, ch, ale, GM, apt, aof, OI, bis, QP, anE, sF, pK, qd, aJG, bPi, cOH, Rd, tw, cOJ, JC, eO, cvi, al, azf, Ld, Sj, Ll, bn, jk, auV, jA, hN, Gs, Gw, cB, aq, Ty, YJ, ax, ez, mD, coL, dt, hi, T, II. Xw, st, kH, hq, cjq, sf, auy, cGJ, aYG, fA, dx, IJ, DP, aw, iD, cOZ, sE, jt, iO, ki, bPl, hJ, iq, ps, BO, iy, Vx, asy, aEa, azu, aKf, ji, Rh, nB, fH, ckA, Jd, aEu, g, BQ, jH, bK, Qf, Dt, po, bv, aip, Q, aav, vM, fx, OA, cPx, yG, fy, akn, Tu, OR, YA, azy, jh, cT, qP, apK, iT, bkv, rc, PM, EO, aEq, sa, kM, apF, wK, cY, Dv, jz, kB, bno, bf, JE, tp, aAC, pp, Bh, ml, B, Ll, ja, anA, gX, k, O, Lf, iv, Tk, gg, hD, kq, yJ, SA, Gr, IO, yg, bBw, cPw, v, afn, alf, Hq, Qz, bt, csL, bny, Fr, iA, Lx, YU, JY, aQv, MW, aJX, bun, aJh, bkV, afz, aMF, nJ, cz, bH, zS, cPs, iu, atq, aEg, cwD, jq, aoU, rT, jL, avv, in, au, jC, Mr, Ne, Zi, cPa, aiT, apG, cOK, nU, ND, DC, vu, hep, iQ, LK, sz, aWV, wp, ir, FL, avo, UG, KL, cPm, brq, Fo, dO, pD, auA, et, M, Lt, Ha, cW, jM, HN, ahV, Bg, Dj, cX, agf, gU, zO, bUR, IA, cf, bum, pF, gw, apG, cPi, aFe, Iv, cON, eM, bkA, zY, cOU, QV, Qm, Bi, cPI, aOT, gT, avu, aBE, iZ, aoQ, iK, bFX, ZU, avC, bmK, Be, hi, LG, bDh, agh, W, bkL, QI, bp, Xj, jl, nP, AP, Xt, fM, qT, aHE, Y, CA, Xu, avB, cPv, amS, kA, Yv, Ez, at, eG, h, aAv, pV, bx, gG, aE, cPf, w, cO, aNa, gO, az, dv, cy, b, t, Si, adR, agw, azc, cfl, acy, azx, Hs, fu, R, Jl, lb, cOO, aqi, of, tz, gY, cOe, zU, od, Jj, ca, jT, bkT, gQ, dH, ata, xO, auk, aKa, Qk, os, cLp, yE, bLx, rt, i, dc, Yw, bsZ, cKW, axq, Kt, Zx aGu, wy, cHr, jy, fU, IW, apM, y, jh, YG, Ml, ave, ip, ss, cV, Lo, vQ, aOg, aul, cs, kN, brt, avg, cj, iF, cPh, ali, YV, CZ, eE, chu, Fs, et, pr, bJN, auw, VP, apg, aol, aCK, apj, qW, auZ, aaa, aoy, iY, er, jR, cPj, fG, cPt, bkt, qO, Xk, fK, qB, ci, OG, An, ia, anb, aIU, xb, ic, Og, xg, agm, ey, re, jD, aO, aJB, GG, iW, jV, es, jF, dQ, bWt, VM, cPr, pB, HE, jG, Tv, u, wR, PJ, Pz, aJ, I, wU, Tx, hv, by, Km, G, Lc, boB, Ca, aAB, Nh, bnc, ce, aHf, jf, cPp, aJD, aoO, aPb, afT, kh, Sk, wP, dn, bq, I, fj, azt, bL, A, Lw, Lv, beJ, Dn, HJ, ana, BY, di, pu, Dd, bbz, hP, yw, MT, aX, aGp, Ec, kn, qn, anM, F, aBd, qr, aoY, Vr, Ex n, cOI, aV, cPu, jZ, Lg, ma, si, aYo, IP, hZ, avx, BC, cPo, GB, P, ce, j, Oi, pw, fT, cEh, sK, ast, qp, awA, QN, YQ, ck, IJ, XH, IN, bh, iE, oT); #c1 (TP53111) c2(NP_001245253) c3(11878) c4(37992, 51049, 64106, 24935, 77163) c5(by, bm, q, bu); #c1(TP53113) C2(NP_612358) c3(11879) c4(37993, 51050, 64107, 24936, 77164) c5(f); #c1(TP5313) c2(NP_001193731) c3(11880) c4(37994, 51051, 64108, 24937, 77165) c5(Ag, A, b, f, F, gm, T, B, i, I, av, fy, u); #c1(TP531NP1) c2(NP_001129205) c3(11881) c4(37995, 51052, 64109, 24938, 77166) c5(aX, I, b, bx wG, f, dB, J, bu, ag, jo, T, O, cK, by, u, y); #c1(TP531NP2) c2(NP_067025) c3(11882) c4(37996, 51053, 64110, 24939, 77167) c5(jT, agc, b, f, F, qi, T, i, fx, Ap, u, y); #c1(TP53RK) c2(NP_291028) c3(11883) c4(37997, 51054, 64111, 24940, 77168) c5(do, f, b); #c1 (TP53TG3C) c2(NP_001192188) c3(11884) c4(37998, 51055, 64112, 24941, 77169) c5(b); #c1(TP63) c2(NP_001108450) c3(11885) c4(37999, 51056, 64113, 24942, 77170) c5(jp, akQ, DP, aw, aPi, Ty, ck, JH, adr, e, aPh, arV, arl, t, yh, fP, nZ, aD, arS, rR, aPf, fe, aeM, aC, gm, aOZ, ft, zU, od, fx, jT, fp, Nq, aPg, wh, aPc, fc, aeR, ag, cT, pH, i, Dr, X, iP, atd, Ak, mk, kY, bw, U, xw, y, atj, pw, js, f, Lo, B, av, fy, aEs, iT, iF, cPh, V, ae, bt, cy, Mp, YU, EE, jd, tl, ji, cPB, hV, b, q, d, jh, zJ, aga, re, aua, arm, ZB, It, dQ, Yr, ar, cPz, u, aE, da, il, LR, sf, IG, aPe, HE, Ur, wV, nV, aPb, iR, kM, wP, Ns, aOY, dn, I, yA, A, fr, Lv, In, FL, xj, avB, rU, BY, zK, iK, m, MT, cPD, aX, or, fq, F, Ir, cPA, ik, oJ, cPC, UF, aV, aeS, fU, cV, Be, IF, BG, QV, aPa, dt, Po, P, ce, T, bp, Ez, AP, fM, qp, QN, YQ, QJ, amS, aPj, PS, aPd, rb); #c1(TP73) c2(XP_011540366) c3(11886) c4(38000, 51057, 64114, 24943, 77171) c5(dx, B, aw, aeB, aCb, dB, HG, w, Ou, adr, e, O, M, dv, t, bx, nZ, ji, Zv, g, gG, du, gm, bp, ft, fx jT, fp, pb, BX, fc, ie, ag, cT, i, pt, Mq, X, jf, Kc, hS, aeD, bw, U, Oh, y, yV, co, ip, f, cs, bu, iv, av, fy, bm, iT, is, V, Ov, gv, iA, JY, GQ, dP, jR, qO, oM, ci, b, jq, BQ, d, jh, bb, jd, re, hV, q, jV, jF, ar, ff, hb, jG, u, o, il, gL, ad, G, aeC, nV, hX, aoA, cX, bL, A, k, fr, jc, iL, gE, hP, MT, aX, qn, F, cU, ik, n, cB, aV, cV, YR, Fs, J, W, jo, T, fO, Oi, jl, by, XH, bh, h, rb); #c1(TPBG) c2(XP_011534399) c3(11887) c4(38001, 51058, 64115, 24944, 77172) c5(A, b, dA, sH, T, cO, at, fM); #c1(TPCN1) c2(NP_001137291) c3(11888) c4(38002, 51059, 64116, 24945, 77173) c5(Dr, og, hV, nV, T, cO, cK); #c1(TPCN2) c2(NP_620714) c3(11889) c4(38003, 51060, 64117, 24946, 77174) c5(cPE, cK, A, Sq, cO); #c1(TPD52) c2(NP_001020423) c3(11890) c4(38004, 51061, 64118, 24947, 77175) c5(A, b, X, bf, Bz, y, cp, aX, B, oO, av, u, I, aC, W, T, eX, x, fp, aM, wV, wP, fD, bq, aA); #c1(TPD52L1) C2(NP_001003396) c3(11891) c4(38005, 51062, 64119, 24948, 77176) c5(jH, A, u, y, dA); #c1(TPD52L2) c2(NP_001230821) c3(11892) c4(38006, 51063, 64120, 24949, 77177) c5(O, b); #c1(TPGS2) c2(NP_001258879) c3(11893) c4(38007, 51064, 64121, 24950, 77178) c5(bf, aE, aM); #c1(TPH1) c2(NP_004170) c3(11894) c4(38008, 51065, 64122, 24951, 77179) c5(ux f, Gm, gG, jJ, tR, ns, Ey, di, ak, IW, cA, bmf, gZ, Nk, cM, cp, zM, sG, wr, bop, cPF, vu, aUb, qA, pP, bLI, dj, hW, aqQ, bK, akl, nu, cz, IR, IX, rQ, wX, GI, FW, lb, xd, GL, aUf, qp, aqw, aY, mA, cC, ih, aaf, IS, o, dc, bh, aA, jP, rr, FY); #c1(TPH2) c2(NP_775489) c3(11895) c4(38009, 51066, 64123, 24952, 77180) c5(jJ, oC, ak, Gt, Gm, ux, tR, ns, cA, qa, nt, nq, nr, nn, nm, aqL, no, xw, cM, TC, np, vW, wZ, gZ, agC, ahj, rr, f, dl, vu, xl, qu, bmf, Wj, aVS, zb, em, dj, fU, hW, aqQ, qA, nu, Fp, aWt, cz, rQ, wX, eX, lo, rV, wW, xd, xv, cPG, sG, Ey, aY, aQM, ih, qc, aaI, rv, dc, bh, bMH, bMv); #c1(TPII) c2(NP_000356) c3(11896) c4(38010, 51067, 64124, 24953, 77181) c5(b, cPI, AA, m, byK, cy, e, O, cp, d, ec, aX, cHF, zP, q, bu, mg, ar, jG, aV, u, o, em, cPH, ae, HX, bK, ui, by, dt, QI, aeV, ni, CY, dP, jh, dY, uj, xY, aWQ, aU, jC); #c1(TPK1) c2(NP_001035947) c3(11897) c4(38011, 51068, 64125, 24954, 77182) c5(oy, bj, cPJ, bb, I); #c1(TPM1) c2(NP_000357) c3(11898) c4(38012, 51069, 64126, 24955, 77183) c5(ml, b, dE, di, cO, cPK, U, y, mR, aoa, ec, aX f, Mr, ik, O, oD, cPL, u, gG, V, jh. Ay, aeU, dt, T, eX, cK, akK, sK, bgc, aWz, AG, bk, Aw); #c1(TPM2) c2(NP_001288155) c3(11899) c4(38013, 51070, 64127, 24956, 77184) c5(Yj, jh, A, bBi, cPN, cPM, chi, chB, arm, chH, B, At, AG, Av, cc, oD, sK); #c1(TPM3) c2(NP_001036816) c3(11900) c4(38014, 51071, 64128, 24957, 77185) c5(KC, f, aw, b, k, jt, xQ, w, yn, O, Ag, cPO, jl, re, hV, q, bu, ar, Av, cB, Tr, oD, bm, iT, jH, og, jE, cV, Ay, nl, xz, T, x, Tp, jT, sK, TY, cPP, nV, jR, OJ, At, AG, Af, Aw, od); #c1(TPM4) c2(NP_001138632) c3(11901) c4(38015, 51072, 64129, 24958, 77186) c5(qL, ik, cp); #c1(TPMT) c2(NP_000358) c3(11902) c4(38016, 51073, 64130, 24959, 77187) c5(IH, b, cPR, jH, mk, z, aiH, ps, gM, m, G, t, h, cs, pf, dl, aC, hN, iv, oO, aV, u, gl, Yb, cPQ, g, ha, V, I, ajc, ir, be, J, gY, P, iw, alW, BX, ie, bY, AG, fP, gR, bT, cPS); #c1(TP0) c2(NP_001193673) c3(11903) c4(38017, 51074, 64131, 24960, 77188) c5(dx, f, iq, hM, bf, pz, O, FN, kX, gl, n, cPU, og, cPT, du, aow, nV, cMe, iz, xO, Lz, cMb, IN, i, pt, Dr, PG, X, pE, ig, U, yV, co, Wn, ak, B, cGq, kN, fy, bm, V, SE, gv, bxD, eX, bq, W, oM, iu, b, bg, z, hV, q, biU, yW, nj, biT, sQ, I, gL, aYz, jG, aCq, L, xL, ex, A, cLL, Sc, gE, mW, cLJ, KQ, al, m, VD, Bi, gT, aE, HP, dj, GS, J, dt, Ei, T, nP, ac, aM, ii, bh); #c1(TPP1) c2(NP_000382) c3(11904) c4(38018, 51075, 64132, 24961, 77189) c5(A, hS, w, si, aun, ec, aPT, h, f, q, ss, jG, nj, o, sp, bK, sn, v, LG, dt, P, T, ac, cPV, hT, cT, fD); #c1(TPP2) c2(NP_003282) c3(11905) c4(38019, 51076, 64133, 24962, 77190) c5(jT, v); #c1(TPPP2) c2(XP_005267381) c3(11906) c4(38020, 51077, 64134, 24963, 77191) c5(wa, aX, jd, f, q, fO, J, jF, n, iv, aA, fy); #c1(TPPP3) c2(NP_057224) c3(11907) c4(38021, 51078, 64135, 24964, 77192) c5(xl, cV); #c1(TPPP) c2(NP_008961) c3(11908) c4(38022, 51079, 64136, 24965, 77193) c5(en, kE, HN, jz, dB, bg, Iv, iL, si, zL, bj, jD, jQ, bb, re, CR, aEU, ky, bK, o, dj, GS, hW, SV, ae, jH, kt, cs, v, J, P, II, jl, fx, hw, EN, ao, Oa, iT, i, alg, aEN); #c1(TPRG1) c2(NP_940887) c3(11909) c4(38023, 51080, 64137, 24966, 77194) c5(at, bj); #c1(TPR) c2(NP_003283) c3(11910) c4(38024, 51081, 64138, 24967, 77195) c5(nV, awX, b, cG, f, ON, bu, oH, og, w, pt, oM, by, Y); #c1(TPRN) c2(NP_001121700) c3(11911) c4(38025, 51082, 64139, 24968, 77196) c5(Bx, cPW); #c1(TPSAB1) c2(NP_003285) c3(11912) c4(38026, 51083, 64140, 24969, 77197) c5(nk, fs, aC, Tr, cy, aV); #c1(TPSB2) c2(NP_077078) c3(11913) c4(38027, 51084, 64141, 24970, 77198) c5(Tr, nk); #c1(TPSD1) c2(NP_036349) c3(11914) c4(38028, 51085, 64142, 24971, 77199) c5(cy, h, Tp, cd, HY, Jk, fP, JC, IW, Tr, et); #c1(TPSG1) c2(NP_036599) c3(11915) c4(38029, 51086, 64143, 24972, 77200) c5(HY, aDX, cy, u, Jk, t, h, Tp, Ck, cd, aDY, Tr, G, fP, jU, JC, IW, I, aC, et, y); #c1(TPTI) c2(NP_001273202) c3(11916) c4(38030, 51087, 64144, 24973, 77201) c5(A, avb, b, Pv, EM, di, O, y, cfh, gM, cy, Bi, f, ra, alW, fv, B, cB, cs, u, o, fi, Bd, fs, ae, aC, v, bp, J, IR, IX, T, ad, aIY, yy, ag, IS, aUt, alX, eG); #c1(TPTE2) c2(NP_001135440) c3(11917) c4(38031, 51088, 64145, 24974, 77202) c5(bh, bm, g); #c1(TPTE) c2(NP_954868) c3(11918) c4(38032, 51089, 64146, 24975, 77203) c5(ag); #c1(TPX2) c2(XP_011527001) c3(11919) c4(38033, 51090, 64147, 24976, 77204) c5(fl, aw, b, k, ahM, jz. A, Iv, bw, U, e, jQ, d, co, jl, Qm, re, B, q, fv, cs, QJ, u, iT, V, cV, qL, bp, ad, T, fO, jT, fy, lu, kJ, ag); #c1(TRA2A) c2(NP_001269688) c3(11920) c4(38034, 51091, 64148, 24977, 77205) c5(mk, Pz); #c1(TRA2B) c2(NP_001230808) c3(11921) c4(38035, 51092, 64149, 24978, 77206) c5(cy, dA, f, HN, ad, kz, ar, cs, aA, aW); #c1(TRABD2A) c2(NP_001074293) c3(11922) c4(38036, 51093, 64150, 24979, 77207) c5(bb); #c1(TRABD) c2(NP_079480) c3(11923) c4(38037, 51094, 64151, 24980, 77208) c5(G, by, J, bu); #c1(TRADD) c2(XP_011521722) c3(11924) c4(38038, 51095, 64152, 24981, 77209) c5(g, m, jl, fr, ps, nl, fO, ft, HM, w, ne, u, O); #c1(TRAF1) c2(NP_001177876) c3(11925) c4(38039, 51096, 64153, 24982, 77210) c5(dx. A, ER, Kt, b, qd, aF, dB, fl, et, PL e, y, hh, m, dv, bb, f, d, AK, Li, vu, ar, O, cs, UM, u, aE, o, zH, PJ, ax, aC, du, J, ad, P, aZ, x, jl, jT, be, dH, gd, cT, axC, tl, eG, bT, ap); #c1(TRAF2) c2(NP_066961) c3(11926) c4(38040, 51097, 64154, 24983, 77211) c5(wa, A, pV, zr, b, zH, cY, iP, dB, mk, w, tG, bw, O, bu, eV, y, zw, d, m, co, aX, zu, h, f, e, zx, zB, B, qB, u, o, ae, fU, fs, Os, vg, zA, cs, gm, gL, ad, vc, fO, vM, cy, by, pq, jT, zE, P, ag, cT, ji, X, jl); #c1(TRAF3) c2(NP_001186356) c3(11927) c4(38041, 51098, 64155, 24984, 77212) c5(A, b, cPX, bf, U, e, y, d, jl, f, bNI, B, fH, u, o, sQ, ae, xl, J, fO, Dp, P, T, II, jT, ajd, fJ, aM, cT, fl, bM); #c1(TRAF31P1) c2(NP_001132962) c3(11928) c4(38042, 51099, 64156, 24985, 77213) c5(bNI, aeg); #c1(TRAF31P2) c2(NP_001157753) c3(11929) c4(38043, 51100, 64157, 24986, 77214) c5(dx, Zm, JH, dN, bL, sE, gn, Pp, ix, rp, bf, HQ, cfh, m, dv, fq, rr, f, dW, eE, da, cPZ, du, cPY, jH, xe, fP, aUt, at); #c1(TRAF4) c2(NP_004286) c3(11930) c4(38044, 51101, 64158, 24987, 77215) c5(o, cn, b, f, F, afn, P, T, y, ar, u, Uh); #c1(TRAF5) c2(NP_665702) c3(11931) c4(38045, 51102, 64159, 24988, 77216) c5(n, jl, aC, nl, fO, P, ix, HQ, agS, gE, at, rn, Il); #c1(TRAF6) c2(NP_665802) c3(11932) c4(38046, 51103, 64160, 24989, 77217) c5(dx, JH, bjA, b, agH, aF, sE, atU, mW, dv, agJ, cbO, y, cp, jh, co, aX, kJ, h, bu, do, cc, kX, u, gl, o, n, PJ, gE, si, m, aC, du, j, by, IJ, nk, T, fO, jl, fx jT, pi, nV, Zn, P, i, bjF, ji, at, ci); #c1(TRAF7) c2(NP_115647) c3(11933) c4(38047, 51104, 64161, 24990, 77218) c5(jd, bwn); #c1(TRAFD1) c2(NP_006691) c3(11934) c4(38048, 51105, 64162, 24991, 77219) c5(aE); #c1(TRAK1) c2(NP_001036111) c3(11935) c4(38049, 51106, 64163, 24992, 77220) c5(bK, af, IV, bu); #c1(TRAK2)

c2(NP_055864) c3(11936) c4(38050, 51107, 64164, 24993, 77221) c5(ao, o); #c1(TRAM1) C2(NP_055109) c3(11937) c4(38051, 51108, 64165, 24994, 77222) c5(fl, A, ar, aeq, b, B, q, cU, afz, kC, fl, hM, O, gE, T, iA, Hs, u, y); #c1(TRAM1L1) c2(NP_689615) c3(11938) c4(38052, 51109, 64166, 24995, 77223) c5(aA, A); #c1(TRAM2) c2(NP_036420) c3(11939) c4(38053, 51110, 64167, 24996, 77224) c5(bq); #c1(TRAP1) c2(NP_001258978) c3(11940) c4(38054, 51111, 64168, 24997, 77225) c5(jh, A, bb, V, b, f, cs, B, ik, uz, il, vp, U, bu, u, dh, y); #c1(TRAPPC10) c2(NP_003265) c3(11941) c4(38055, 51112, 64169, 24998, 77226) c5(vR, S, mk, nU, axK, hS, zk, Pz, zp); #c1(TRAPPC11) c2(NP_068761) c3(11942) c4(38056, 51113, 64170, 24999, 77227) c5(bf, cQa, xM, nU, kG, cO, nO); #c1(TRAPPC1) c2(NP_067033) c3(11943) c4(38057, 51114, 64171, 25000, 77228) c5(al, jZ); #c1(TRAPPC2) c2(NP_001122307) c3(11944) c4(38058, 51115, 64172, 25001, 77229) c5(rM, nU, Is, dt, QZ, WE, atg); #c1(TRAPPC4) c2(NP_057230) c3(11945) c4(38059, 51116, 64173, 25002, 77230) c5(W, U, bj, V); #c1(TRAPPC9) c2(NP_001153844) c3(11946) c4(38060, 51117, 64174, 25003, 77231) c5(bb, dA, nU, Is, cz, cQb, cO, QZ, aV, et); #c1(TRAT1) c2(NP_057472) c3(11947) c4(38061, 51118, 64175, 25004, 77232) c5(aw, b, cV, hg, P, u, y, cq); #c1(TRDMT1) c2(NP_004403) c3(11948) c4(38062, 51119, 64176, 25005, 77233) c5(lJ, fU, bb, b, q, bu, co, av, fy, A); #c1(TRDN) c2(NP_001238916) c3(11949) c4(38063, 51120, 64177, 25006, 77234) c5(ak, cQc, Ol, fl, dh); #c1(TREH) c2(NP_001287994) c3(11950) c4(38064, 51121, 64178, 25007, 77235) c5(b, jz, aN, bBK, bf, aK, O, jQ, m, co, fy, wB, I, aZz, J, lx, et, cQd, aM, jR, al aBF); #c1(TREM1) c2(NP_001229518) c3(11951) c4(38065, 51122, 64179, 25008, 77236) c5(oh, bn, axx, vg, b, aF, sE, nI, mk, aWm, le, tG, z, Mn, y, co, pi, bX, bv, fy, u, TP, ax, hW, jH, aC, aDM, be, Ij, gL, bR, vc, aox, et, jU, dH, cMC, gd, cT, fP, bk, rr, I, In); #c1(TREM2) c2(NP_001258750) c3(11952) c4(38066, 51123, 64180, 25009, 77237) c5(acE, ao, gk, bS, pi, hT, axY, v, dt, w, o, aj, ai, aV, aK, OA, aO); #c1(TREML1) c2(NP_001258736) c3(11953) c4(38067, 51124, 64181, 25010, 77238) c5(aF, dY); #c1(TREML2) c2(NP_079083) c3(11954) c4(38068, 51125, 64182, 25011, 77239) c5(di); #c1(TRERF1) C2(XP_006715208) c3(11955) c4(38069, 51126, 64183, 25012, 77240) c5(u, LS, ac, y); #c1(TREX1) c2(NP_009179) c3(11956) c4(38070, 51127, 64184, 25013, 77241) c5(EO, en, b, sE, mW, cQe, bw, cQf, m, DG, sG, mL f, aC, aaZ, ar, gl, aSB, cJ, acv, j, IJ, EQ, boS, hT, P, Il); #c1(TREX2) c2(NP_542432) c3(11957) c4(38071, 51128, 64185, 25014, 77242) c5(ch, A, m); #c1(TRHDE) c2(NP_037513) c3(11958) c4(38072, 51129, 64186, 25015, 77243) c5(aC, at); #c1(TRH) c2(NP_009048) c3(11959) c4(38073, 51130, 64187, 25016, 77244) c5(amC, dM, b, cQg, hS, sJ, w, hM, cA, bRB, coz, cM, cf, aX, Ob, eB, h, f, q, do, B, yE, Km, n, jG, bm, bzf, biT, iF, hW, I, cV, Fb, aqi, v, W, Il, kS, WZ, eH, ii, aY, pO, Fu, cQh, cQi, xJ, coA, cT, iu, dc, di, eG); #c1(TRHR) c2(XP_011515565) c3(11960) c4(38074, 51131, 64188, 25017, 77245) c5(cQj, qs, apS, iF, W, yE, di, Jj, Km, aQd, aA, pO, hM, cQk); #c1(TRIAP1) c2(NP_057483) c3(11961) c4(38075, 51132, 64189, 25018, 77246) c5(fO); #c1(TRIB1) c2(NP_079471) c3(11962) c4(38076, 51133, 64190, 25019, 77247) c5(n, jK, aw, I, h, eX, J, dK, M, QI, fP, eR, bq, bw, aA, at, aq, aO, ap); #c1(TRIB2) c2(NP_067675) c3(11963) c4(38077, 51134, 64191, 25020, 77248) c5(bL, A, b, aX, h, B, M, do, ar, n, jG, bm, o, J, pb, jE, cT, fP, Fg, yA, at, rn); #c1(TRIB3) c2(NP_001288117) c3(11964) c4(38078, 51135, 64192, 25021, 77249) c5(dx, f, aw, b. A, xf, bw, bf, U, ey, y, dv, h, B, tE, u, o, n, mz, V, I, du, J, Lc, eX, aM, dO, bq, aA, at, ap); #c1(TRIM10) c2(NP_006769) c3(11965) c4(38079, 51136, 64193, 25022, 77250) c5(m, aV, Lk); #c1(TRIM11) c2(NP_660215) c3(11966) c4(38080, 51137, 64194, 25023, 77251) c5(w, kG, O, b); #c1(TRIM13) c2(NP_001007279) c3(11967) c4(38081, 51138, 64195, 25024, 77252) c5(A, MZ, b, X, eu, hM, O, U, y, aX, pp, Qe, h, B, q, jF, hN, mR, Pm, av, u, o, V, cV, J, fO, W, T, Il, fx, jT, iw, qt, lc, cT, i, fl, aA); #c1(TRIM15) c2(NPJ50232) c3(11968) c4(38082, 51139, 64196, 25025, 77253) c5(da, m, aV); #c1(TRIM16) c2(NP_006461) c3(11969) c4(38083, 51140, 64197, 25026, 77254) c5(lb, gg, jV, b, cV); #c1(TRIM17) c2(NP_001020111) c3(11970) c4(38084, 51141, 64198, 25027, 77255) c5(by, aRr, kG, bu); #c1(TRIM21) c2(NP_003132) c3(11971) c4(38085, 51142, 64199, 25028, 77256) c5(b, iF, nF, gw, cQm, gn, mW, mk, aer, Og, U, Oh, Ik, y, d, m, co, BL, eA, et, f, auh, e, eE, X, Em, cQI, cs, nB, u, gl, vi, fU, rN, aC, bJF, Oq, be, J, ad, W, P, azD, T, Il, ct, ajd, xO, qt, Yw, Zl, iV, a YE, yE, azG, cQn, aT, iu); #c1(TRIM22) c2(NP_001186502) c3(11972) c4(38086, 51143, 64200, 25029, 77257) c5(P, en, Kt, gL); #c1(TRIM23) c2(NP_001647) c3(11973) c4(38087, 51144, 64201, 25030, 77258) c5(V, b, apG, jU, U, u, y); #c1(TRIM24) c2(NP_003843) c3(11974) c4(38088, 51145, 64202, 25031, 77259) c5(bm, jE, co, aw, b, cV, t, h, hV, F, q, G, og, BL, fy, u, y); #c1(TRIM25) c2(NP_005073) c3(11975) c4(38089, 51146, 64203, 25032, 77260) c5(en, T, ar, iA, u, y); #c1(TRIM26) c2(XP_005249435) c3(11976) c4(38090, 51147, 64204, 25033, 77261) c5(aw, b, Dv, gG, wy, ix, C, iL, z, al, Ld, m, jT, q, bu, ar, HE, aV, aq, Lg, jB, kZ, jE, JY, gv, sf, et, by, Lx, ac, cq, wV, Lc, bm, wP, Lo, Lu, fl, bh, bV); #c1(TRIM27) c2(NP_006501) c3(11977) c4(38091, 51148, 64205, 25034, 77262) c5(b, fr, m, og, ic, fx, O, bkK, aX, f, cU, sB, jh, afh, ad, aeC, ft, afj, ag, i, iA, yA); #c1(TRIM28) c2(NP_005753) c3(11978) c4(38092, 51149, 64206, 25035, 77263) c5(co, aX, b, bp, bu, P, ar, fy, aw, by, u, y, eg); #c1(TRIM29) c2(NP_036233) c3(11979) c4(38093, 51150, 64207, 25036, 77264) c5(d, A, aw, b, kJ, re, ag, iT, u, e, y, cq); #c1(TRIM2) c2(NP_001123539) c3(11980) c4(38094, 51151, 64208, 25037, 77265) c5(cQo, aV, cb); #c1(TRIM31) c2(NP_008959) c3(11981) c4(38095, 51152, 64209, 25038, 77266) c5(da, m, by, eX, hW, b, nU, yO, bu, om, ix ew, fy, cs, cQp, ad, u, y, JY); #c1(TRIM32) c2(XP_011516700) c3(11982) c4(38096, 51153, 64210, 25039, 77267) c5(d, da, rQ, kG, b, cnV, zj, F, J, TD, e, fp, oD, ajg, aA, adr, mL xl); #c1(TRIM34) c2(NP_067629) c3(11983) c4(38097, 51154, 64211, 25040, 77268) c5(P); #c1(TRIM35) c2(NP_741983) c3(11984) c4(38098, 51155, 64212, 25041, 77269) c5(g, J); #c1(TRIM36) c2(NP_001017397) c3(11985) c4(38099, 51156, 64213, 25042, 77270) c5(A); #c1(TRIM37) c2(NP_056109) c3(11986) c4(38100, 51157, 64214, 25043, 77271) c5(A, X, u, B, om, fe, fl, eX, cQp, mY, fy, AP, y, adg); #c1(TRIM38) c2(XP_005248857) c3(11987) c4(38101, 51158, 64215, 25044, 77272) c5(m, iV); #c1(TRIM39) c2(NP_067076) c3(11988) c4(38102, 51159, 64216, 25045, 77273) c5(m); #c1(TRIM3) c2(XP_011518146) c3(11989) c4(38103, 51160, 64217, 25046, 77274) c5(w, g, aA, f, O); #c1(TRIM40) c2(NP_001273562) c3(11990) c4(38104, 51161, 64218, 25047, 77275) c5(da, m, aV); #c1(TRIM42) c2(NP_689829) c3(11991) c4(38105, 51162, 64219, 25048, 77276) c5(av, aV); #c1(TRIM44) c2(NP_060053) c3(11992) c4(38106, 51163, 64220, 25049, 77277) c5(u, by, aw, b, bu); #c1(TRIM50) c2(NP_835226) c3(11993) c4(38107, 51164, 64221, 25050, 77278) c5(alM); #c1(TRIM56) c2(NPJI2223) c3(11994) c4(38108, 51165, 64222, 25051, 77279) c5(vQ, b); #c1(TRIM58)

c2(NP_056246) c3(11995) c4(38109, 51166, 64223, 25052, 77280) c5(di); #c1(TRIM59) c2(NP_775107) c3(11996) c4(38110, 51167, 64224, 25053, 77281) c5(by, A, B, bu); #c1(TRIM5) c2(NPJ49023) c3(11997) c4(38111, 51168, 64225, 25054, 77282) c5(hg, J, gL, iV, P, Ku, aV, Il); #c1(TRIM62) c2(XP_011540007) c3(11998) c4(38112, 51169, 64226, 25055, 77283) c5(co, aw, b, T, u, y); #c1 (TRIM66) c2(NP_055633) c3(11999) c4(38113, 51170, 64227, 25056, 77284) c5(aA); #c1(TRIM68) c2(NP_001291425) c3(12000) c4(38114, 51171, 64228, 25057, 77285) c5(m, A, B, I, gn); #c1(TRIM69) c2(NP_001288073) c3(12001) c4(38115, 51172, 64229, 25058, 77286) c5(en, aF, ig, bb, gd, DM, do, dQ, pB, cMI, dh, fh, aBs, lb, hZ, pF, Il, sS, Oa, ag, fl, atR); #c1(TRIM6-TRIM34) c2(NP_001003819) c3(12002) c4(38116, 51173, 64230, 25059, 77287) c5(P); #c1(TRIM71) c2(NP_001034200) c3(12003) c4(38117, 51174, 64231, 25060, 77288) c5(jE, bm, g); #c1(TRIM72) c2(NP_001008275) c3(12004) c4(38118, 51175, 64232, 25061, 77289) c5(oD, m, xl, cO); #c1(TRIM73) c2(NP_944606) c3(12005) c4(38119, 51176, 64233, 25062, 77290) c5(alM); #c1(TRIM74) c2(XP_011514491) c3(12006) c4(38120, 51177, 64234, 25063, 77291) c5(alM); #c1(TRIM8) c2(NP_112174) c3(12007) c4(38121, 51178, 64235, 25064, 77292) c5(bb); #c1(TRIM9) c2(NP_055978) c3(12008) c4(38122, 51179, 64236, 25065, 77293) c5(Fh, bg, at, dB, gw); #c1(TRIOBP) c2(NP_001034230) c3(12009) c4(38123, 51180, 64237, 25066, 77294) c5(cQq, Bx); #c1(TRIO) c2(NP_009049) c3(12010) c4(38124, 51181, 64238, 25067, 77295) c5(i, h, ZY, w, T, iD, fx, bm); #c1(TRIP10) c2(NP_001275891) c3(12011) c4(38125, 51182, 64239, 25068, 77296) c5(g, jE, bm, axx, b, aDM, re, W, gd, cT, iT, fH, si, u, fJ, y); #c1(TRIP11) c2(NP_004230) c3(12012) c4(38126, 51183, 64240, 25069, 77297) c5(h, cQr, cB); #c1(TRIP13) c2(NP_001159732) c3(12013) c4(38127, 51184, 64241, 25070, 77298) c5(QZ, yh, XQ, aw, Vf); #c1(TRIP4) c2(NP_057297) c3(12014) c4(38128, 51185, 64242, 25071, 77299) c5(bnx, u, bev, y); #c1(TRIP6) c2(XP_011514847) c3(12015) c4(38129, 51186, 64243, 25072, 77300) c5(b, Dg, f, w, T, jM); #c1(TRIQK) c2(XP_011515284) c3(12016) c4(38130, 51187, 64244, 25073, 77301) c5(at, bj); #c1(TRMTIOA) c2(NP_001128137) c3(12017) c4(38131, 51188, 64245, 25074, 77302) c5(QZ, bf, ait, aM); #c1(TRMTI2) c2(NP_060426) c3(12018) c4(38132, 51189, 64246, 25075, 77303) c5(u, y); #c1(TRMT1) c2(NP_001136026) c3(12019) c4(38133, 51190, 64247, 25076, 77304) c5(n0); #c1(TRMT44) c2(NP_689757) c3(12020) c4(38134, 51191, 64248, 25077, 77305) c5(cT); #c1(TRMT5) c2(NP_065861) c3(12021) c4(38135, 51192, 64249, 25078, 77306) c5(dA); #c1(TRMU) c2(NP_001269711) c3(12022) c4(38136, 51193, 64250, 25079, 77307) c5(ake, cQt, bb, I, cK, bgW, gv, na, z, bh, cQs); #c1(TRO) c2(NP_001034794) c3(12023) c4(38137, 51194, 64251, 25080, 77308) c5(is, jE, co, agl, b, X, bm, q, jc, ck, VG, eG, Lt); #c1(TROVE2) c2(NP_001035828) c3(12024) c4(38138, 51195, 64252, 25081, 77309) c5(m, u, gn, mW, hoc, cQI, sx, gl, y); #c1(TRPA1) c2(XP_011515926) c3(12025) c4(38139, 51196, 64253, 25082, 77310) c5(aUa, cQv, b, cO, bf, cmn, oy, co, bb, cQu, yp, IY, cB, aV, o, fU, be, azl, ti, bTj, cy, jU, aM, Jd, nk, Y, zT, Fi, auy, bq, jC, eG); #c1(TRPC1) c2(NP_001238774) c3(12026) c4(38140, 51197, 64254, 25083, 77311) c5(B, pV, b, Zy, A, di, Vy, Co, pz, y, co, aX, f, O, cs, bta, fy, u, aE, l, aC, qB, ad, IX, T, wt, ch, fD); #c1(TRPC3) c2(NP_001124170) c3(12027) c4(38141, 51198, 64255, 25084, 77312) c5(B, td, b, X, cO, akB, A, D, ak, IW, Co, gO, qs, f, do, mL, av, IX, aIM, ji, kS, SR, cQw, di, at); #c1(TRPC4AP) c2(NP_955400) c3(12028) c4(38142, 51199, 64256, 25085, 77313) c5(bOa, o, b); #c1(TRPC4) c2(NP_001129427) c3(12029) c4(38143, 51200, 64257, 25086, 77314) c5(dm, bb, dA, hY, dB, jf, IW, bq, pz, ac); #c1(TRPC5) c2(NP_036603) c3(12030) c4(38144, 51201, 64258, 25087, 77315) c5(b, aC, nU, ih, di, et, gO); #c1(TRPC6) c2(NP_004612) c3(12031) c4(38145, 51202, 64259, 25088, 77316) c5(bP, A, td, b, X, vh, IW, BP, jf, eG, w, di, cO, cQx, bf, ey, Co, e, O, d, wd, f, bu, bEo, B, av, xd, te, da, ma, hW, l, bd, by, IX, T, aZ, vw, et, aM, BN, vZ, fD, l, bh, wR, he, ap); #c1(TRPC7) c2(NP_001161048) c3(12032) c4(38146, 51203, 64260, 25089, 77317) c5(oC, aX, dA, ak, n, bf); #c1(TRPM1) c2(NP_001238949) c3(12033) c4(38147, 51204, 64261, 25090, 77318) c5(cQy, aX, cY, DO, cQz, cyP, eO, aif); #c1(TRPM2) c2(XP_005261228) c3(12034) c4(38148, 51205, 64262, 25091, 77319) c5(oC, ak, aw, l, b, IY, Ue, f, ao, jr, dj, hS, A, T, bf, aX, Jd, u, y, aM); #c1(TRPM3) c2(NP_001007472) c3(12035) c4(38149, 51206, 64263, 25092, 77320) c5(bb, pR, aXS, xq, eO, bq, at, cK); #c1(TRPM4) c2(NP_001182156) c3(12036) c4(38150, 51207, 64264, 25093, 77321) c5(A, fc, bUz, f, ajW, B, aF, cQA, aV); #c1(TRPM5) c2(NP_055370) c3(12037) c4(38151, 51208, 64265, 25094, 77322) c5(ar, u, l, y, cl); #c1(TRPM6) c2(NP_001170781) c3(12038) c4(38152, 51209, 64266, 25095, 77323) c5(l, BN, vh, tz, di, bf, TW, aM); #c1 (TRPM7) c2(NP_060142) c3(12039) c4(38153, 51210, 64267, 25096, 77324) c5(bL, ml, b, di, bf, ey, bj, aO, byj, aX, f, bu, mL, fv, y, JY, u, dh, fh, ma, l, aaH, v, by, W, T, bb, aM, ao, BN, bh, ap); #c1(TRPM8) c2(NP_076985) c3(12040) c4(38154, 51211, 64268, 25097, 77325) c5(B, b, fr, A, dV, U, e, y, d, co, aX, kJ, sG, vf, dZ, ar, hb, JF, u, xy, V, cV, ft, cy, qp, vW, auy, jN, crY, aA); #c1(TRPS1) c2(NP_001269831) c3(12041) c4(38155, 51212, 64269, 25098, 77326) c5(Dr, A, sm, fr, di, Em, y, oy, Ag, bb, h, B, asY, do, Um, avh, u, bdD, aC, cQB, aSA, Dw, ft, dt, cQC, T, hR, AP, ac, mP, bpd, Af); #c1(TRPV1) c2(NP_542437) c3(12042) c4(38156, 51213, 64270, 25099, 77327) c5(dx, gK, f, b, k, aiV, vD, DT, vB, ub, iZ, w, dV, ali, bf, ey, akn, A, O, bFF, cy, Jr, vh, DB, cQF, yp, dZ, B, cQD, Tr, zR, dh, nk, aIR, aEd, cB, cV, aC, aFz, du, be, azl, P, cQG, cQE, jB, bn, Tp, fx, cz, qe, aM, jH, qp, Vb, fN, aNY, aAx, hn, sG, vf, jN, i, dn, l, bEZ, aA, ap, eG, rr, coS, aG); #c1(TRPV2) c2(NP_057197) c3(12043) c4(38157, 51214, 64271, 25100, 77328) c5(Jd, A, b, B, fO, IY, w, O, i, Au, cK, fx, bgv, iR, xl, ap); #c1(TRPV3) c2(NP_001245134) c3(12044) c4(38158, 51215, 64272, 25101, 77329) c5(cQH, sG, ccD, vf, eE, mk, dZ, dV, fq); #c1(TRPV4) c2(NP_001170902) c3(12045) c4(38159, 51216, 64273, 25102, 77330) c5(cG, gw, xc, bBv, AA, cQQ, D, cQL, OF, aSr, cnS, cp, qZ, cQJ, cQN, cN, Jr, f, cH, yp, kz, ac, bK, cQP, cQI, QD, jB, rN, Nc, nl, v, cQK, cy, qe, cQM, rM, cQR, PL, cEJ, Vb, Y, zM, cb, zT, fP, bk, l, cQO, dR, fW); #c1(TRPV5) c2(NP_062815) c3(12046) c4(38160, 51217, 64274, 25103, 77331) c5(arA, aF, f, J, iU, M, aeP, di, aox, aAW, bWE, bf, TW, aM); #c1(TRPV6) c2(NP_061116) c3(12047) c4(38161, 51218, 64275, 25104, 77332) c5(f, b, iU, mk, A, D, ak, cO, U, bj, y, qs, jT, ja, nU, ar, B, cs, aYQ, av, u, iT, kF, V, J, ad, dt, T, aIM, Fr, KE, UY); #c1(TRRAP) c2(NP_001231509) c3(12048) c4(38162, 51219, 64276, 25105, 77333) c5(jT, A, aX, b, B, v, BY, sf, si, bUr, fp); #c1(TSACC) c2(NP_001291755) c3(12049) c4(38163, 51220, 64277, 25106, 77334) c5(dB, by, ag, jo, y, cK, bu, u, O); #c1(TSC1) c2(NP_001155899) c3(12050) c4(38164, 51221, 64278, 25107, 77335) c5(dx, by, B, aw, iD, if, EM, cs, dB, lp, w, bf, adr, ca, O, M, dv, iy, DE, kJ, kS, e, aID, mg, cl, Dd, jF, n, g, asd, fe, lb, Ls, ft, aQw, fO, gm, bp, azo, iJ, ME, Ce, od, Jj, x, Lw, fx, jT, HR, cxv, cq, jE, BX, iL, bm, DO, jh, ag, cT, aeP, apK, iT, i, agQ, bkv, pt, avz, bP, GO, kM, iF, X, fE, afY, iP, jf, hS, kY, ate, JE, U, Oh, y, jb, co, ip, yE, pz, fi, f, N, cQS, bu, gX, k, iv, IL, av, fy, buP, kq, QD, d, jB, vR, V, bPc, ze, Dw, qq, Qz, gv, Lv, anD, boN, ny, mD, VP, Fr, iA, YU, JY, W, du, anG, iY, aJX, QO, To, jo, jR, Le, tl, ji, iu, ci, gG, aEg, hV, b, jq, Dr, jg, MS, oi, ic, jC, pF, mF, Mr, hh, ec, ra, jd, re, nU, q, jV, byM, pn, ar, ff, Xp, Um, pB, jG, u, da, jj, VM, l, qL, Xu, Fs, dT, aAM, ad, G, zk, agm, aZ, ct, auY, et, Ut, jU, P, nV, kB, iR, afT, hT, Dj, agb, fg, di, yA, rQ, baW, QU, bL, A, IO, iG, asx, fr, zF, pR, JI, pD, QV, jc, og, hl, JC, gE, zK, alm, jw, hP, buk, dl, RX, qs, cQT, aX, il, Xv, h, xJ, F, gT, cU, zp, ik, Nm, cB, LI, aAS, jZ, py, fU, xc, gO, cV, YR, BC, J, po, dt, ajF, T, II, Ez, nP, cz, bjs, aM, Xw, qp, st, ck, avl, zU, YJ, E, jk, bh, eG, rb); #c1(TSC22D1) c2(NP_001230728) c3(12051) c4(38165, 51222, 64279, 25108, 77336) c5(g, Ag, l, A, QT, gt, b, k, re, B, Fs, anf, qP, T, Af, jT, u, Qq, iT); #c1(TSC22D3) c2(NP_001015881) c3(12052) c4(38166, 51223, 64280, 25109, 77337) c5(aX, am, aC, byr, be, fO, J, brA, rJ, gF, Ey, T, aA, cy, rH, xU, Gq, cp); #c1(TSC22D4) c2(NP_001289972) c3(12053) c4(38167, 51224, 64281, 25110, 77338) c5(amT, b); #c1(TSC2) c2(NP_000539) c3(12054) c4(38168, 51225, 64282, 25111, 77339) c5(aw, dB, ctB, lp, bW, e, O, iy, aID, mg, asa, g, asd, bK, fO, ME, x, Lw, fp, wh, yE, i, bkv, bP, hT, iP, hS, bf, bw, Oh, y, co, f, iv, IL, d, JB, bPc, anD, iA, W, py, aY, P, jR, wl, Dr, b, jq, MS, dk, Ne, hh, axd, nU, ar, ff, u, o, Xu, cz, aZ, et, rQ, iR, iY, ih, dn, JC, k, xc, pD, HS, iL, bj, Ld, cQT, aX, Xv, h, xJ, oJ, cB, bSs, jZ, dt, jo, T, aM, Xw, dl, Nz, Qn, bKe); #c1(TSEN2) c2(NP_001138865) c3(12055) c4(38169, 51226, 64283, 25112, 77340) c5(QZ, xM, cQU, nU, A); #c1(TSEN34) c2(NP_001269261) c3(12056) c4(38170, 51227, 64284, 25113, 77341) c5(QZ, xM, cQU, nU, Vf); #c1(TSEN54) c2(NP_997229) c3(12057) c4(38171, 51228, 64285, 25114, 77342) c5(xM, nU, cQV, Vf, QZ, bM, cQW, cyx); #c1 (TSFM) c2(NP_001166166) c3(12058) c4(38172, 51229, 64286, 25115, 77343) c5(cQX, cK, hT, mg); #c1(TSG101) c2(NP_006283) c3(12059) c4(38173, 51230, 64287, 25116, 77344) c5(B, b, cG, X, pD, A, gE, hP, y, fe, co, bZF, h, f, aBG, q, bu, hV, av, u, iT, fU, J, by, P, T, II, jT, JY, ja, jE, nV, bm, i, l, re); #c1(TSGA10) c2(NP_878915) c3(12060) c4(38174, 51231, 64288, 25117, 77345) c5(A, aX, b, X, t, q, J, hX, G, i, iv, x); #c1(TSHR) c2(XP_005268094) c3(12061) c4(38175, 51232, 64289, 25118, 77346) c5(Bd, Dr, iq, cRc, b, cRj, gw, LQ, cQZ, mk, xO, hM, tG, cRb, ajZ, bw, bD, cRf, Ir, Ag, Hq, cRi, cjg, aOF, Bi, hV, cRg, sW, Uq, og, ra, FN, tg, cxk, u, nj, biT, nP, cRa, bxJ, nV, yV, VD, tp, Dt, fO, pk, gL, cRe, Lz, vc, bNM, T, bp, bwF, bq, auA, cRd, cQY, ii, bDX, dt, bBX, aV, bEa, vg, xL, ale, cMb, iu, nc, aq, cV, bzf, IN, bDZ, W, cRh, bXc, di, pO, BK, nl); #c1(TSHZ1) c2(NP_005777) c3(12062) c4(38176, 51233, 64290, 25119, 77347) c5(bm, A, b, QB, aN, oH, yD, w, di, bV, Fh, bW, aK, y, bb, tX, ra, kV, Bi, ak, q, beP, tF, mR, B, fy, u, o, fh, qw, si, alX, aC, bK, KL, bg, aDz, rw, Bd, ji, tj, kS, cRk, aL, ao, ck, xM, akX, aT, eG, kK); #c1(TSHZ2) c2(NP_001180350) c3(12063) c4(38177, 51234, 64291, 25120, 77348) c5(bq, A, gR); #c1(TSHZ3) c2(NP_065907) c3(12064) c4(38178, 51235, 64292, 25121, 77349) c5(ao, A, gR, B, cRm, Eo, di, cRI, at, u, y); #c1(TSLP) c2(NP_149024) c3(12065) c4(38179, 51236, 64293, 25122, 77350) c5(dx, eX, td, aZ, b, bx, bBV, gE, rd, ali, di, aWb, z, pV, y, dv, cy, aoR, yX, t, DM, f, akm, dQ, qB, as, Ek, gg, u, da, be, aC, yY, du, UG, J, j, G, ti, Jc, II, bt, JN, jU, jH, apD, dP, aei, Jh, cgT, cT, fg, l, ej, aA, bRq, eG, C); #c1(TSNAX) c2(NP_005990) c3(12066) c4(38180, 51237, 64294, 25123, 77351) c5(hW, b, ahq, aY, aqu, ak, cz, cU, cA, wr); #c1(TSN) c2(NP_001248330) c3(12067) c4(38181, 51238, 64295, 25124, 77352) c5(HI, bb, b, q, Lu, XH, bo, jT); #c1 (TSPAN10) c2(NP_001277141) c3(12068) c4(38182, 51239, 64296, 25125, 77353) c5(bq, bb); #c1(TSPAN11) c2(XP_011518982) c3(12069) c4(38183, 51240, 64297, 25126, 77354) c5(m); #c1(TSPAN12) c2(XP_011514296) c3(12070) c4(38184, 51241, 64298, 25127, 77355) c5(cz, byp, byn, b, cRn); #c1(TSPAN13) c2(NP_055214) c3(12071) c4(38185, 51242, 64299, 25128, 77356) c5(A, u, eu, y, B); #c1(TSPAN14) c2(NP_001121781) c3(12072) c4(38186, 51243, 64300, 25129, 77357) c5(bra, fy); #c1 (TSPAN16) c2(NP_001269438) c3(12073) c4(38187, 51244, 64301, 25130, 77358) c5(t, G); #c1(TSPAN18) c2(XP_006718435) c3(12074) c4(38188, 51245, 64302, 25131, 77359) c5(py); #c1(TSPAN31) c2(NP_005972) c3(12075) c4(38189, 51246, 64303, 25132, 77360) c5(e, b, fr, hS, QR, w, bo, nT, yw, iK, jx, d, tp, QV, h, F, bu, ciL, dQ, cM, AS, cV, by, P, ft, aY, QG, dc); #c1(TSPAN32) c2(NP_620591) c3(12076) c4(38190, 51247, 64304, 25133, 77361) c5(kt, en, ag); #c1(TSPAN33) c2(NP_848657) c3(12077) c4(38191, 51248, 64305, 25134, 77362) c5(m, h, gm, n, jT, fh); #c1(TSPAN4) c2(XP_005253159) c3(12078) c4(38192, 51249, 64306, 25135, 77363) c5(b, eo); #c1 (TSPAN6) c2(NP_003261) c3(12079) c4(38193, 51250, 64307, 25136, 77364) c5(vY); #c1(TSPAN7) c2(NP_004606) c3(12080) c4(38194, 51251, 64308, 25137, 77365) c5(A, jl, b, gH, pR, nU, B, cRo, o); #c1(TSPAN8) c2(XP_006719646) c3(12081) c4(38195, 51252, 64309, 25138, 77366) c5(b, bY, bf, U, aW, aX, ak, q, vu, ik, cs, dj, V, l, aC, Ej, gv, P, T, aM, eJ, acg, bh, aA, ap); #c1(TSPAN9) c2(NP_001161792) c3(12082) c4(38196, 51253, 64310, 25139, 77367) c5(bb, n, l, awg); #c1(TSPEAR) c2(NP_001258966) c3(12083) c4(38197, 51254, 64311, 25140, 77368) c5(hS, dj, cRp); #c1(TSP02) c2(XP_011512699) c3(12084) c4(38198, 51255, 64312, 25141, 77369) c5(l, jl); #c1(TSP0) c2(NP_001243459) c3(12085) c4(38199, 51256, 64313, 25142, 77370) c5(hV, b, k, eu, tR, aN, O, w, ak, xu, Fr, cA, bf, U, aK, e, cM, d, E, wX, co, aX, RD, ps, ml, f, F, y, A, YR, gu, aCH, aV, u, dh, g, ahB, baE, V, B, hZ, sB, v, cz, P, T, cV, bq, cy, jT, ac, aM, nV, aXp, uJ, aY, sS, agU, ih, rV, i, dc, od, iu, Bi, bV): #c1(TSPY10) c2(NP_001269398) c3(12086) c4(38200, 51257, 64314, 25143, 77371) c5(A, b, wy, afR, BY, ck, ps, y, am, B, q, PX, bm, jE, j, P, Ca, Lu, wV, bxK, u, UW, wP); #c1(TSPY1) c2(NP_003299) c3(12087) c4(38201, 51258, 64315, 25144, 77372) c5(A, b, wy, afR, BY, ck, Lr, ps, y, am, B, q, PX, bm, jE, wV, j, P, Ca, Lu, US, bxK, u, UW, wP, rv); #c1(TSPY3) c2(XP_011542306) c3(12088) c4(38202, 51259, 64316, 25145, 77373) c5(A, b, wy, afR, BY, ck, ps, y, am, B, q, PX, bm, jE, j, P, Ca, Lu, wV, bxK, u, UW, wP); #c1(TSPY4) c2(NP_001157943) c3(12089) c4(38203, 51260, 64317, 25146, 77374) c5(A, b, wy, afR, BY, ck, ps, y, am, B, q, PX, bm, jE, j, P, Ca, Lu, wV, bxK, u, UW, wP); #c1(TSPYL1) c2(NP_003300) c3(12090) c4(38204, 51261, 64318, 25147, 77375) c5(Fp, agd, cRq, O, am); #c1 (TSPYL2) c2(NP_071400) c3(12091) c4(38205, 51262, 64319, 25148, 77376) c5(jT, co, alj, b, yh, q, adH, Oj, fG, P, fl, iA, fy); #c1(TSPYL4) c2(NP_067680) c3(12092) c4(38206, 51263, 64320, 25149, 77377) c5(aX); #c1 (TSPYL5) c2(NP_277047) c3(12093) c4(38207, 51264, 64321, 25150, 77378) c5(A, by, y, bu, u, O); #c1(TSR1) c2(NP_060598) c3(12094) c4(38208, 51265, 64322, 25151, 77379) c5(ap); #c1(TSSC1) c2(NP_003301) c3(12095) c4(38209, 51266, 64323, 25152, 77380) c5(IV); #c1 (TSSKIB) c2(NP_114417) c3(12096) c4(38210, 51267, 64324, 25153, 77381) c5(Jh, j, am); #c1(TSSK2) c2(NP_443732) c3(12097) c4(38211, 51268, 64325, 25154, 77382) c5(vc, j); #c1(TSSK4) c2(NP_001171668)

c3(12098) c4(38212, 51269, 64326, 25155, 77383) c5(wn, NT, am); #c1(TSTA3) c2(NP_003304) c3(12099) c4(38213, 51270, 64327, 25156, 77384) c5(co); #c1(TSTD1) c2(NP_001106676) c3(12100) c4(38214, 51271, 64328, 25157, 77385) c5(qL, Dr, b); #c1(TST) c2(NP_003303) c3(12101) c4(38215, 51272, 64329, 25158, 77386) c5(afE, Mj, iU, cas, yn, Mn, aW, ml, q, nv, vu, A, nR, nQ, nW, P, arf, SF, jU, cvU, bGj, dX, nE); #c1(TTBK1) c2(NP_115927) c3(12102) c4(38216, 51273, 64330, 25159, 77387) c5(HN, o); #c1(TTBK2) c2(NP_775771) c3(12103) c4(38217, 51274, 64331, 25160, 77388) c5(aX, xM, dB, alY, jo, rw, kV, cRr); #c1(TTCl2) c2(NP_060338) c3(12104) c4(38218, 51275, 64332, 25161, 77389) c5(Yk, aX, Gt, t, bf, IV, at, Gj); #c1(TTC17) c2(NP_060729) c3(12105) c4(38219, 51276, 64333, 25162, 77390) c5(cy, cV); #c1(TTC19) c2(NP_060245) c3(12106) c4(38220, 51277, 64334, 25163, 77391) c5(aqm, cRs, agl, bK, hT, v, aqj, bYj); #c1(TTC1) c2(NP_001269429) c3(12107) c4(38221, 51278, 64335, 25164, 77392) c5(ih); #c1(TTC21B) c2(NP_079029) c3(12108) c4(38222, 51279, 64336, 25165, 77393) c5(cRt, cRu, TD, IV, et, o); #c1(TTC28) c2(NP_001138890) c3(12109) c4(38223, 51280, 64337, 25166, 77394) c5(aA, U, V); #c1(TTC29) c2(NP_001287690) c3(12110) c4(38224, 51281, 64338, 25167, 77395) c5(at); #c1(TTC37) c2(NP_055454) c3(12111) c4(38225, 51282, 64339, 25168, 77396) c5(aYK); #c1(TTC39A) c2(NP_001284592) c3(12112) c4(38226, 51283, 64340, 25169, 77397) c5(bf, bm, y); #c1(TTC39B) c2(NP_001161812) c3(12113) c4(38227, 51284, 64341, 25170, 77398) c5(bf, at, or, I); #c1(TTC3) c2(NP_001001894) c3(12114) c4(38228, 51285, 64342, 25171, 77399) c5(aq, ans, aE); #c1(TTC5) c2(NP_612385) c3(12115) c4(38229, 51286, 64343, 25172, 77400) c5(b, h, f, J, es, T, ji); #c1(TTC6) c2(XP_011535733) c3(12116) c4(38230, 51287, 64344, 25173, 77401) c5(cRv, qf, i, cO); #c1(TTC7A) c2(NP_001275882) c3(12117) c4(38231, 51288, 64345, 25174, 77402) c5(aC, bsD, fP, dA); #c1(TTC7B) c2(NP_001010854) c3(12118) c4(38232, 51289, 64346, 25175, 77403) c5(bb, aO, ap); #c1(TTC8) c2(NP_001275710) c3(12119) c4(38233, 51290, 64347, 25176, 77404) c5(cRx, ml, cRw, TD, cO, aA, nW); #c1(TTC9B) c2(NP_689692) c3(12120) c4(38234, 51291, 64348, 25177, 77405) c5(aqV); #c1(TTC9C) c2(NP_776171) c3(12121) c4(38235, 51292, 64349, 25178, 77406) c5(A); #c1(TTC9) c2(NP_056166) c3(12122) c4(38236, 51293, 64350, 25179, 77407) c5(Wf); #c1(TTF1) c2(XP_006717336) c3(12123) c4(38237, 51294, 64351, 25180, 77408) c5(Dr, b, Sc, ahS, og, hM, ckg, e, d, co, hV, FN, apB, ar, n, kN, fy, biV, fU, FL, bp, P, T, nV, QN, Bg, bpk, gd, ji, af); #c1(TTF2) c2(XP_011540606) c3(12124) c4(38238, 51295, 64352, 25181, 77409) c5(og, aQF, Nq, Ns, ag, cBh, hM, bwF, aNd); #c1(TTI1) c2(NP_001290386) c3(12125) c4(38239, 51296, 64353, 25182, 77410) c5(fO); #c1(TTI2) c2(NP_079391) c3(12126) c4(38240, 51297, 64354, 25183, 77411) c5(cRy, nU); #c1(TTK) c2(XP_011534401) c3(12127) c4(38241, 51298, 64355, 25184, 77412) c5(fl, bNm, b, sl, w, kY, y, aX, IU, kJ, F, bu, ik, ji, u, o, aLt, em, kF, V, il, LG, by, pt, fx, jT, ao, hT, ag, aaS, kA, i, oM, atq); #c1(TTL) c2(NP_714923) c3(12128) c4(38242, 51299, 64356, 25185, 77413) c5(A, B, cV); #c1(TTLL10) c2(XP_011539472) c3(12129) c4(38243, 51300, 64357, 25186, 77414) c5(nR); #c1(TTLL11) c2(NP_001132914) c3(12130) c4(38244, 51301, 64358, 25187, 77415) c5(Ns, Nq); #c1(TTLL12) c2(NP_055955) c3(12131) c4(38245, 51302, 64359, 25188, 77416) c5(ac); #c1(TTLL1) c2(NP_036395) c3(12132) c4(38246, 51303, 64360, 25189, 77417) c5(A, B, cV); #c1(TTLL3) c2(NP_001021100) c3(12133) c4(38247, 51304, 64361, 25190, 77418) c5(U); #c1(TTLL4) c2(NP_055455) c3(12134) c4(38248, 51305, 64362, 25191, 77419) c5(ag, kJ); #c1(TTLL5) c2(NP_055887) c3(12135) c4(38249, 51306, 64363, 25192, 77420) c5(X, av, nR, b); #c1(TTLL6) c2(NP_001124390) c3(12136) c4(38250, 51307, 64364, 25193, 77421) c5(bq, cV); #c1(TTLL7) c2(XP_011540457) c3(12137) c4(38251, 51308, 64365, 25194, 77422) c5(o); #c1(TTLL8) c2(XP_011529043) c3(12138) c4(38252, 51309, 64366, 25195, 77423) c5(bb); #c1(TTLL9) c2(NP_001008409) c3(12139) c4(38253, 51310, 64367, 25196, 77424) c5(bm, kF); #c1(TTPA) c2(NP_000361) c3(12140) c4(38254, 51311, 64368, 25197, 77425) c5(dx, A, cT, bBv, sl, kV, aXC, LL, bSm, B, q, sL, aUu, ss, bm, EX, cc, DU, du, aC, bK, nW, sn, v, dt, P, QI, KX, bq, Lc, sp, o, hM, df, ml); #c1(TTR) c2(NP_000362) c3(12141) c4(38255, 51312, 64369, 25198, 77426) c5(aKI, dx, dM, aw, gG, dB, ctB, aN, lp, en, hM, cO, aK, O, dv, tX, kJ, aKH, RW, cRE, ajc, bK, du, bp, aax, aE, hR, pq, aL, amy, aKB, cRJ, bLx, dc, aKG, Dr, Dv, aYv, ahg, xw, cM, aGQ, DG, cDb, f, pl, aaZ, ky, bm, EX, jB, cRI, ckJ, v, ct, bny, cK, cRB, ahT, asJ, aoy, aY, amj, er, jR, aNw, abE, Zo, b, bLh, cRA, jq, cRD, cRH, LP, ec, jd, nU, q, aYd, cRF, fv, u, ov, o, fh, cag, l, KL, nd, rw, nb, aaK, et, jU, ao, anG, RS, DR, ZI, aoA, vT, bzf, zZ, cyl, y, C, bL, di, RC, cRK, cRC, aKE, bkC, cRz, LI, aci, h, tF, afl, Ld, aq, RZ, cV, cRL, dt, T, cRG, ac, sK, Y, Nq, cb, cH, Yv, aT); #c1(TTYH1) c2(NP_001005367) c3(12142) c4(38256, 51313, 64370, 25199, 77427) c5(g); #c1(TTYH2) c2(NP_116035) c3(12143) c4(38257, 51314, 64371, 25200, 77428) c5(x, aal, dB); #c1(TUBA1A) c2(NP_001257328) c3(12144) c4(38258, 51315, 64372, 25201, 77429) c5(aij, cC, agn, FR, nU, ME, beb, cjd, cRM, FT, IG, QZ, at, FY); #c1(TUBA1B) c2(NP_006073) c3(12145) c4(38259, 51316, 64373, 25202, 77430) c5(A, beb, FT, e, y, cp, d, m, co, aX, re, B, q, cU, cs, fy, u, iT, bPJ, ad, aqR, blj); #c1(TUBA1C) c2(NP_001290046) c3(12146) c4(38260, 51317, 64374, 25203, 77431) c5(A, bu); #c1(TUBA3D) c2(NP_525125) c3(12147) c4(38261, 51318, 64375, 25204, 77432) c5(aPg, fy, bUk); #c1(TUBA4A) c2(NP_001265481) c3(12148) c4(38262, 51319, 64376, 25205, 77433) c5(ao, fy, fc, PY, aV, u); #c1(TUBA8) c2(NP_001180343) c3(12149) c4(38263, 51320, 64377, 25206, 77434) c5(oC, Zz, aF, oB, ak, q, ex, blj, T, cs, z, x, gF, jv, o); #c1(TUBB1) c2(NP_110400) c3(12150) c4(38264, 51321, 64378, 25207, 77435) c5(bq, ql, bb, cRN, ap); #c1(TUBB2A) c2(NP_001060) c3(12151) c4(38265, 51322, 64379, 25208, 77436) c5(hS, h, bu, cRO); #c1(TUBB2B) c2(NP_821080) c3(12152) c4(38266, 51323, 64380, 25209, 77437) c5(FT, Ag, bxA, aUs, FR, cC, cRP, IG, Af, cRQ, QZ, T, u); #c1(TUBB3) c2(NP_001184110) c3(12153) c4(38267, 51324, 64381, 25210, 77438) c5(A, aw, b, X, sf, gn, aN, lp, hS, yD, bxA, XW, PZ, aUs, fx, y, d, co, XZ, re, f, e, bu, ar, B, n, av, fy, u, aE, iT, ff, KW, Ad, Vf, cV, p, cRS, Fs, j, by, dt, iB, aGR, T, II, XT, bM, x, Jw, cRR, jT, fU, XY, aNH, amy, st, kB, Ya, jR, ag, w, Yb, i, bDS, XX, XV, anK, bp, ci, ap); #c1(TUBB4A) c2(NP_001276056) c3(12154) c4(38268, 51325, 64382, 25211, 77439) c5(en, b, k, X, Pv, dB, kB, sJ, w, dV, Wy, A, y, co, aX, Tv, B, JI, fr, dZ, mR, O, av, aV, u, aE, cRU, hW, cV, fO, ft, afJ, P, cRT, II, QZ, fx, hR, afv, aGR, fc, blz, akT, os, uH, qP, CL, i, bDS, bM); #c1(TUBB4B) c2(NP_006079) c3(12155) c4(38269, 51326, 64383, 25212, 77440) c5(sE, dB, lp, w, cO, bf, xl, cy, qc, yh, eE, mR, aD, mz, aC, ME, GI, jT, hj, mO, pq, cT, aA, id, agx, X, arQ, mk, iG, Fh, U, uH, y, arR, bhG, co, pp, amo, DM, ak, IN, cs, Ch, av, fy, pP, gw, V, aNO, bJc, dP, byf, fG, ji, dR, iu, ap, aOe, b, GL, aPW, z, zL, bb, Ro, ra, q, jV, CO, pn, vu, ar, ff, as, dQ, u, aE, da, sz, im, Dg, be, UG, sC, j, RI, CM, lo, ct, JI, agQ, Ck, eo, na, aU, di, qs, aX, kn, h, aOd, aV, fU, cV, be, xS, J, jo, ti, T, II, jl, eN); #c1(TUBB6) c2(NP_001290455) c3(12156) c4(38270, 51327, 64384, 25213, 77441) c5(U, V); #c1(TUBB) c2(NP_001280142) c3(12157) c4(38271, 51328, 64385, 25214, 77442) c5(m, b, X, dB, bp, do, jo, Em, mR, ff, QZ, av, u, y, ap); #c1(TUBD1) c2(NP_001180538) c3(12158) c4(38272, 51329, 64386, 25215, 77443) c5(u); #c1(TUBE1) c2(NP_057346) c3(12159) c4(38273, 51330, 64387, 25216, 77444) c5(u, aE); #c1(TUBG1) c2(NP_001061) c3(12160) c4(38274, 51331, 64388, 25217, 77445) c5(Ad, cRV, cjd, FT, QZ, PZ, u, y); #c1(TUBG2) c2(NP_057521) c3(12161) c4(38275, 51332, 64389, 25218, 77446) c5(u); #c1(TUBGCP2) c2(NP_001243546) c3(12162) c4(38276, 51333, 64390, 25219, 77447) c5(bq, aZQ); #c1(TUBGCP3) c2(NP_006313) c3(12163) c4(38277, 51334, 64391, 25220, 77448) c5(aC, bm); #c1(TUBGCP4) c2(NP_001273343) c3(12164) c4(38278, 51335, 64392, 25221, 77449) c5(u); #c1(TUBGCP5) c2(NP_001096080) c3(12165) c4(38279, 51336, 64393, 25222, 77450) c5(rv, cz); #c1(TUBGCP6) c2(NP_065194) c3(12166) c4(38280, 51337, 64394, 25223, 77451) c5(QZ, ml, P); #c1(TUB) c2(NP_003311) c3(12167) c4(38281, 51338, 64395, 25224, 77452) c5(A, nQ, l, aIM, ml, eX, nE, aA, nR, nW); #c1(TUFM) c2(NP_003312) c3(12168) c4(38282, 51339, 64396, 25225, 77453) c5(dx, dv, cy, du, cRW, yE, cT, ik, iL, aA); #c1(TUFT1) c2(NP_001119809) c3(12169) c4(38283, 51340, 64397, 25226, 77454) c5(kC, Ur, ku); #c1(TULP1) c2(NP_001276324) c3(12170) c4(38284, 51341, 64398, 25227, 77455) c5(cRY, nQ, aIM, ml, cRZ, nE, aA, cwA, nW, cRX); #c1(TULP2) c2(NP_003314) c3(12171) c4(38285, 51342, 64399, 25228, 77456) c5(nW, nQ, cRX); #c1(TULP3) c2(NP_001153880) c3(12172) c4(38286, 51343, 64400, 25229, 77457) c5(ag, fv, kJ); #c1(TULP4) c2(NP_001007467) c3(12173) c4(38287, 51344, 64401, 25230, 77458) c5(bOA); #c1(TUSC1) c2(NP_001004125) c3(12174) c4(38288, 51345, 64402, 25231, 77459) c5(is, qf, co, aX, bu, A, di, ic, eO, by); #c1(TUSC2) c2(NP_009206) c3(12175) c4(38289, 51346, 64403, 25232, 77460) c5(vq, b, iP, eu, w, cO, bf, zY, y, co, eK, F, fy, u, zW, fU, V, J, bp, jl, ao, QJ, oi, bk, aA, wT); #c1(TUSC3) c2(NP_006756) c3(12176) c4(38290, 51347, 64404, 25233, 77461) c5(d, fr, A, cy, X, nU, cSa, ft, kB, w, eq, av, e); #c1(TUSC5) c2(NP_758955) c3(12177) c4(38291, 51348, 64405, 25234, 77462) c5(bf, aM); #c1(TUT1) c2(NP_073741) c3(12178) c4(38292, 51349, 64406, 25235, 77463) c5(b); #c1(TVP23B) c2(NP_057162) c3(12179) c4(38293, 51350, 64407, 25236, 77464) c5(bw); #c1(TWF1) c2(NP_001229326) c3(12180) c4(38294, 51351, 64408, 25237, 77465) c5(jT, u, y); #c1(TWIST1) c2(XP_011513798) c3(12181) c4(38295, 51352, 64409, 25238, 77466) c5(B, aw, aZ, vB, cO, e, O, cp, BO, ik, zW, agu, aBE, tz, ft, rQ, cSd, cSb, fx, av, ag, i, aA, AI, sm, arB, X, Ak, bw, U, y, alS, co, yX, f, bu, btF, DP, cs, gg, fy, iT, yJ, em, Am, V, bny, iA, nJ, fG, ji, bp, ci, bsF, hV, b, agt, q, d, jh, zJ, re, nU, arm, ar, hb, btn, u, il, avo, ad, iD, jH, nV, pS, na, agf, asj, g, A, fr, gw, aKd, aX, xJ, F, cO, cSc, n, bua, LR, cV, Be, be, W, T, acl, by, AP, fM, auy); #c1(TWIST2) c2(NP_001258822) c3(12182) c4(38296, 51353, 64410, 25239, 77467) c5(b, X, aAM, ate, jy, U, e, y, d, t, re, q, fr, av, u, iT, V, J, ft, G, T, rT, cSe, cT, Cy); #c1(TWSG1) c2(NP_065699) c3(12183) c4(38297, 51354, 64411, 25240, 77468) c5(by, B, aw, b, X, pR, iP, dB, A, hl, U, e, y, d, jh, co, aX, h, f, q, bu, ar, cB, cs, av, fy, u, EM, iT, iF, fU, V, cV, aSw, bp, gv, G, T, agm, VP, ad, aai, iR, jR, ag, Lo, bh, re); #c1(TXK) c2(NP_003319) c3(12184) c4(38298, 51355, 64412, 25241, 77469) c5(ix); #c1(TXLNG) c2(NP_001162154) c3(12185) c4(38299, 51356, 64413, 25242, 77470) c5(bm, q); #c1(TXN2) c2(XP_005261565) c3(12186) c4(38300, 51357, 64414, 25243, 77471) c5(IJ, ma, BX, ip, fr, aF, f, ch, mR, ny, Bs, bf, ft, u, y, aM); #c1(TXNDC15) c2(NP_078991) c3(12187) c4(38301, 51358, 64415, 25244, 77472) c5(u, fO, y); #c1(TXNDC16) c2(NP_065835) c3(12188) c4(38302, 51359, 64416, 25245, 77473) c5(jd, Nq); #c1(TXNDC17) c2(NP_116120) c3(12189) c4(38303, 51360, 64417, 25246, 77474) c5(jh); #c1(TXNDC5) c2(NP_001139021) c3(12190) c4(38304, 51361, 64418, 25247, 77475) c5(by, A, pV, jE, b, Be, bm, re, f, q, fO, bu, ag, nl, qB, aC, Oi, JY, u, gl); #c1(TXN) c2(NP_001231867) c3(12191) c4(38305, 51362, 64419, 25248, 77476) c5(dx, pm, en, sE, HG, lp, w, cO, bf, ajf, O, dv, b, tE, cSf, aC, bK, yL, du, bp, aDe, wh, sS, fN, aeR, ag, cT, bk, pt, X, vD, jz, iG, bw, U, y, co, f, bu, ky, B, cs, av, fy, yJ, em, V, Bs, v, MW, bq, cK, er, PY, aoD, oM, aDF, ap, am, z, ey, bb, q, dQ, Km, u, dh, fh, Pu, l, ad, BZ, as, et, jU, ao, ch, eQ, aE, kC, aff, lv, A, k, fr, gn, di, C, jQ, qs, aX, F, oJ, aq, ma, cV, an, xf, be, J, dt, uF, T, fO, zS, by, aM, aG, eG); #c1(TXNL1) c2(NP_004777) c3(12192) c4(38306, 51363, 64420, 25249, 77477) c5(by, h, f, bu); #c1(TXNRD2) c2(NP_001269441) c3(12193) c4(38307, 51364, 64421, 25250, 77478) c5(hV, pV, als, b, A, hM, JE, iq, bD, gZ, U, y, zJ, kT, f, q, bu, mR, B, qB, u, JI, ma, V, aC, nl, oK, by, nV, aif, baa, ii, ch, mx, i, eN, pO); #c1(TXNRD3NB) c2(NP_001034872) c3(12194) c4(38308, 51365, 64422, 25251, 77479) c5(da); #c1(TYK2) c2(XP_011526547) c3(12195) c4(38309, 51366, 64423, 25252, 77480) c5(bhv, A, b, X, dB, mW, sJ, dd, DM, cA, al, pz, y, M, Ei, cy, pp, jd, h, eE, hN, jT, cM, n, zQ, aV, u, gl, cSg, da, l, m, aC, J, btl, II, pF, fM, of, ie, aE, btO, DI, bh, aA, bT, pv); #c1(TYMP) c2(NP_001107227) c3(12196) c4(38310, 51367, 64424, 25253, 77481) c5(avO, dx, hT, aw, b, zH, X, jh, i, Lh, cSi, cSh, kM, w, ic, bw, GV, bf, U, hP, fx, y, d, cU, co, aX, aeM, kW, ni, re, f, e, q, bu, dl, FJ, bn, mg, O, A, cs, hV, av, fy, u, iT, aNN, fi, og, V, l, yg, aC, du, brv, ad, W, dv, T, cV, Oi, x, iA, by, ac, ao, da, Y, Nv, AB, ex, ag, FH, tl, bh, ar, at, eG, PM); #c1(TYMS) c2(NP_001062) c3(12197) c4(38311, 51368, 64425, 25254, 77482) c5(avO, IJ, B, aw, iX, dB, Ty, w, ps, e, gM, t, dl, gP, jM, Qx, aC, bK, Xc, Dt, gm, bp, x, fx, jT, cSk, pq, bSA, hQ, ie, ag, i, dc, jl, Nn, fl, GM, X, oa, ix, Dj, bw, U, Oh, cM, tp, co, ip, aiz, f, cs, bu, gX, iv, av, fy, bm, cSj, iT, fi, V, ae, aZz, byO, cd, YS, ny, Hh, iA, JY, ahT, GB, iP, py, aY, P, ji, apT, bn, IH, b, ia, oi, Og, jy, d, jh, bb, QO, jd, re, je, g, ar, ff, aJ, as, jG, u, fh, PJ, qy, aEf, il, ad, G, aeC, et, Ut, iw, hT, Bg, Ns, fl, l, Mp, azt, GK, A, fr, pR, gN, xf, jw, hP, yw, m, aX, aGp, awz, sG, wG, h, F, gT, cU, hN, ik, y, cB, nA, QJ, aq, fU, J, W, jo, T, fO, cr, Ap, ac, ast, qp, awA, atJ, Nq, by, cgD, Af, Oi, at, rb); #c1(TYR) c2(NP_000363) c3(12198) c4(38312, 51369, 64426, 25255, 77483) c5(cSI, ak, pV, en, aw, aTh, O, iy, IZ, cSn, JZ, zb, g, aeM, auf, cg, f, cmz, DO, XP, w, bk, i, Nn, zu, cY, jz, dV, hg, e, dZ, B, cs, av, fy, cSg, cSs, cJ, aJV, jC, cSo, cSr, tl, kD, ck, b, bHB, cSm, azB, ic, alE, HQ, d, bbM, ceu, ND, X, RF, da, cz, awT, he, rv, fl, l, yA, aX, A, aYu, aBV, ow, lv, bj, sb, jQ, m, jl, LI, cB, qB, aV, dj, hW, cV, J, dt, cSp, asn, YQ); #c1(TYR03) c2(NP_006284) c3(12199) c4(38313, 51370, 64427, 25256, 77484) c5(dx, A, b, qd, mW, QR, iK, m, co, cy, LI, h, B, dh, be, fs, du, BC, J, bp, P, QI, II, dO, cSt, gl); #c1(TYR0BP) c2(NP_001166985) c3(12200) c4(38314, 51371, 64428, 25257, 77485) c5(mZ, fl, hW, m, X, Fs, axY, HG, dt, aC, abr, z, et, anf, bOI); #c1(TYRP1) c2(NP_000541) c3(12201) c4(38315, 51372, 64429, 25258, 77486) c5(ake, f, pV, b, GL, bHB, cSm, z, eR, aN, A, jC, ic, Gk, cSv, kV, e, y, d, aX, aeM, IZ, IY, sG, wd, hg, cs, cY, ar, B, Hk, cSu, av, aV, u, aNN, xc, cSs, nQ, cV, p, qB, cbf, v, bp, ad, dt, lh, aJV, Jj, aYz, cy, et, Jd, xO, fc, iu, er, DO, cmA, vW, XP, aah, X, dR, kD, ap); #c1 (TYSND1) c2(NP_001035363) c3(12202) c4(38316, 51373, 64430, 25259, 77487) c5(am, bE); #c1(TYW1B) c2(XP_011514532) c3(12203) c4(38317, 51374, 64431, 25260, 77488) c5(bj, bb); #c1(U2AF1) c2(NP_001020375) c3(12204) c4(38318, 51375, 64432, 25261, 77489) c5(zp, b, hX, cPr, h, zh, P, nJ, ag, cT, zk, T, n, ar, di, pJ, aq, ci, cp); #c1(U2AF2) c2(NP_001012496) c3(12205) c4(38319, 51376, 64433, 25262, 77490) c5(U, V); #c1(UACA) c2(NP_001008225) c3(12206) c4(38320, 51377, 64434, 25263, 77491) c5(ac, fy, q, b, nj); #c1(UAP1) c2(NP_003106) c3(12207) c4(38321, 51378, 64435, 25264, 77492) c5(di); #c1(UBA1) c2(XP_011542255) c3(12208) c4(38322, 51379, 64436, 25265, 77493) c5(apR, aC, asf, apA, cSw, kz, Qx); #c1(UBA2) c2(NP_005490) c3(12209) c4(38323, 51380, 64437, 25266, 77494) c5(FT, xM, ahE, ahC, Xd, IC, nx, nz, nU, ahz, cz, hS, P, bM, dl, ahD, bK, afA, u, FR); #c1(UBA3) c2(NP_003959) c3(12210) c4(38324, 51381, 64438, 25267, 77495) c5(aq); #c1(UBA7) c2(NP_003326) c3(12211) c4(38325, 51382, 64439, 25268, 77496) c5(co, b, apd, lb, bp, jV, II, pB); #c1(UBAC1) c2(NP_057256) c3(12212) c4(38326, 51383, 64440, 25269, 77497) c5(aF); #c1(UBAC2) c2(NP_001137544) c3(12213) c4(38327, 51384, 64441, 25270, 77498) c5(ix, tl); #c1 (UBAP1) c2(NP_001164672) c3(12214) c4(38328, 51385, 64442, 25271, 77499) c5(id, sj, T, aj, bq, ai); #c1(UBAP2) c2(NP_001269458) c3(12215) c4(38329, 51386, 64443, 25272, 77500) c5(ai); #c1(UBASH3A) c2(NP_001001895) c3(12216) c4(38330, 51387, 64444, 25273, 77501) c5(m, aX, aC, ig, qB, bf, aA, dH, iu, aE, aM); #c1(UBASH3B) c2(NP_116262) c3(12217) c4(38331, 51388, 64445, 25274, 77502) c5(A, aw, mW, sJ, ix, Xv, y, iy, m, cy, t, h, B, VM, jG, bm, gl, nl, l, Xu, G, bb, Xw, jE, u, yC); #c1(UBB) c2(NP_001268647) c3(12218) c4(38332, 51389, 64446, 25275, 77503) c5(acE, bS, b, lk, aIV, bg, aK, bSf, DG, re, cBf, aaZ, adQ, aq, iT, aOP, cV, GS, v, aN, axM, HN, o); #c1(UBC) c2(NP_066289) c3(12219) c4(38333, 51390, 64447, 25276, 77504) c5(Ke, wV, f, si, jT, ak, wP, ar, i, fx, at, u, y); #c1(UBD) c2(NP_006389) c3(12220) c4(38334, 51391, 64448, 25277, 77505) c5(aw, b, GL, ig, ix, iL, cA, bf, U, m, kJ, q, jV, iZ, cs, qu, aV, o, si, V, lb, ad, P, T, rV, aVd, et, aM, GJ, bT); #c1(UBE2A) c2(NP_001269090) c3(12221) c4(38335, 51392, 64449, 25278, 77506) c5(atn, f, WW, nz, nU, bxq, cSx); #c1(UBE2B) c2(NP_003328) c3(12222) c4(38336, 51393, 64450, 25279, 77507) c5(b, gE, aSB, lp, wn, pu, z, y, rY, am, re, f, q, cB, bm, iT, awq, NT, nl, P, T, jT, u, fl, yA); #c1(UBE2C) c2(NP_001268671) c3(12223) c4(38337, 51394, 64451, 25280, 77508) c5(B, b, k, FL, w, U, A, e, y, d, co, re, hV, q, FN, ar, O, cB, av, fy, u, iT, V, VD, cV, qL, W, zU, T, x, jT, nV, QN, py); #c1(UBE2D1) c2(NP_003329) c3(12224) c4(38338, 51395, 64452, 25281, 77509) c5(yK, b, yO, yM, o, pq); #c1 (UBE2D2) c2(NP_003330) c3(12225) c4(38339, 51396, 64453, 25282, 77510) c5(n, b); #c1(UBE2D3) c2(NP_003331) c3(12226) c4(38340, 51397, 64454, 25283, 77511) c5(bf, nV, u, fl, y); #c1(UBE2E1) c2(NP_001189405) c3(12227) c4(38341, 51398, 64455, 25284, 77512) c5(czR, mk, Pz); #c1(UBE2E2) c2(NP_689866) c3(12228) c4(38342, 51399, 64456, 25285, 77513) c5(oy, d, b, l, ik, u, e, y); #c1(UBE2E3) c2(NP_006348) c3(12229) c4(38343, 51400, 64457, 25286, 77514) c5(lp, ig, nl, y); #c1(UBE2G1) c2(NP_003333) c3(12230) c4(38344, 51401, 64458, 25287, 77515) c5(fl, b); #c1(UBE2G2) c2(NP_003334) c3(12231) c4(38345, 51402, 64459, 25288, 77516) c5(J); #c1(UBE2H) c2(NP_003335) c3(12232) c4(38346, 51403, 64460, 25289, 77517) c5(kF, cz); #c1(UBE2I) c2(NP_003336) c3(12233) c4(38347, 51404, 64461, 25290, 77518) c5(wa, b, X, y, Ag, co, arl, jd, h, f, q, bu, jF, ar, n, iv, av, fy, u, Qx, o, sQ, tp, J, fO, by, T, aX, Af, ji, aA); #c1(UBE2J1) c2(NP_057105) c3(12234) c4(38348, 51405, 64462, 25291, 77519) c5(jR); #c1 (UBE2K) c2(NP_001104582) c3(12235) c4(38349, 51406, 64463, 25292, 77520) c5(bUg, si, il, b, sg, cnV, q, agw, cSy, aiL, H, ik, jT, u, re, iT, aln); #c1(UBE2L3) c2(NP_001243284) c3(12236) c4(38350, 51407, 64464, 25293, 77521) c5(jH, A, m, aC, B, ig, fl, iL, jZ); #c1 (UBE2L6) c2(NP_004214) c3(12237) c4(38351, 51408, 64465, 25294, 77522) c5(en, u, y, b); #c1(UBE2M) c2(NP_003960) c3(12238) c4(38352, 51409, 64466, 25295, 77523) c5(iR, b); #c1(UBE2N) c2(NP_003339) c3(12239) c4(38353, 51410, 64467, 25296, 77524) c5(b, asx, X, gG, jc, fx, O, d, jh, co, f, q, e, cU, ar, n, as, av, fy, iT, da, cV, an, bp, BV, ll, iA, k, Kj, agQ, i, ci); #c1(UBE2Q2) c2(NP_001138807) c3(12240) c4(38354, 51411, 64468, 25297, 77525) c5(b, aBE, F, fD, u, y); #c1(UBE2QL1) c2(NP_001138633) c3(12241) c4(38355, 51412, 64469, 25298, 77526) c5(ix, ff, dB); #c1(UBE2R2) c2(NP_060281) c3(12242) c4(38356, 51413, 64470, 25299, 77527) c5(bb); #c1(UBE2S) c2(NP_055316) c3(12243) c4(38357, 51414, 64471, 25300, 77528) c5(bUq, il, b, sg, cnV, q, agw, cSy, aiL, iT, H, ik, jT, u, re, y, aln); #c1(UBE2T) c2(NP_054895) c3(12244) c4(38358, 51415, 64472, 25301, 77529) c5(dx, dv, aX, b, qL, aF, nz, du, F, q, bp, si, bmh, ew, pt, oM, u, y); #c1(UBE2U) c2(XP_011539067) c3(12245) c4(38359, 51416, 64473, 25302, 77530) c5(dA); #c1(UBE2V1) c2(NP_001027459) c3(12246) c4(38360, 51417, 64474, 25303, 77531) c5(fn, A, b, k, eu, bg, w, iL, xw, aoa, h, B, q, M, Xi, Cp, Qx, jB, wB, v, j, J, P, T, II, avY, cq, ao, f, PY, Dj, fl); #c1(UBE2V2) c2(NP_003341) c3(12247) c4(38361, 51418, 64475, 25304, 77532) c5(f); #c1(UBE2Z) c2(NP_075567) c3(12248) c4(38362, 51419, 64476, 25305, 77533) c5(da, b, X, hn, hv, ih, acF, av, at); #c1(UBE3A) c2(XP_005268328) c3(12249) c4(38363, 51420, 64477, 25306, 77534) c5(f, aw, b, aPW, lp, hS, A, y, h, nU, M, u, Qx, iT, si, bK, v, gL, cz, dt, XV, AP, cSz, agw, bpd, n, re); #c1(UBE3B) c2(NP_001257380) c3(12250) c4(38364, 51421, 64478, 25307, 77535) c5(S, cV, WW, cBi, cSy, cSA); #c1(UBE3C) c2(NP_055486) c3(12251) c4(38365, 51422, 64479, 25308, 77536) c5(cy, q, aCU); #c1(UBE4A) c2(NP_001191006) c3(12252) c4(38366, 51423, 64480, 25309, 77537) c5(jH, b, cV, Jh, f, j); #c1(UBE4B) c2(XP_011538792) c3(12253) c4(38367, 51424, 64481, 25310, 77538) c5(b, cV, Jh, f, q, j, cK, bm, jZ); #c1 (UBIAD1) c2(XP_011539606) c3(12254) c4(38368, 51425, 64482, 25311, 77539) c5(pk, A, qt, dD, B, dB, i, cO, fx, aOB, pR, cSB); #c1(UBL3) c2(NP_009037) c3(12255) c4(38369, 51426, 64483, 25312, 77540) c5(FG, yO); #c1 (UBL4A) c2(NP_055050) c3(12256) c4(38370, 51427, 64484, 25313, 77541) c5(avO, f, b, adL, agH, iC, UR, yz, byF, gB, agJ, ak, IW, Fh, qG, VX, eV, y, zP, it, bb, wp, nU, N, Lm, pP, xl, as, oD, aCr, byC, u, mz, Ps, qw, ae, c, an, zd, fO, dt, P, KK, BW, x, byK, qx, jG, pq, CY, nh, qt, byA, Ck, Le, cT, aU); #c1(UBL5) c2(NP_001041706) c3(12257) c4(38371, 51428, 64485, 25314, 77542) c5(b, aiW, jz, bci, ig, lv, iL, bf, y, jQ, h, eX, qF, jn, dQ, bgW, fy, u, qz, fO, P, aM, sE, ag, bk, aA, at); #c1(UBL7) c2(NP_001273669) c3(12258) c4(38372, 51429, 64486, 25315, 77543) c5(CM); #c1(UBLCP1) c2(NP_659486) c3(12259) c4(38373, 51430, 64487, 25316, 77544) c5(da, vY); #c1(UBN1) c2(NP_001072982) c3(12260) c4(38374, 51431, 64488, 25317, 77545) c5(bxW, ao); #c1(UBOX5) c2(NP_001254513) c3(12261) c4(38375, 51432, 64489, 25318, 77546) c5(LR); #c1(UBP1) c2(NP_001121632) c3(12262) c4(38376, 51433, 64490, 25319, 77547) c5(P, ix);

c1(UBQLN1) c2(NP_038466) c3(12263) c4(38377, 51434, 64491, 25320, 77548) c5(ao, si, k, bj, f, bp, fH, cGm, o, cV, ji, di, u, fJ, y); #c1(UBQLN2) c2(NP_038472) c3(12264) c4(38378, 51435, 64492, 25321, 77549) c5(ao, bS, PY, cSC, aj, ai, axZ); #c1(UBQLNL) c2(NP_659490) c3(12265) c4(38379, 51436, 64493, 25322, 77550) c5(b); #c1(UBR1) c2(NP_777576) c3(12266) c4(38380, 51437, 64494, 25323, 77551) c5(bn, aKy, b, nU, gm, cSD); #c1(UBR3) c2(NP_742067) c3(12267) c4(38381, 51438, 64495, 25324, 77552) c5(Wo, bb, aO, fh); #c1(UBR4) c2(XP_011539410) c3(12268) c4(38382, 51439, 64496, 25325, 77553) c5(aX, b, aaz, by, akB, bu); #c1(UBR5) c2(NP_001269802) c3(12269) c4(38383, 51440, 64497, 25326, 77554) c5(bUq, jT, b, X, agw, cnV, q, bu, cSy, aiL, iT, H, ct, T, av, by, u, re, y); #c1(UBR7) c2(NP_786924) c3(12270) c4(38384, 51441, 64498, 25327, 77555) c5(nU); #c1(UBTD2) c2(NP_689490) c3(12271) c4(38385, 51442, 64499, 25328, 77556) c5(at); #c1(UBTF) c2(NP_001070151) c3(12272) c4(38386, 51443, 64500, 25329, 77557) c5(aC, f, bm, g); #c1(UBXN1) c2(NP_001273006) c3(12273) c4(38387, 51444, 64501, 25330, 77558) c5(bu); #c1(UBXN2A) c2(NP_859064) c3(12274) c4(38388, 51445, 64502, 25331, 77559) c5(cs, ad); #c1(UBXN2B) c2(NP_001071087) c3(12275) c4(38389, 51446, 64503, 25332, 77560) c5(Pv); #c1(UBXN4) c2(NP_055422) c3(12276) c4(38390, 51447, 64504, 25333, 77561) c5(ba, f, o); #c1(UCHL1) c2(NP_004172) c3(12277) c4(38391, 51448, 64505, 25334, 77562) c5(WH, A, aw, Ob, X, F, dB, cSE, bg, tN, au, aDH, zK, bf, U, bu, hP, ey, y, d, jh, jl, co, rY, b, bj, ml, f, wN, q, es, az, gX, v, dQ, B, cB, YR, ik, av, fy, u, EX, cI, awC, si, V, I, cV, Be, bK, GS, is, LG, bp, gm, W, cSF, P, T, fO, GR, ar, bSf, nP, by, ac, aM, jT, iT, apB, e, XH, o, gR, aA, aX re, yh); #c1(UCHL3) c2(NP_005993) c3(12278) c4(38392, 51449, 64506, 25335, 77563) c5(bg, ar, v, iT); #c1(UCHL5) c2(NP_001186190) c3(12279) c4(38393, 51450, 64507, 25336, 77564) c5(jh, aw, b, ch, fO, jN, iT); #c1(UCK1) c2(NP_001129426) c3(12280) c4(38394, 51451, 64508, 25337, 77565) c5(cbr, n, nJ); #c1(UCK2) c2(NP_036606) c3(12281) c4(38395, 51452, 64509, 25338, 77566) c5(en, bb, V, ch, ck, di, U, jT, Lt, cp); #c1(UCKL1) c2(NP_001180308) c3(12282) c4(38396, 51453, 64510, 25339, 77567) c5(b); #c1(UCMA) c2(NP_660357) c3(12283) c4(38397, 51454, 64511, 25340, 77568) c5(B, b, X, dB, A, O, co, f, F, bu, ar, y, mm, fy, u, ff, fU, cV, aC, bp, by, jo, av, qp, zM, ag, hd); #c1(UCN2) c2(NP_149976) c3(12284) c4(38398, 51455, 64512, 25341, 77569) c5(BL, V, aai, aC, cO, U, cDU, eG, jU); #c1(UCN3) c2(NP_444277) c3(12285) c4(38399, 51456, 64513, 25342, 77570) c5(GD, aw, b, di, cA, aMI, bC, co, f, ar, fy, bU, aC, bp, W, Hq, T, aZ, aY, ih, fl, ji, aA, eG); #c1(UCN) c2(NP_003344) c3(12286) c4(38400, 51457, 64514, 25343, 77571) c5(f, b, bx, X, pR, dB, Kc, aFe, A, di, kY, Fr, cA, bf, O, axQ, e, cM, d, M, aX, Be, t, h, nU, q, fb, cy, cU, y, cs, av, fy, u, dh, aNN, bm, hW, aC, Bs, Bx, fO, W, G, fl, aox bt, pt, bb, iA, jT, jU, acU, aY, LQ, eQ, hT, ie, B, ih, yE, cT, dc, oM, aA, at, eG, ap); #c1(UCP1) c2(NP_068605) c3(12287) c4(38401, 51458, 64515, 25344, 77572) c5(dx B, b, dD, vD, eH, A, di, z, wf, bf, y, oy, dv, cO, f, aph, cs, fH, u, aE, em, I, du, cx ad, Fy, bTj, eX, jT, f J, ac, aM, rd, dS, MP, fD, aA, at, ib); #c1(UCP2) c2(NP_003346) c3(12288) c4(38402, 51459, 64516, 25345, 77573) c5(ek, dx, IJ, eX, iq, dN, hM, cO, bf, gO, dv, gC, rh, bbJ, tE, Hs, mz, aC, du, gm, x, bSt, fN, YA, we, bBy, fD, ch, bq, aA, bP, fl, vD, rd, hS, Hi, y, co, f, cs, em, dA, Bs, v, cx bQ, iA, dO, cf, vH, iu, ap, b, aF, j J, cSG, ey, aO, Ag, bb, kW, qu, u, dh, fh, da, kF, I, ad, qg, jH, ao, nV, aos, aE, di, A, kg, vZ, wf, m, aX, aV, xf, J, vF, T, gF, aM, ii, Af, at); #c1(UCP3) c2(NP_003347) c3(12289) c4(38403, 51460, 64517, 25346, 77574) c5(dx, A, mz, vD, jJ, aHB, rd, hM, cO, bf, ey, rh, f, dl, jm, ar, aE, o, em, fD, I, Bs, du, cx eX, bq, gF, aM, ao, at, ii, ch, MP, i, I, di, aA, aG, ap); #c1(UEVLD) c2(NP_001035787) c3(12290) c4(38404, 51461, 64518, 25347, 77575) c5(T); #c1(UFDIL) c2(NP_001030324) c3(12291) c4(38405, 51462, 64519, 25348, 77576) c5(ahi, cr, bwl, K, bFf, T, afb, cpt, xw, AP); #c1(UFL1) c2(NP_056138) c3(12292) c4(38406, 51463, 64520, 25349, 77577) c5(d, co, b, q, ar, ji, e); #c1(UFM1) c2(NP_001273633) c3(12293) c4(38407, 51464, 64521, 25350, 77578) c5(u, y); #c1(UGCG) c2(NP_003349) c3(12294) c4(38408, 51465, 64522, 25351, 77579) c5(fl, b, w, Vn, ba, y, f, q, cs, bzq, av, u, o, I, aC, J, fO, ad, aEY, aGI, aU, at, wz); #c1(UGDH) c2(NP_001171629) c3(12295) c4(38409, 51466, 64523, 25352, 77580) c5(bm, xL, pP, cf, dY, aWQ, gF, iu); #c1(UGGT1) c2(NP_064505) c3(12296) c4(38410, 51467, 64524, 25353, 77581) c5(d, it, hi, f, bqC, EN, e); #c1(UGGT2) c2(NP_064506) c3(12297) c4(38411, 51468, 64525, 25354, 77582) c5(d, bb, e, I); #c1(UGP2) c2(NP_006750) c3(12298) c4(38412, 51469, 64526, 25355, 77583) c5(h); #c1(UGTIA10) c2(NP_061948) c3(12299) c4(38413, 51470, 64527, 25356, 77584) c5(YM, d, it, en, V, b, bm, gG, bqC, dt, EN, T, et, U, u, e, y); #c1(UGTIA1) c2(NP_000454) c3(12300) c4(38414, 51471, 64528, 25357, 77585) c5(dx, en, aw, ain, dD, gG, dB, bV, cO, bf, bgC, VX, fx, gM, cU, Mx, t, e, gP, fH, jH, du, EC, bp, vc, x, qx, Wp, Yp, pq, jE, gt, U, bm, ag, bk, i, fN, bq, aA, GD, byz, X, hS, Fh, qG, cJI, y, f, bu, gX, B, cs, aYP, av, fy, pP, iT, qw, V, it, byJ, iA, fJ, YM, W, aH, ap, b, aE, cGZ, au, yU, tG, z, aoi, aO, d, jh, bb, q, vu, ar, ff, Km, u, fh, sz, I, ir, cSI, gL, ad, wM, rw, et, iw, mk, Ck, Bg, ah, aU, A, EN, vg, adT, al, iM, il, az, hN, ik, rR, PT, bnD, cSH, IG, J, dt, P, by, aM, aCC, fP, avx Oi, at); #c1(UGTIA3) c2(NP_061966) c3(12301) c4(38415, 51472, 64529, 25358, 77586) c5(YM, d, it, en, gB, bqC, dt, EN, byJ, et, adT, cJI, bm, e); #c1(UGTIA4) c2(NP_009051) c3(12302) c4(38416, 51473, 64530, 25359, 77587) c5(YM, d, Mx, en, it, bqC, dt, hS, EN, i, I, ct, bm, e); #c1(UGTIA5) c2(NP_061951) c3(12303) c4(38417, 51474, 64531, 25360, 77588) c5(d, EN, it, en, bqC, dt, e); #c1(UGTIA6) c2(NP_001063) c3(12304) c4(38418, 51475, 64532, 25361, 77589) c5(en, aw, b, EN, hS, U, e, y, d, tn, it, co, cy, q, akf, bqC, cs, bv, fH, av, u, V, iw, TK, dt, byJ, x, ct, fJ, YM, W, bm, e); #c1(UGTIA7) c2(NP_061950) c3(12305) c4(38419, 51476, 64533, 25362, 77590) c5(GD, en, b, EN, bn, iL, gE, O, bqC, hP, adT, gM, aDo, co, ip, gX, e, g, bu, zB, hN, fv, rR, cs, fy, bm, jZ, jH, d, V, im, ju, it, gv, dt, T, ll, byJ, fx, ad, iw, ag, i, bh); #c1(UGTIA8) c2(NP_061949) c3(12306) c4(38420, 51477, 64534, 25363, 77591) c5(gM iw, it, en, aw, V, il, jh, ps, gL, bgC, dt, EN, ik, i, bm, u, e, y, d); #c1(UGTIA9) c2(NP_066307) c3(12307) c4(38421, 51478, 64535, 25364, 77592) c5(en, b, EN, A, U, e, gM, it, g, bqC, vu, cs, fy, u, IG, d, V, IP, ad, dt, T, lo, x, hN, iw, aH, bm, i); #c1(UGT2A1) c2(NP_001239203) c3(12308) c4(38422, 51479, 64536, 25365, 77593) c5(b); #c1(UGT2A2) c2(NP_001099147) c3(12309) c4(38423, 51480, 64537, 25366, 77594) c5(b); #c1(UGT2A3) c2(NP_079019) c3(12310) c4(38424, 51481, 64538, 25367, 77595) c5(BX, ny, ip); #c1(UGT2B10) c2(NP_001066) c3(12311) c4(38425, 51482, 64539, 25368, 77596) c5(PT, aX, b); #c1(UGT2B11) c2(NP_001064) c3(12312) c4(38426, 51483, 64540, 25369, 77597) c5(u, Mr); #c1(UGT2B15) c2(NP_001067) c3(12313) c4(38427, 51484, 64541, 25370, 77598) c5(YM, bm, A, aw, V, b, cY, Mi, B, et, I, byJ, Oi, aX, U, cJI, u, y); #c1(UGT2B28) c2(NP_001193933) c3(12314) c4(38428, 51485, 64542, 25371, 77599) c5(U, V); #c1(UGT2B4) c2(NP_001284544)

c3(12315) c4(38429, 51486, 64543, 25372, 77600) c5(YM, jh, kF, il, q, jw, ik, Mr, et, aA, cJI, u, bT, y); #c1(UGT2B7) c2(NP_001065) c3(12316) c4(38430, 51487, 64544, 25373, 77601) c5(A, aw, b, cSJ, cY, hS, bf, cJI, fx, y, gM, hB, q, cU, ff, Wf, u, bm, V, im, jo, aUe, hE, byJ, et, iA, ac, YM, iw, jE, qt, iR, P, i, T, fD); #c1(UGT3A2) c2(NP_001161788) c3(12317) c4(38431, 51488, 64545, 25374, 77602) c5(BX, ny, ip); #c1(UGT8) c2(NP_001121646) c3(12318) c4(38432, 51489, 64546, 25375, 77603) c5(bn, b, eY, bV, bw, y, co, arl, ra, PK, tF, u, og, dA, kt, el, W, aX, qK, hS, py, gf, ag, re); #c1(UHMK1) c2(NP_001171692) c3(12319) c4(38433, 51490, 64547, 25376, 77604) c5(aiJ, u, t, h, ak, J, G, n, hD, afY, y); #c1(OHRFIBP1) c2(NP_060224) c3(12320) c4(38434, 51491, 64548, 25377, 77605) c5(m, u, y, b); #c1(UHRF1) c2(NP_001276980) c3(12321) c4(38435, 51492, 64549, 25378, 77606) c5(A, b, O, U, y, co, bb, yN, t, B, q, bu, ff, cs, aV, u, V, aSz, ad, gO, jo, fy, fx by, nV, fc, ie, G, i, rb); #c1(UHRF2) c2(NP_690856) c3(12322) c4(38436, 51493, 64550, 25379, 77607) c5(co, V, b, U, fy, u, y); #c1(UIMC1) c2(NP_057374) c3(12323) c4(38437, 51494, 64551, 25380, 77608) c5(fy, b, X, x, av, ho, u, y); #c1(ULBP1) c2(NP_079494) c3(12324) c4(38438, 51495, 64552, 25381, 77609) c5(jT, co, aw, b, hx f, F, q, eu, P, cs, J, ad, h); #c1(ULBP2) c2(NP_079493) c3(12325) c4(38439, 51496, 64553, 25382, 77610) c5(bb, b, f, eu, fO, J, ag, P, cs, aX, jG, bu); #c1(ULBP3) c2(NP_078794) c3(12326) c4(38440, 51497, 64554, 25383, 77611) c5(PI, jT, Wo); #c1(ULK1) c2(NP_003556) c3(12327) c4(38441, 51498, 64555, 25384, 77612) c5(jh, b, f, P, fP, y, fy, u, O); #c1(ULK2) c2(NP_001136082) c3(12328) c4(38442, 51499, 64556, 25385, 77613) c5(w, bj, O); #c1(ULK3) c2(NP_001092906) c3(12329) c4(38443, 51500, 64557, 25386, 77614) c5(jG, di); #c1(ULK4) c2(NP_060356) c3(12330) c4(38444, 51501, 64558, 25387, 77615) c5(oy, f, ak, fO, di, hT); #c1(UMOD) c2(NP_001008390) c3(12331) c4(38445, 51502, 64559, 25388, 77616) c5(bP, cgS, td, mi, nX, bKz, zz, bKw, di, dx, iC, bf, cSL, gO, qs, dv, f, bKv, bKy, IY, vo, cp, u, aE, aAU, ob, du, gJ, bln, P, wt, et, aM, cSK, aVR, ch, vU, ih, fD, ap); #c1(UMODL1) c2(NP_001004416) c3(12332) c4(38446, 51503, 64560, 25389, 77617) c5(Bu); #c1(UMPS) c2(NP_000364) c3(12333) c4(38447, 51504, 64561, 25390, 77618) c5(A, aw, b, u, bw, U, VX, e, d, it, co, awA, awz, q, bu, gX, hN, ar, aJ, fy, pP, V, ae, T, x, iw, qt, ch, cnn, Da); #c1(UNC119) c2(NP_005139) c3(12334) c4(38448, 51505, 64562, 25391, 77619) c5(nQ, ml, ard, nW, aZ, aJj); #c1(UNC13A) c2(NP_001073890) c3(12335) c4(38449, 51506, 64563, 25392, 77620) c5(Vr, ao, ey, hS); #c1(UNCl3B) c2(NP_006368) c3(12336) c4(38450, 51507, 64564, 25393, 77621) c5(pS, et, ey, bj, aE, any); #c1(UNC13C) c2(NP_001074003) c3(12337) c4(38451, 51508, 64565, 25394, 77622) c5(oy, dA, cO, bj, ac, ap); #c1(UNCl3D) c2(NP_954712) c3(12338) c4(38452, 51509, 64566, 25395, 77623) c5(iw, jE, ax, b, cSM, u, bxO, be, ne, bm, hN, pS, iv, zQ, Bz, bQf, y, dH); #c1(UNC45A) c2(NP_001034764) c3(12339) c4(38453, 51510, 64567, 25396, 77624) c5(T, u, y, cV); #c1(UNC45B) c2(NP_001253981) c3(12340) c4(38454, 51511, 64568, 25397, 77625) c5(cK, hR, f, AP); #c1(UNC5A) c2(NP_588610) c3(12341) c4(38455, 51512, 64569, 25398, 77626) c5(fx, i); #c1(UNC5B) c2(NP_001231818) c3(12342) c4(38456, 51513, 64570, 25399, 77627) c5(dx du, aw, V, b, aC, f, dB, jR, jo, dv, B, i, U, fx); #c1(UNC5C) c2(NP_003719) c3(12343) c4(38457, 51514, 64571, 25400, 77628) c5(hh, by, aX, V, b, aC, cs, dB, bu, jo, T, Qt, bq, U, ad, bj, aA); #c1(UNC5D) c2(NP_543148) c3(12344) c4(38458, 51515, 64572, 25401, 77629) c5(dB, jo, T, ff, cV); #c1(UNC79) c2(NP_065869) c3(12345) c4(38459, 51516, 64573, 25402, 77630) c5(oy); #c1(UNC93A) c2(NP_001137419) c3(12346) c4(38460, 51517, 64574, 25403, 77631) c5(X); #c1(UNC93B1) c2(NP_112192) c3(12347) c4(38461, 51518, 64575, 25404, 77632) c5(hZ, xT, cSN, yN, fl); #c1(UNG) c2(NP_003353) c3(12348) c4(38462, 51519, 64576, 25405, 77633) c5(f, zr, b, eu, w, U, A, e, d, co, bb, pp, t, h, B, cs, iv, zQ, V, ht, v, J, CM, P, ad, jG, jT, aeq, G, Ot, cSO, i, fl, fj); #c1(UPB1) c2(NP_057411) c3(12349) c4(38463, 51520, 64577, 25406, 77634) c5(em, cSP, cz, dl, cO); #c1(UPF1) c2(NP_002902) c3(12350) c4(38464, 51521, 64578, 25407, 77635) c5(A, V, b, B, bu, T, cSQ, cq); #c1(UPF2) c2(NP_542166) c3(12351) c4(38465, 51522, 64579, 25408, 77636) c5(ao, nU, A, V); #c1(UPF3A) c2(NP_075387) c3(12352) c4(38466, 51523, 64580, 25409, 77637) c5(ao); #c1(UPF3B) c2(NP_075386) c3(12353) c4(38467, 51524, 64581, 25410, 77638) c5(nz, nU, cz, bKF, QZ, cSR); #c1(UPKIA) c2(NP_001268372) c3(12354) c4(38468, 51525, 64582, 25411, 77639) c5(jh, b, by, sV, bu, iR, JY); #c1(UPKIB) c2(NP_008883) c3(12355) c4(38469, 51526, 64583, 25412, 77640) c5(iR, fx, T, b, eo); #c1(UPK2) c2(NP_006751) c3(12356) c4(38470, 51527, 64584, 25413, 77641) c5(d, E, b, e, i, fx, iR, aJU); #c1(UPK3A) c2(NP_001161046) c3(12357) c4(38471, 51528, 64585, 25414, 77642) c5(aw, IY, i, sV, iR, ac, Jd); #c1(UPP1) c2(NP_001274355) c3(12358) c4(38472, 51529, 64586, 25415, 77643) c5(V, b, X, J, T, JF, gj, sR, av, u, U, y); #c1(UPP2) c2(NP_001128570) c3(12359) c4(38473, 51530, 64587, 25416, 77644) c5(d, b, Wk, cz, iR, e); #c1(UPRT) c2(NP_659489) c3(12360) c4(38474, 51531, 64588, 25417, 77645) c5(V, b, X, ch, Dg, F, J, ad, ag, cs, av, U, O); #c1(UQCC1) c2(NP_001171906) c3(12361) c4(38475, 51532, 64589, 25418, 77646) c5(agm); #c1(UQCC2) c2(NP_115716) c3(12362) c4(38476, 51533, 64590, 25419, 77647) c5(aqm, kZ, m); #c1(UQCRB) c2(NP_006285) c3(12363) c4(38477, 51534, 64591, 25420, 77648) c5(aqm, A, aqj, SS, cf); #c1(UQCRC1) c2(NP_003356) c3(12364) c4(38478, 51535, 64592, 25421, 77649) c5(X); #c1(UQCRC2) c2(NP_003357) c3(12365) c4(38479, 51536, 64593, 25422, 77650) c5(cSS, do, aA); #c1(OQCRFS1) c2(NP_005994) c3(12366) c4(38480, 51537, 64594, 25423, 77651) c5(A, fs, V, b, nF, f, F, w, T, y, fy, av, at, u, U, aW); #c1(UQCRQ) c2(NP_055217) c3(12367) c4(38481, 51538, 64595, 25424, 77652) c5(aqm, cST, agj, SS, cf); #c1(URB2) c2(XP_005273417) c3(12368) c4(38482, 51539, 64596, 25425, 77653) c5(oy); #c1(URGCP) c2(NP_001071131) c3(12369) c4(38483, 51540, 64597, 25426, 77654) c5(cV, fr, q, ft, iL, bu); #c1(URI1) c2(NP_001239570) c3(12370) c4(38484, 51541, 64598, 25427, 77655) c5(bDM, g, bDN, cy, qd, X, q, iU, aC, OC, dZ, T, dV, iL, fH, av, fJ, oP); #c1(URM1) c2(NP_001129419) c3(12371) c4(38485, 51542, 64599, 25428, 77656) c5(bu); #c1(UR0C1) c2(NP_001159446) c3(12372) c4(38486, 51543, 64600, 25429, 77657) c5(cSV, nU, cSO); #c1(UROD) c2(XP_011540382) c3(12373) c4(38487, 51544, 64601, 25430, 77658) c5(gE, b, nF, aF, Rl, wy, mk, C, z, cSW, cM, yK, jn, bbl, Me, aHH, hue, NK, fM, aCv, nB, Nf, gT, em, jB, cSY, yO, cz, dt, Rk, ip, mF, bsu, cSX, rQ, aci, OR, aY, aCt, cTa, cSZ, Lo, agw, rv, dc); #c1(UR0S) c2(NP_000366) c3(12374) c4(38488, 51545, 64602, 25431, 77659) c5(KC, em, nF, dt, ni, aO, cTb); #c1(USB1) c2(NP_001182231) c3(12375) c4(38489, 51546, 64603, 25432, 77660) c5(iw, ast, mk, aVH, ss, hN); #c1(USE1) c2(NP_060937) c3(12376) c4(38490, 51547, 64604, 25433, 77661) c5(da, b, X, iP, hn, fO, hv, ih, acF, iL, av, jT, u, y); #c1(USF1) c2(NP_001263302) c3(12377) c4(38491, 51548, 64605, 25434, 77662) c5(dx, f, b, eR, aN, eH, eO, bf, ey, y, m, dv, hV, Zl, ar, cs, ev, fy, u, o, Tl, I, du, bp, ad, ME, KK, T, eX, et, aM, nV, dS, Fy, xX, aA, at, kD, ap); #c1(USF2) c2(NP_003358) c3(12378) c4(38492, 51549, 64606, 25435, 77663) c5(A, aw, aoW, b, sE, U, e, y, V, d, f, q, ar, B, aJ, hV, EG, u, o, n, fU, hb, KK, T, et, jG, nV, bm, gR, aFB, eG); #c1(USH1C) c2(NP_001284693) c3(12379) c4(38493, 51550, 64607, 25436, 77664) c5(cTc, nQ, na, ml, cs, bCN, ad, mw, ow, Bx, cTd, alE, U, nE); #c1(USH1G) c2(NP_775748) c3(12380) c4(38494, 51551, 64608, 25437, 77665) c5(nQ, aY, ml, dc, eu, XM, ow, bdw, alE, jv, coD, cM); #c1(USH2A) c2(NP_009054) c3(12381) c4(38495, 51552, 64609, 25438, 77666) c5(A, nQ, cpN, cTe, ow, dt, na, xY, rQ, nW, Gg, nE, alE, Nx, ml); #c1(USO1) c2(NP_001276978) c3(12382) c4(38496, 51553, 64610, 25439, 77667) c5(A, aw, b, ka, gE, iU, mk, sJ, bvB, iL, eO, al, cp, m, co, aX, kH, fq, re, f, F, bu, Li, aV, aE, ri, da, ax Pz, ez, il, im, aC, sX, nl, dB, bvC, bp, by, P, aem, T, ll, aZ, pi, dH, jH, ig, bvx, eQ, ix, iT, xX, fl); #c1(USP10) c2(NP_005144) c3(12383) c4(38497, 51554, 64611, 25440, 77668) c5(w, f, ll, ad); #c1(USP11) c2(NP_004642) c3(12384) c4(38498, 51555, 64612, 25441, 77669) c5(pk, kJ, nW, nU, ag, pt, oM, ml); #c1(USP12) c2(NP_872294) c3(12385) c4(38499, 51556, 64613, 25442, 77670) c5(jH); #c1(USP13) c2(NP_003931) c3(12386) c4(38500, 51557, 64614, 25443, 77671) c5(mk, aX, Pz, y, u); #c1(USP14) c2(NP_001032411) c3(12387) c4(38501, 51558, 64615, 25444, 77672) c5(bn, b, k, AA, fl, co, arl, jF, ar, cV, aC, bK, fO, T, bp, Kv, aJT, et, qK, jH, azy, aT); #c1(USP15) c2(NP_001239007) c3(12388) c4(38502, 51559, 64616, 25445, 77673) c5(b, X, ag, w, fP, rp, av, pi, O); #c1(USP7L2) c2(NP_958804) c3(12389) c4(38503, 51560, 64617, 25446, 77674) c5(m, f, u, b); #c1(USP17L30) c2(NP_001243796) c3(12390) c4(38504, 51561, 64618, 25447, 77675) c5(m, b); #c1(USP18) c2(NP_059110) c3(12391) c4(38505, 51562, 64619, 25448, 77676) c5(co, BL, b, fc, fN, f, aE, fe, ll, gE, aZA, al, aV, dL, yW); #c1(USP20) c2(XP_005251722) c3(12392) c4(38506, 51563, 64620, 25449, 77677) c5(bb); #c1(USP22) c2(NP_056091) c3(12393) c4(38507, 51564, 64621, 25450, 77678) c5(og, V, b, re, cs, J, ad, W, T, rb, cO, U, fy, iT); #c1(USP25) c2(NP_001269970) c3(12394) c4(38508, 51565, 64622, 25451, 77679) c5(wX, fy, aq, fP, bp); #c1(USP26) c2(NP_114113) c3(12395) c4(38509, 51566, 64623, 25452, 77680) c5(aMC, US, NT, am, Ke, UW, wn); #c1(USP28) c2(NP_065937) c3(12396) c4(38510, 51567, 64624, 25453, 77681) c5(aw, V, b, LI, nJ, T, i, U, u, fx, y); #c1(USP2) c2(NP_001230688) c3(12397) c4(38511, 51568, 64625, 25454, 77682) c5(wn, A, I, q, b); #c1(USP32) c2(NP_115971) c3(12398) c4(38512, 51569, 64626, 25455, 77683) c5(f, u, ll, y, ad); #c1(USP33) c2(XP_011539358) c3(12399) c4(38513, 51570, 64627, 25456, 77684) c5(t, G); #c1(USP36) c2(XP_005257599) c3(12400) c4(38514, 51571, 64628, 25457, 77685) c5(X, av, bj); #c1(USP37) c2(XP_005246779) c3(12401) c4(38515, 51572, 64629, 25458, 77686) c5(bb, jV, jR); #c1(USP3) c2(NP_001243631) c3(12402) c4(38516, 51573, 64630, 25459, 77687) c5(c0); #c1(USP40) c2(NP_060688) c3(12403) c4(38517, 51574, 64631, 25460, 77688) c5(bj, GR); #c1(USP42) c2(NP_115548) c3(12404) c4(38518, 51575, 64632, 25461, 77689) c5(h, J, b); #c1(USP43) c2(NP_001254505) c3(12405) c4(38519, 51576, 64633, 25462, 77690) c5(Eo, dA); #c1(USP44) c2(NP_001265322) c3(12406) c4(38520, 51577, 64634, 25463, 77691) c5(co, b); #c1(USP46) c2(NP_001127695) c3(12407) c4(38521, 51578, 64635, 25464, 77692) c5(V, ak, ad, cs, U, aqD); #c1(USP48) c2(XP_011540564) c3(12408) c4(38522, 51579, 64636, 25465, 77693) c5(xq); #c1(USP49) c2(NP_001273483) c3(12409) c4(38523, 51580, 64637, 25466, 77694) c5(bb); #c1(USP4) c2(NP_001238806) c3(12410) c4(38524, 51581, 64638, 25467, 77695) c5(f0, b, F, q, T, u, y); #c1(USP5) c2(NP_001092006) c3(12411) c4(38525, 51582, 64639, 25468, 77696) c5(yp, w, aq, hn); #c1(USP6) c2(NP_001291213) c3(12412) c4(38526, 51583, 64640, 25469, 77697) c5(aw, b, adh, Cc, azo, asj, zK, u, yw, y); #c1(USP6NL) c2(NP_001073960) c3(12413) c4(38527, 51584, 64641, 25470, 77698) c5(aX); #c1(USP7) c2(NP_001273386) c3(12414) c4(38528, 51585, 64642, 25471, 77699) c5(A, b, cO, Lq, e, y, cfh, d, re, f, ar, B, Lf, cs, fy, u, cV, lb, fl, J, fO, ad, T, bq, aUt, od); #c1(USP8) c2(NP_001122082) c3(12415) c4(38529, 51586, 64643, 25472, 77700) c5(fy, w, OS, co, OW); #c1(USP9X) c2(NP_001034679) c3(12416) c4(38530, 51587, 64644, 25473, 77701) c5(er, wp, V, b, kJ, u, nU, Zl, q, fO, gm, ag, mR, cK, U, cTf, aK, jw, y); #c1(USP9Y) c2(XP_011529771) c3(12417) c4(38531, 51588, 64645, 25474, 77702) c5(wn, NT, at, cyJ, am); #c1(USPL1) c2(NP_005791) c3(12418) c4(38532, 51589, 64646, 25475, 77703) c5(u, y); #c1(UST) c2(NP_005706) c3(12419) c4(38533, 51590, 64647, 25476, 77704) c5(oy, bq, at, eG); #c1(UTF1) c2(NP_003568) c3(12420) c4(38534, 51591, 64648, 25477, 77705) c5(wV, cV, re, wy, wP, Lo, sf, T, fp, iT); #c1(UTP14A) c2(NP_001159693) c3(12421) c4(38535, 51592, 64649, 25478, 77706) c5(f); #c1(UTP14C) c2(NP_067677) c3(12422) c4(38536, 51593, 64650, 25479, 77707) c5(am); #c1(UTP20) c2(NP_055318) c3(12423) c4(38537, 51594, 64651, 25480, 77708) c5(dx, du, u, ac); #c1(UTRN) c2(NP_009055) c3(12424) c4(38538, 51595, 64652, 25481, 77709) c5(Rx, X, xQ, di, ey, bj, y, c, f, bgt, xl, oD, u, dh, cc, wK, v, Oc, IX, cK, IR, ao, dY, Le, IS, Au, iB); #c1(UTS2B) c2(NP_937795) c3(12425) c4(38539, 51596, 64653, 25482, 77710) c5(dx vr, du, mA, IW, bq, at, o); #c1(UTS2) c2(XP_011538839) c3(12426) c4(38540, 51597, 64654, 25483, 77711) c5(bP, dx, tu, b, IW, ix, di, cO, bf, U, sx aqQ, qs, dv, cy, dN, eX, PR, sM, cl, cs, Tv, dh, mz, jj, V, I, cV, vN, Bs, sH, du, gJ, j, ad, W, Hq, cd, bq, cK, et, Fw, aM, dS, xM, eQ, Ic, mA, fD, aC, bh, aA, at, eG, ap); #c1(UTS2R) c2(NP_061822) c3(12427) c4(38541, 51598, 64655, 25484, 77712) c5(dx, by, en, Ir, iD, dN, aeB, iD, aE, ns, nm, nt, ng, nr, nn, rV, bf, no, np, iw, hM, az, bQ, cy, b, t, AX aDx, cU, bbJ, sM, sL, zb, fw, nB, kX, pq, bk, gl, aoh, g, Ew, ng, aqQ, HX, aC, nl, ft, du, yD, gm, fO, Yl, fl, Gl, x, fx fp, mO, dH, pb, wh, tR, qt, aai, Ey, aaz, bm, qN, K, we, iV, cT, w, pv, bpS, aM, cB, btv, aA, jl, cl, bV, bP, id, zr, P, cG, nF, bKn, i, oH, MY, ix, bZ, sF, wX, si, ai, A, cM, V, rF, yE, Wn, ml, f, md, agm, bu, gX, B, cs, Ch, av, CX, pP, iT, dX, aEq, ajs, yV, ae, jh, bx, Bs, nl, v, kp, byO, Ey, dv, eX, bq, Fr, iA, hw, W, aH, sK, aJc, aaf, TP, bwP, dY, ape, cz, gO, fK, ji, jP, iu, ap, hV, am, GL, aF, ak, eR, AA, wn, m, au, aVb, z, aoi, zf, aO, alb, eE, biX, bb, axK, fy, aga, re, nU, q, ND, X, vu, ar, RF, qu, jG, ctJ, u, nj, o, ff, sQ, jE, I, kt, el, fz, ad, aD, CZ, aUJ, aAB, et, kS, jU, cW, rd, ao, KK, Xl, mk, fD, ch, tW, py, he, Qx, cd, MR, Bm, amb, HV, R, cK, C, lb, aBt, mz, fr, zF, gE, xj, mW, bci, O, di, s, iL, bw, wf, fs, al, jR, bj, U, aW, LQ, RX, qs, Wj, aX, aCU, sG, fq, F, yx, do, bxW, hN, y, cEy, bK, hS, jZ, jH, aAU, oJ, Ps, ax, hW, ez, apx cV, dB, J, fl, dt, jo, co, ll, aj, cr, mQ, azo, qe, bgD, et, eG, bNr, G, bIT, fP, al at, bpe); #c1(UTY) c2(NP_001245181) c3(12428) c4(38542, 51599, 64656, 25485, 77713) c5(at); #c1(UVRAG) c2(NP_003360) c3(12429) c4(38543, 51600, 64657, 25486, 77714) c5(jp, akQ, DP, aw, aPi, Ty, Ir, adr, e, aPh, arV, cy, yh, arS, aPf, fe, gm, aOZ, ft, bmh, aiL, fx, aPg, aPj, aPc, ag, i, Dr, X, atd, Ak, mk, kY, U, y, atj, f, bu, B, cs, av, fy, aEs, iT, V, bt, arl, Mp, tl, ck, b, d, zJ, re, hV, ar, u, da, il, LR, by, sf, aPe, nV, aPh, kM, Ns, aOY, yA, A, fr, Lv, FL, Nq, zK, MT, aX, F, ik, rR, qB, fU, Be, QV, aPa, dt, Po, co, T, aPd, ad, AP, qp, avB, amS, Ez, rb); #c1(UVSSA) c2(XP_011511824) c3(12430) c4(38544, 51601, 64658, 25487, 77715) c5(Lq, bnM, Lf, cTg); #c1(UXS1) c2(NP_001240804) c3(12431) c4(38545, 51602, 64659, 25488, 77716) c5(bb, AP, bph); #c1(UXT) c2(NP_004173) c3(12432) c4(38546, 51603, 64660, 25489, 77717) c5(dE, A, B, b); #c1(VACI4) c2(NP_060522) c3(12433) c4(38547, 51604, 64661, 25490, 77718) c5(P, cG, q, lv); #c1(VAMP1) c2(NP_001284367) c3(12434) c4(38548, 51605, 64662, 25491, 77719) c5(W, bK, GN, YR); #c1(VAMP2) c2(NP_055047) c3(12435) c4(38549, 51606, 64663, 25492, 77720) c5(ak, b, I, nU, hS, GN, o, kE); #c1(VAMP4) c2(NP_001172056) c3(12436) c4(38550, 51607, 64664, 25493, 77721) c5(bf, I, aM); #c1(VAMP7) c2(NP_001138621) c3(12437) c4(38551, 51608, 64665, 25494, 77722) c5(dj, Zv, kE, b, ak, F, ns, nm, nt, ng, nr, nn, O, no, np, u, y); #c1(VAMP8) c2(NP_003752) c3(12438) c4(38552, 51609, 64666, 25495, 77723) c5(dx, fl, b, fr, dB, Ag, dv, bb, pp, fh, du, ft, jo, T, gF, hR, et, we, Af, bq, at, ap); #c1(VANGL2) c2(NP_065068) c3(12439) c4(38553, 51610, 64667, 25496, 77724) c5(pk, aX, V, b, Bt, IJ, bu, mx, U, by, jG); #c1(VAPA) c2(NP_003565) c3(12440) c4(38554, 51611, 64668, 25497, 77725) c5(ae, bb, yQ, dA, ak, vu, aM); #c1(VAPB) c2(NP_001182606) c3(12441) c4(38555, 51612, 64669, 25498, 77726) c5(ao, cTh, cTi, PY, v, cTj, kz, HS, DA, u); #c1(VARS2) c2(NP_001161205) c3(12442) c4(38556, 51613, 64670, 25499, 77727) c5(m, ix, Bm, kW); #c1(VARS) c2(NP_006286) c3(12443) c4(38557, 51614, 64671, 25500, 77728) c5(m, kW); #c1(VASH1) c2(NP_055724) c3(12444) c4(38558, 51615, 64672, 25501, 77729) c5(vr, I, ml, Eu, V, b, qL, fE, f, gv, ag, T, bh, bf, U, at, u, aA, aM); #c1(VASH2) c2(NP_001129946) c3(12445) c4(38559, 51616, 64673, 25502, 77730) c5(jE, b, X, q, jf, av, bm); #c1(VASP) c2(NP_003361) c3(12446) c4(38560, 51617, 64674, 25503, 77731) c5(BO, SA, b, ed, f, bu, mR, bt, ey, by, u, y, ap); #c1(VAT1) c2(NP_006364) c3(12447) c4(38561, 51618, 64675, 25504, 77732) c5(fB, w, u, O, y); #c1(VATIL) c2(NP_065978) c3(12448) c4(38562, 51619, 64676, 25505, 77733) c5(bb, hW); #c1(VAV1) c2(NP_001245136) c3(12449) c4(38563, 51620, 64677, 25506, 77734) c5(WH, b, eu, pD, bw, bu, y, co, aX, js, kJ, t, h, f, q, jV, gT, ar, Dc, u, aE, cV, J, gm, aiL, by, VQ, jR, ag, cT, fg, eG); #c1(VAV2) c2(NP_001127870) c3(12450) c4(38564, 51621, 64678, 25507, 77735) c5(d, 80, ez, sr, X, f, gr, aV, u, e, y); #c1(VAV3) c2(XP_011538805) c3(12451) c4(38565, 51622, 64679, 25508, 77736) c5(fl, A, aw, ez, b, er, gm, qr, bu, w, hM, B, di, fT, by, u, y, sr); #c1(VAX1) c2(NP_001106175) c3(12452) c4(38566, 51623, 64680, 25509, 77737) c5(d, aw, bvY, e, ar, i, cTk, apU, kD, fx); #c1(VAX2) c2(NP_036608) c3(12453) c4(38567, 51624, 64681, 25510, 77738) c5(uH); #c1(VBP1) c2(NP_001290472) c3(12454) c4(38568, 51625, 64682, 25511, 77739) c5(VP, pR, N, dB, P); #c1(VCAN) c2(NP_001119808) c3(12455) c4(38569, 51626, 64683, 25512, 77740) c5(dx, bL, fr, A, 10, rD, b, qd, LD, dB, O, kB, sF, iL, Fr, bW, U, fx, y, gO, cU, dv, aX, jd, re, f, q, bu, dl, X, k, B, a J, iT, i J, av, u, fY, oJ, g, ma, V, C, adh, sH, du, jE, cd, ft, aRx fO, Im, cy, iA, by, et, fM, jH, wh, rK, bm, Ic, tO, vK, pZ, i, bq, T, yA, eG, rb, ic); #c1(VCL) c2(NP_003364) c3(12456) c4(38570, 51627, 64684, 25513, 77741) c5(dx, B, b, oa, dB, A, xl, O, cp, BO, dv, f, mR, cTm, QM, du, cTI, bp, BV, co, T, cK, sK, qp, in, aGo); #c1(VCP) c2(NP_009057) c3(12457) c4(38571, 51628, 64685, 25514, 77742) c5(xJ, aw, bS, b, fr, Lv, EM, alV, AA, A, chG, bOZ, bZ, ai, xw, bj, cTn, y, jh, uT, il, bEj, ag, oB, f, amg, q, ayd, iT, bxW, Vr, bdT, mg, B, KL, bK, oD, av, fy, u, dh, o, cc, WG, si, nQ, nl, v, bN, dt, T, aj, aX, J, by, OA, DE, ao, bhy, alt, ck, PY, zM, gd, cH, bk, amb, ajg, cK, re, DG); #c1(VCX2) c2(NP_057462) c3(12458) c4(38572, 51629, 64686, 25515, 77743) c5(nU, iE, bty); #c1(VCX3A) c2(NP_057463) c3(12459) c4(38573, 51630, 64687, 25516, 77744) c5(nz, nU, KD, iE, bty); #c1(VCX3B) c2(NP_001001888) c3(12460) c4(38574, 51631, 64688, 25517, 77745) c5(n0, iE, bty); #c1(VCX) c2(NP_038480) c3(12461) c4(38575, 51632, 64689, 25518, 77746) c5(oy, nU, iE, bty); #c1(VCY) c2(NP_004670) c3(12462) c4(38576, 51633, 64690, 25519, 77747) c5(n0, iE, bty); #c1(VDAC1) c2(XP_005272132) c3(12463) c4(38577, 51634, 64691, 25520, 77748) c5(aNN, ao, fy, aw, dg, b, cV, Qk, f, fO, hS, do, T, o, aBz, fP, aV, u, y); #c1(VDAC2) c2(NP_001171712) c3(12464) c4(38578, 51635, 64692, 25521, 77749) c5(d, Al, co, aX, jd, avN, gm, hS, P, kz, IW, bf, aM, u, e, y, gT); #c1(VDR) c2(NP_000367) c3(12465) c4(38579, 51636, 64693, 25522, 77750) c5(dx, B, pV, Gm, Zy, sE, iU, aE, Ka, HC, sJ, bcf, aEK, aaV, e, O, cp, bQ, cy, iR, t, aDx dl, iZ, jU, ia, pq, gl, TP, gG, aeM, aC, Ls, du, gm, tz, gY, asH, od, x, mm, dH, wh, abv, aZg, rS, bm, Qk, Dz, bY, rJ, cT, pH, i, bq, arz, wz, bT, dB, BP, cC, td, a AY, X, DO, aFy, mk, NH, xZ, bf, bw, rH, Oh, y, bee, tp, co, ip, f, v, Mp, cs, av, fy, pP, Bm, yJ, bZ, o, vR, yV, ae, jh, nl, cx gv, bsW, fq, eX, ny, aA, bcg, nb, iz, jo, vl, aAW, ji, qB, bX, ap, aFI, aDX, b, bcc, aE, jL, BX, A, yU, ic, z, gZ, jD, d, Ag, bb, Iz, jF, azo, hV, q, jV, fr, jm, dQ, ff, aRY, bos, ar, bcd, rX, ri, fh, da, kF, aJ, I, afW, Dg, gL, ad, gO, aZ, Nh, sN, et, JH, yG, P, jH, ao, nV, ig, fD, u, azr, kM, Ck, ex, gd, aFi, arA, I, D, yA, wR, bOo, rC, azt, Ic, sD, aoG, gE, tx, mW, bci, di, ajv, iL, iC, wf, Pl, al, xe, bj, U, AD, oy, m, V, IE, aX, wp, aQk, rG, h, qL, fo, ik, Pm, afp, PT, aV, jZ, aFc, ax, tl, W, YR, be, Dw, J, arx, dt, bR, axl, ti, T, bp, Oi, aDA, jl, ya, Ap, acx aM, QK, ii, NG, iu, amL, hg, aCO, zM, Dl, fP, cgE, bh, at, eG, amK); #c1(VEGFA) c2(NP_001020537) c3(12466) c4(38580, 51637, 64694, 25523, 77751) c5(ml, bOa, bPf, wS, dD, Vz, vB, Ip, hM, baB, pz, ra, vr, aDo, kJ, e, nv, nZ, dl, Hj, anY, byn, cl, cTA, EM, mz, Sk, aee, aC, ft, Wm, Wp, vG, kl, pq, jE, bm, DO, tO, ag, bk, fD, bq, aA, Dr, VK, X, EB, vD, eu, Bd, dV, iG, GV, bw, vl, Oh, FA, cM, wB, ps, Dq, hg, N, cTw, Mp, av, fy, fY, is, fi, vR, V, nl, cd, IR, cTt, aJV, uu, jC, J, f J, xd, pk, dy, rK, aY, bdH, bcK, HB, Cy, gR, ar, ap, ck, acA, Hr, boE, hh, jh, qH, bzX, fv, aJ, Km, mR, dh, da, fs, il, oK, gL, ad, xk, aHG, aeC, Jl, an, nV, acw, agb, fg, xf, yA, bxm, af, BK, Iv, QU, rj, fr, pR, In, gN, iH, jc, fe, wh, iL, gE, nT, jQ, RX, xT, cr, aDQ, Lh, Cz, ans, p, bQc, HP, ajG, tP, m, YR, me, dB, bd, cTu, jo, zX, bit, VF, Jh, Ic, aGt, fP, E, hz, gl, dx dM, ud, cTs, ctB, HG, eH, qP, hC, vp, oU, O, RR, cU, bQ, aAo, azb, AX, FN, cTr, jM, oN, oJ, Ad, aeM, VA, du, gm, bp, Kw, x, Yp, su, aOo, tc, qt, a KB, dS, fc, mE, adr, sN, mx, sU, bP, wa, fl, cTB, bS, He, afY, iP, mk, ix Ku, kY, biQ, Iw, U, co, Qc, f, bsY, bu, dZ, cvJ, fB, EX, be, aog, bku, Bs, gv, YS, ny, ww, bvV, aH, beQ, anG, cTq, QG, SR, bkU, pv, cTz, oi, z, wJ, BQ, d, bmx, bb, eA, jd, vj, q, zx IY, mL, ff, hV, iR, amO, fh, kF, Kx, VD, ov, LR, rw, aZ, et, Ut, jU, jH, Eu, ch, Cr, gd, o, fl, Xm, sF, Tq, qd, asi, fw, bVA, pw, HS, JC, al, VJ, aW, LI, abf, bn, jk, aWi, qL, cB, aq, cTD, ax, nQ, tp, sj, aZG, Fs, gV, dU, T, ll, Bb, js, hg, Oi, rb, gj, wg, gf, eX, aw, iD, dN, cnY, jt, DT, eW, ki, aoL, eD, azO, iy, Vx, aOx, aD, fH, yg, oP, g, ha, bK, yL, Dt, po, fO, bta, vc, cTy, fx, hR, OA, bvH, aDb, M, CB, baC, BX, cT, xb, dX, bmX, yC, aDf, wK, cY, jz, awm, kB, bf, ai, xU, uD, bSo, pp, ml, B, blN, gX, k, iv, bv, gg, iT, yJ, azd, rN, yg, v, Qz, aR, bt, Fr, cTv, JY, bun, QS, cf, nJ, vH, dr, bxn, iu, uy, aGU, b, zH, aF, jL, in, tG, axg, iA, Mr, Ne, aiT, aga, re, aUU, bMh, OC, vu, Nf, bVz, cTC, sh, sz, if, cz, IX, Fo, Mw, et, PL, hU, DR, bxG, bry, IS, acE, ID, adW, gw, og, ds, aGA, vg, iC, wf, xe, Ct, jx bNQ, LS, Qm, sG, hP, va, akl, avu, tF, iZ, ik, aKE, sV, PT, Yb, aHA, Be, bte, bks, W, QI, ji, jl, nP, fM, aM, bpG, agl, Y, atJ, cgD, Yv, Ez, at, eG, gK, bx, gG, aE, eC, sJ, w, tH, bV, cO, aTd, gO, QJ, dv, cy, t, Si, cTp, do, Dc, R, Ls, sH, Ij, od, Jj, PZ, bvG, jT, dL, dH, ata, xO, hQ, dk, fN, Qk, K, we, yE, i, dc, beO, id, td, Zx, wy, Kc, cTo, os, IW, VG, Co, y, jh, cJH, VO, ave, ip, UV, cTx, cs, kN, JD, aOS, uO, iF, jB, sB, fz, aZG, ok, Gu, Tn, Xr, WM, VP, cK, pi, aDY, aaa, py, er, PY, jR, add, Be, TQ, qO, aDX, uS, QB, anb, DC, QF, yU, ic, FG, axq, ey, gF, aO, Fp, bX, jV, es, pn, dQ, ac, VM, jG, u, PJ, bU, tg, I, qC, by, BZ, wM, G, Ca, lo, vw, Jd, eQ, Bu, Du, uH, ue, Cv, dn, I, jq, bL, A, bC, UA, HJ, bvQ, cA, BY, di, sx, bkC, MT, aX, fq, h, xJ, F, aoY, n, aV, HI, fU, cV, KN, GB, P, j, aj, BL, blj, pF, qe, bVx, rM, arD, qp, aAx, vS, qs, XH, bh, aT, LQ, iE); #c1(VEGFB) c2(NP_001230662) c3(12467) c4(38581, 51638, 64695, 25524, 77752) c5(dx, Dr, A, b, k, dB, cO, VJ, jd, adl, cTE, q, cU, av, dh, bK, sH, du, v, W, jo, T, iA, hR, tO, ag, bq, at); #c1(VEGFC) c2(NP_005420) c3(12468) c4(38582, 51639, 64696, 25525, 77753) c5(Qd, en, aw, gG, dB, w, bmX, bf, e, O, Vx, kJ, yh, og, aC, sH, PQ, gm, bPN, x, fx, jT, DO, tO, ag, i, jl, yC, Dr, cY, iP, eu, fU, iG, bw, VJ, y, tp, co, Qc, pp, f, bu, B, cs, av, fy, iT, is, iF, V, dA, nl, P, ji, b, ia, ey, vn, Bb, Mr, d, jh, ra, re, hV, q, X, ar, VM, u, dh, il, ad, aZ, nV, acw, eQ, Cr, A, fr, jc, JC, wf, hP, U, aW, LS, Tg, aGt, fq, h, F, ik, n, ma, ez, cV, J, gV, W, jo, T, bp, aX, nP, by, aM, Rd, at, eG, iE); #c1(VENTX) c2(NP_055283) c3(12469) c4(38583, 51640, 64697, 25526, 77754) c5(hX, cT, fP); #c1(VEPH1) c2(NP_001161383) c3(12470) c4(38584, 51641, 64698, 25527, 77755) c5(Dj, b, eO); #c1(VEZT) c2(NP_060069) c3(12471) c4(38585, 51642, 64699, 25528, 77756) c5(eG); #c1(VGF) c2(XP_011514851) c3(12472) c4(38586, 51643, 64700, 25529, 77757) c5(f, X, avn, cA, cM, eA, ak, F, av, o, dj, hW, I, bxG, cz, T, fx yG, ao, aY, i, dc); #c1(VGLL1) c2(NP_057351) c3(12473) c4(38587, 51644, 64701, 25530, 77758) c5(Be, T, u, y, atb); #c1(VGLL2) c2(NP_703154) c3(12474) c4(38588, 51645, 64702, 25531, 77759) c5(aX); #c1(VGLL3) c2(NP_057290) c3(12475) c4(38589, 51646, 64703, 25532, 77760) c5(X, av, A, aA, cp); #c1(VGLL4) c2(NP_001121691) c3(12476) c4(38590, 51647, 64704, 25533, 77761) c5(b, ak, jJ, by, at, bu); #c1(VHL) c2(NP_000542) c3(12477) c4(38591, 51648, 64705, 25534, 77762) c5(EM, dB, aoL, tH, e, O, Hq, iy, DE, nC, bEx, bzz, g, fe, bp, Nz, fx, jT, cq, aNm, sg, cTE, cT, i, bP, X, iP, awm, bw, U, y, co, ip, ml, f, blN, bu, cs, av, fy, d, YV, fD, aub, auw, VP, W, pk, cFk, anG, ji, ap, Dr, b, bL, Qt, czQ, Ne, hh, ec, Fp, jd, jV, WO, ra, pn, ar, ff, VM, jG, u, dh, Ji, anZ, UG, eu, aSP, et, nV, hO, bkZ, yC, QU, KC, IO, k, pR, JC, nT, buk, RX, bmW, n, cB, aJZ, HI, fU, cV, dt, jo, T, zS, nP, fM, qp, bII, vt); #c1(VHLL) c2(NP_001004319) c3(12478) c4(38592, 51649, 64706, 25535, 77763) c5(P, en, ER, b, re, aiW, aMr, J, ag, BY, dQ, lI, aVs, Rd, iT, RQ); #c1(VIL1) c2(NP_009058) c3(12479) c4(38593, 51650, 64707, 25536, 77764) c5(d, ax, aw, apG, be, FL, q, e, aC, fU, T, aE, dH); #c1(VIM) c2(XP_01517951) c3(12480) c4(38594, 51651, 64708, 25537, 77765) c5(dx by, ml, aw, gG, dB, PR, w, JH, e, O, cU, dv, AX, fp, cl, fH, Hs, fe, lb, du, gm, bp, ft, fB, fx, Tw, OA, dH, bdW, Tu, DO, ag, cT, qP, i, vJ, aA, ceR, aaL, X, EB, iP, jz, hS, kY, U, arW, y, co, f, bu, ky, B, JX, cs, iJ, av, fy, bm, V, jh, v, gv, bAH, jC, k, f J, aec, cTG, ack, gt, py, PY, fw, xe, fG, ji, OG, b, QB, bBv, oi, zL, Mr, d, bPc, jd, re, hV, q, jV, es, ar, ff, hb, as, jG, pY, QM, jj, el, LR, gL, ad, Fo, Ca, et, cW, nV, kB, u, DR, gd, xP, asY, aJR, A, iL, qd, fr, jR, pu, gE, zK, yw, iK, jx, aOy, aX, bNN, h, cPI, F, Lh, Ir, aC, jQ, ax, cV, an, be, J, W, jo, T, jl, Pk, jT, ii, Zb, Xu, cb, sp, E, bh, iE, gl); #c1(VIPAS39) c2(NP_001180244) c3(12481) c4(38595, 51652, 64709, 25538, 77766) c5(aeg, IA, mg, cTH); #c1(VIP) c2(NP_003372) c3(12482) c4(38596, 51653, 64710, 25539, 77767) c5(B, JN, cy, Si, aC, p, akK, EZ, cDS, bk, aA, rn, jj, bNB, Kc, mk, dV, IW, vl, Co, y, co, rY, DM, ak, dZ, cs, fy, aNY, rN, nl, v, IR, eX, Qt, dP, jR, cIB, Tp, b, aTX, bb, jd, nU, es, dQ, hb, Tr, ar, Tv, u, dh, fh, ad, BZ, IX, Fo, jU, ao, ig, xU, gd, IS, I, A, wf, qs, sG, fq, aV, aq, hW, cV, be, P, ti, T, bzA, pw, cz, nk, ce, hq, DI, iB, gl); #c1(VIPR1) c2(NP_001238811) c3(12483) c4(38597, 51654, 64711, 25540, 77768) c5(bm, jK, A, aw, Kt, b, TQ, qz, C, z, U, al, y, d, Fp, co, sG, ak, e, g, vQ, es, bh, ar, B, cs, kX, u, jH, vR, V, cV, aC, nl, gL, gv, P, lI, aff, ad, qW, apD, ce, aq, cz, fP, I, aZA, yq, gE, bpe, ib, gl); #c1(VIPR2) c2(NP_001291451) c3(12484) c4(38598, 51655, 64712, 25541, 77769) c5(co, bb, b, Ey, sG, fq, Bt, es, eX, fc, A, B, cV, NS, Bu, aV, be); #c1(VIT) c2(NP_001171440) c3(12485) c4(38599, 51656, 64713, 25542, 77770) c5(bb, dA); #c1(VK0RC1) c2(NP_076869) c3(12486) c4(38600, 51657, 64714, 25543, 77771) c5(dx, bL, A, acm, gU, aaP, cTI, vY, sU, iL, cO, aO, gO, m, dv, bb, fm, adl, B, q, dl, mL, wY, mm, cp, bcj, o, fh, be, I, sX, du, gJ, My, eX, hR, bcB, eN, LO, bm, gl, vP, bg, wl, at, ap); #c1(VLDLR) c2(NP_001018066) c3(12487) c4(38601, 51658, 64715, 25544, 77772) c5(dx, id, b, fN, aF, ZP, eR, eH, jc, FT, eO, cA, adT, xw, aW, bhZ, dv, cy, dN, wd, f, bu, cM, ev, dh, EX, is, hW, I, du, bd, cz, Fy, T, lI, by, kS, JY, dP, aY, ch, ex, o, dc, aA); #c1(VMA21) c2(NP_001017980) c3(12488) c4(38602, 51659, 64716, 25545, 77773) c5(cTJ, ajg, adw, akn, oD); #c1(VMO1) c2(NP_001138411) c3(12489) c4(38603, 51660, 64717, 25546, 77774) c5(dB); #c1 (VMP1) c2(NP_112200) c3(12490) c4(38604, 51661, 64718, 25547, 77775) c5(bn, b, wG, f, q, ag, jo, fl, ff, bw); #c1(VNIR2) c2(NP_776255) c3(12491) c4(38605, 51662, 64719, 25548, 77776) c5(b, dY); #c1(VNIR4) c2(NP_776256) c3(12492) c4(38606, 51663, 64720, 25549, 77777) c5(b, dY); #c1(VNN1) c2(NP_004657) c3(12493) c4(38607, 51664, 64721, 25550, 77778) c5(da, jH, awl, bb, V, ae, aAr, f, di, fq, fP, U, cp, dL, jU, ap); #c1(VNN2) c2(NP_001229279) c3(12494) c4(38608, 51665, 64722, 25551, 77779) c5(da, awl, pw, ae, u, fq, aAr); #c1(VNN3) c2(NP_001278632) c3(12495) c4(38609, 51666, 64723, 25552, 77780) c5(da, fg); #c1(VOPP1) c2(NP_001271212) c3(12496) c4(38610, 51667, 64724, 25553, 77781) c5(d, h, e); #c1(VPRBP) c2(NP_055518) c3(12497) c4(38611, 51668, 64725, 25554, 77782) c5(cf, ER, b, X, f, eu, aC, P, asT, bf, av, fy, u, yW, y, aM); #c1(VPREB1) c2(NP_009059) c3(12498) c4(38612, 51669, 64726, 25555, 77783) c5(WH, b, m, hX, J, pD, M, aC, G, iv); #c1(VPREB3) c2(NP_037510) c3(12499) c4(38613, 51670, 64727, 25556, 77784) c5(jT, gm, pD); #c1(VPS11) c2(XP_011541201) c3(12500) c4(38614, 51671, 64728, 25557, 77785) c5(re, fl, ad, cU, cs, afs, iT); #c1(VPSI3A) c2(NP_001018047) c3(12501) c4(38615, 51672, 64729, 25558, 77786) c5(aag, ZZ, bgq, b, bK, yO, v, bu, dt, cc, iZ, bUg, xM, PE, bM, ac, V); #c1(VPSI3B) c2(NP_056058) c3(12502) c4(38616, 51673, 64730, 25559, 77787) c5(iw, sk, aX, na, XP, hN, ic, QZ, o, cp); #c1(VPSI3C) c2(NP_001018098) c3(12503) c4(38617, 51674, 64731, 25560, 77788) c5(bf, aA, I, aM); #c1(VPS26A) c2(NP_001030337) c3(12504) c4(38618, 51675, 64732, 25561, 77789) c5(i, I); #c1(VPS28) c2(NP_057292) c3(12505) c4(38619, 51676, 64733, 25562, 77790) c5(P, en); #c1(VPS33A) c2(NP_075067) c3(12506) c4(38620, 51677, 64734, 25563, 77791) c5(aeg, IZ); #c1 (VPS33B) c2(NP_061138) c3(12507) c4(38621, 51678, 64735, 25564, 77792) c5(gD, aY, aeg, na, mg, IA); #c1 (VPS35) c2(NP_060676) c3(12508) c4(38622, 51679, 64736, 25565, 77793) c5(cTK, b, I, bu, Oc, GR, aA, bj, o, V); #c1(VPS3G) c2(NP_057159) c3(12509) c4(38623, 51680, 64737, 25566, 77794) c5(cgi); #c1(VPS37A)

c2(NP_001138624) c3(12510) c4(38624, 51681, 64738, 25567, 77795) c5(oy, cTL, X, Ud, av, Fg); #c1(VPS37B) c2(NP_078943) c3(12511) c4(38625, 51682, 64739, 25568, 77796) c5(P); #c1(VPS37C) c2(NP_060436) c3(12512) c4(38626, 51683, 64740, 25569, 77797) c5(P, J); #c1 (VPS39) c2(NP_001288067) c3(12513) c4(38627, 51684, 64741, 25570, 77798) c5(u); #c1(VPS4I) c2(NP_055211) c3(12514) c4(38628, 51685, 64742, 25571, 77799) c5(bj, b, e0); #c1(VPS4A) c2(NP_037377) c3(12515) c4(38629, 51686, 64743, 25572, 77800) c5(aeq); #c1(VPS4B) c2(NP_004860) c3(12516) c4(38630, 51687, 64744, 25573, 77801) c5(fe, u, y); #c1(VPS5I) c2(NP_037397) c3(12517) c4(38631, 51688, 64745, 25574, 77802) c5(ek, dx, ml, aw, dN, dB, HG, eW, w, cO, bf, O, dv, kJ, mR, Hs, n, aC, wo, fx, wh, i, bq, aA, fl, X, EB, kB, kY, wX, bw, U, y, ed, ml, f, bu, gX, B, av, fy, fY, sB, V, ae, cd, IR, eX, be, ci, ap, b, QB, A, ey, aO, Bc, q, fv, u, aE, sz, fs, by, IX, lo, et, VH, xU, ih, IS, uk, k, tR, di, JC, wf, sx, qs, h, cU, oJ, sV, du, IP, sj, mc, J, dU, P, My, T, aM, qp); #c1(VPS52) c2(NP_001276105) c3(12518) c4(38632, 51689, 64746, 25575, 77803) c5(B, Ir, b, qd, abo, eu, tR, Ak, hS, A, cA, wX, vI, y, m, co, aX, XZ, f, PA, q, cTM, cs, kO, jG, u, GS, agu, og, ae, ht, ad, HK, zf, cQY, fM, ii, wn, py, ih, xb, Rj, ji); #c1(VPS53) c2(NP_001121631) c3(12519) c4(38633, 51690, 64747, 25576, 77804) c5(jE, V, b, re, q, U, bm, iT); #c1(VPS54) c2(NP_001005739) c3(12520) c4(38634, 51691, 64748, 25577, 77805) c5(ao, apR, PY, apA, HS); #c1(VPS72) c2(NP_001258016) c3(12521) c4(38635, 51692, 64749, 25578, 77806) c5(co, fy); #c1(VPS8) c2(NP_001009921) c3(12522) c4(38636, 51693, 64750, 25579, 77807) c5(bj); #c1(VRK1) c2(NP_003375) c3(12523) c4(38637, 51694, 64751, 25580, 77808) c5(d, fl, co, gE, b, Vf, nU, fP, bp, Eo, kz, T, cB, bf, boV, ar, u, e, y); #c1(VRK2) c2(NP_001123953) c3(12524) c4(38638, 51695, 64752, 25581, 77809) c5(b, ak, hS, T, u, CG, y); #c1(VSIG10) c2(NP_061959) c3(12525) c4(38639, 51696, 64753, 25582, 77810) c5(l); #c1(VSIG1) c2(NP_001164024) c3(12526) c4(38640, 51697, 64754, 25583, 77811) c5(X, by, bu); #c1(VSIG2) c2(NP_055127) c3(12527) c4(38641, 51698, 64755, 25584, 77812) c5(m, f, cTN, i, iC, fx); #c1(VSIG4) c2(NP_001093901) c3(12528) c4(38642, 51699, 64756, 25585, 77813) c5(co, h, be, fl, T, fy): #c1(VSNL1) c2(NP_003376) c3(12529) c4(38643, 51700, 64757, 25586, 77814) c5(d, ao, co, V, b, cV, adr, ft, f, aN, dV, O, fy, U, xw, aK, e, o); #c1(VSTM1) c2(NP_001275720) c3(12530) c4(38644, 51701, 64758, 25587, 77815) c5(c0); #c1(VSX1) c2(NP_001243200) c3(12531) c4(38645, 51702, 64759, 25588, 77816) c5(A, b, LX, cTO, iU, eR, Ak, ba, aW, aSW, AP, ml, B, nv, hb, zW, dj, LK, cTP, wd, LW, LY, ag, LZ, bnp, aOB, ap); #c1(VSX2) c2(NP_878314) c3(12532) c4(38646, 51703, 64760, 25589, 77817) c5(cTQ, V, kH, cTR, sr, nR, kD, cTS); #c1(VTA1) c2(NP_001273300) c3(12533) c4(38647, 51704, 64761, 25590, 77818) c5(A, aw, b, U, y, jh, co, Qm, f, q, bu, ar, B, cs, u, V, by, W, P, ad, axk, py, i, ap); #c1(VTCN1) c2(XP_011540445) c3(12534) c4(38648, 51705, 64762, 25591, 77819) c5(fl, b, X, eu, ig, hl, C, bf, U, BQ, y, jb, oy, co, aX, kJ, bu, aC, ik, av, aM, u, aE, ax, V, il, Be, dB, by, et, dH, ag, g0, oT); #c1(VTI1A) c2(NP_660207) c3(12535) c4(38649, 51706, 64763, 25592, 77820) c5(fh, A, bb, V, ar, bq, U, at, o, ap); #c1(VTI1B) c2(NP_006361) c3(12536) c4(38650, 51707, 64764, 25593, 77821) c5(o); #c1(VTN) c2(NP_000629) c3(12537) c4(38651, 51708, 64765, 25594, 77822) c5(aba, bL, id, aw, iL, b, k, X, arQ, eu, jf, O, w, di, C, dx, YT, U, A, aW, RX, dv, rY, hV, F, q, bu, ar, y, iv, Ek, av, fy, u, dh, ake, dj, sQ, I, B, aC, hZ, du, dB, J, ct, Ej, T, II, cV, aX, by, at, aeq, auK, bm, er, ciM, uH, eX, ag, qP, dX, asg, eg, eG, bwi, Dg, pv); #c1(VWA2) c2(NP_001258975) c3(12538) c4(38652, 51709, 64766, 25595, 77823) c5(x, bf, aE, bq, aM); #c1(VWA3A) c2(NP_775886) c3(12539) c4(38653, 51710, 64767, 25596, 77824) c5(ak); #c1 (VWA3B) c2(NP_659429) c3(12540) c4(38654, 51711, 64768, 25597, 77825) c5(c0); #c1(VWA5A) c2(NP_055437) c3(12541) c4(38655, 51712, 64769, 25598, 77826) c5(aX, b, cY, bj, re, T, u, y); #c1(VWA5BI) c2(XP_011538989) c3(12542) c4(38656, 51713, 64770, 25599, 77827) c5(oy); #c1(VWA7) c2(NP_079534) c3(12543) c4(38657, 51714, 64771, 25600, 77828) c5(m, aV, aE, o); #c1(VWA8) c2(NP_001009814) c3(12544) c4(38658, 51715, 64772, 25601, 77829) c5(dA, sG, ak, cz, ns, nm, nt, nq, nr, nm, no, np); #c1(VWCE) c2(NP_689931) c3(12545) c4(38659, 51716, 64773, 25602, 77830) c5(by, iL, q, b, bu); #c1(VWDE) c2(NP_001129396) c3(12546) c4(38660, 51717, 64774, 25603, 77831) c5(A); #c1(VWF) c2(NP_000543) c3(12547) c4(38661, 51718, 64775, 25604, 77832) c5(dx, dM, dN, dD, aZm, yz, aE, aN, aUO, eW, ak, cO, Eh, bf, OH, arE, jv, dv, IZ, AX, cTW, sZ, om, kX, tU, fu, azZ, vO, vN, sH, ZY, gJ, bp, ft, Ek, hR, pq, CB, tO, we, Ee, vK, fD, ahp, aA, WB, bP, bpu, id, xK, IW, co, aUL, aUK, cut, aK, f, UV, vQ, aG, Em, iF, vR, rP, ae, qb, qC, gv, I, adM, aR, eX, bq, tj, cTX, qD, xd, dy, DW, sK, aUW, fw, bqF, ej, Vh, ap, bqD, pT, aF, qz, bEH, vY, aUQ, DX, z, aO, bb, q, mL, DZ, kk, VM, DY, u, dr, o, fh, l, im, sX, bc, ZS, aUP, cTY, et, ps, bpx, L, rm, ch, vT, dh, Cv, fl, ab, cTT, vZ, cTV, bL, MZ, ix, fr, di, wf, cTZ, BM, aX, wp, sG, h, aC, oJ, cTU, du, Eg, P, bDc, T, ya, ac, aM, eN, ii, ql, bgV, zp, fP, bh, at); #c1(WAPAL) c2(NP_055860) c3(12548) c4(38662, 51719, 64776, 25605, 77833) c5(b); #c1(WARS2) c2(XP_011538796) c3(12549) c4(38663, 51720, 64777, 25606, 77834) c5(em, iu, bq, ag); #c1(WARS) c2(XP_006720312) c3(12550) c4(38664, 51721, 64778, 25607, 77835) c5(bP, WH, eX, b, bge, gn, ld, hS, di, iL, bf, U, e, d, avQ, adx, adm, XZ, t, f, om, mL, oO, sK, u, jZ, em, V, I, qs, G, T, afb, cK, gF, jT, aM, yG, eh, ads, Ya, tW, ie, Ck, mA, aE, ag, cT, fD, abs, bq, aA, iu); #c1(WASF1) c2(NP_001020106) c3(12551) c4(38665, 51722, 64779, 25608, 77836) c5(BO, ak, hW, V, b, BW, nU, cI, tF, A, di, B, ale, cA, bf, U, gZ, u, aA, y, aM); #c1(WASF3) c2(NP_001278894) c3(12552) c4(38666, 51723, 64780, 25609, 77837) c5(en, BW, b, A, di, kY, cA, bf, U, y, aqQ, ja, f, Db, oJ, Tv, u, V, dA, cV, aM, wh, B, bq, aA); #c1(WASH1) c2(XP_011515960) c3(12553) c4(38667, 51724, 64781, 25610, 77838) c5(dj, vu, b); #c1(WAS) c2(NP_000368) c3(12554) c4(38668, 51725, 64782, 25611, 77839) c5(g, en, b, aGk, sE, eu, cOh, cUa, w, O, y, BO, Ei, pp, fq, q, oE, hN, zb, asW, bQo, fP, zQ, u, n, cj, cV, be, ad, CM, P, BW, aA, jU, iw, cs, eQ, he, IN, byt, jN, CV, ael, ci, gl); #c1(WASL) c2(NP_003932) c3(12555) c4(38669, 51726, 64783, 25612, 77840) c5(BO, V, wn, bd, BV, hS, O, BW, U, u, y); #c1(WBP1L) c2(NP_001077382) c3(12556) c4(38670, 51727, 64784, 25613, 77841) c5(t, G, iv); #c1(WBP2) c2(NP_036610) c3(12557) c4(38671, 51728, 64785, 25614, 77842) c5(u, y); #c1(WBSCR17) c2(NP_071924) c3(12558) c4(38672, 51729, 64786, 25615, 77843) c5(o); #c1(WBSCR22) c2(NP_001189489) c3(12559) c4(38673, 51730, 64787, 25616, 77844) c5(gd, aZ, b, aIM); #c1 (WDFY2) c2(NP_443182) c3(12560) c4(38674, 51731, 64788, 25617, 77845) c5(av, b); #c1(WDFY4) c2(NP_065996) c3(12561) c4(38675, 51732, 64789, 25618, 77846) c5(m, ix, i, dA); #c1(WDHD1) c2(NP_001008397) c3(12562) c4(38676, 51733, 64790, 25619, 77847) c5(dx, rN, hV, aw, aDj, b, aeB, X, sE, aMI, eW, A, di, cBx, cA, bf, U, aI, y, gO, d, asN, co, aX, ra, iI, h, f, q, e, qX, uz, cs, av, cq, u, aE, wR, V, ft, du, Wj, azo, ad, dv, bt, aFt, qV, fx, vA, aM, Eu, eF, fr, P, he, B, agm, fD, aT, at, ap); #c1(WDPCP) c2(NP_056994) c3(12563) c4(38677, 51734, 64791, 25620, 77848) c5(sX, cUh, TD); #c1(WDR11) c2(NP_060587) c3(12564) c4(38678, 51735, 64792, 25621, 77849) c5(b, z, yD, og, Vy, gE, PI, O, cy, aoR, IV, cUc, im, aC, j, by, bcL, UT, pw, jG, Lz, bwW, cT, NU, bHI, at, iu, bT); #c1(WDR12) c2(NP_060726) c3(12565) c4(38679, 51736, 64793, 25622, 77850) c5(bq, at); #c1(WDR17) c2(NP_733828) c3(12566) c4(38680, 51737, 64794, 25623, 77851) c5(bm); #c1(WDR19) c2(NP_079408) c3(12567) c4(38681, 51738, 64795, 25624, 77852) c5(bP, b, A, aw, Yh, cUd, bOA, cUe, B, gJ, P, fO, vU, VN, sJ, nW, cUf, wy, SD, o, yG); #c1(WDR1) c2(NP_005103) c3(12568) c4(38682, 51739, 64796, 25625, 77853) c5(nV, aX, Ei, OM, Nq, dv, P, nH, co, cp); #c1(WDR20) c2(NP_001229344) c3(12569) c4(38683, 51740, 64797, 25626, 77854) c5(b, gG, wy, U, S, q, Me, ik, cl, cs, aq, NT, V, iI, bfY, Ce, ct, mF, ym, yE, agw, XH, rv, aA, at); #c1(WDR26) c2(NP_001108585) c3(12570) c4(38684, 51741, 64798, 25627, 77855) c5(aX, f, vB, BV, dQ, wT); #c1(WDR31) c2(NP_001012361) c3(12571) c4(38685, 51742, 64799, 25628, 77856) c5(fh, at, bb, bq, ap); #c1(WDR34) c2(NP_443076) c3(12572) c4(38686, 51743, 64800, 25629, 77857) c5(bjh, h, bjf, cUg, jV); #c1(WDR35) c2(NP_001006658) c3(12573) c4(38687, 51744, 64801, 25630, 77858) c5(atS, b, cUi, bOA, cUh, gv, bh, zW); #c1(WDR36) c2(NP_644810) c3(12574) c4(38688, 51745, 64802, 25631, 77859) c5(f, cy, ez, er, md, qr, akm, lg, aD, bq, aA, cUj); #c1(WDR37) c2(NP_054742) c3(12575) c4(38689, 51746, 64803, 25632, 77860) c5(bb, do, et, fD); #c1(WDR43) c2(NP_055946) c3(12576) c4(38690, 51747, 64804, 25633, 77861) c5(Xt); #c1(WDR45B) c2(NP_062559) c3(12577) c4(38691, 51748, 64805, 25634, 77862) c5(nU); #c1(WDR45) c2(NP_001025067) c3(12578) c4(38692, 51749, 64806, 25635, 77863) c5(cUk, axi, nU, bM); #c1(WDR46) c2(NP_005443) c3(12579) c4(38693, 51750, 64807, 25636, 77864) c5(m, aX, bu); #c1(WDR48) c2(NP_001290331) c3(12580) c4(38694, 51751, 64808, 25637, 77865) c5(V, fr, ft, od, pt, oM, jT, XR); #c1(WDR49) c2(NP_849146) c3(12581) c4(38695, 51752, 64809, 25638, 77866) c5(at); #c1(WDR4) c2(NP_387510) c3(12582) c4(38696, 51753, 64810, 25639, 77867) c5(di); #c1(WDR55) c2(XP_005268526) c3(12583) c4(38697, 51754, 64811, 25640, 77868) c5(fh, at, bb, bq, ap); #c1(WDR5) c2(XP_005272220) c3(12584) c4(38698, 51755, 64812, 25641, 77869) c5(A, u, B, y); #c1(WDR60) c2(NP_060521) c3(12585) c4(38699, 51756, 64813, 25642, 77870) c5(cUI, zW); #c1(WDR62) c2(NP_001077430) c3(12586) c4(38700, 51757, 64814, 25643, 77871) c5(aev, b, FR, cUm, nU, cUn, bu, ais, QZ, by, ait); #c1(WDR64) c2(NP_653226) c3(12587) c4(38701, 51758, 64815, 25644, 77872) c5(aV); #c1(WDR66) c2(NP_001171474) c3(12588) c4(38702, 51759, 64816, 25645, 77873) c5(d, jh, aeU, e); #c1(WDR70) c2(NP_060504) c3(12589) c4(38703, 51760, 64817, 25646, 77874) c5(hT); #c1(WDR72) c2(XP_011519737) c3(12590) c4(38704, 51761, 64818, 25647, 77875) c5(bb, Ur, cUo, aE, fD); #c1(WDR74) c2(NP_060563) c3(12591) c4(38705, 51762, 64819, 25648, 77876) c5(aX); #c1(WDR76) c2(NP_079184) c3(12592) c4(38706, 51763, 64820, 25649, 77877) c5(U, V, Dj); #c1(WDR78) c2(XP_011540464) c3(12593) c4(38707, 51764, 64821, 25650, 77878) c5(cT); #c1(WDR7) c2(NP_056100) c3(12594) c4(38708, 51765, 64822, 25651, 77879) c5(qf, aV); #c1(WDR81) c2(NP_001157145) c3(12595) c4(38709, 51766, 64823, 25652, 77880) c5(SJ, adT, cUp, kS); #c1(WDR83) c2(NP_15708) c3(12596) c4(38710, 51767, 64824, 25653, 77881) c5(by, b, bu); #c1(WDR86) c2(NP_001271190) c3(12597) c4(38711, 51768, 64825, 25654, 77882) c5(at); #c1(WDR93) c2(NP_001271324) c3(12598) c4(38712, 51769, 64826, 25655, 77883) c5(ao); #c1(WEE1) c2(NP_001137448) c3(12599) c4(38713, 51770, 64827, 25656, 77884) c5(iF, aw, b, cV, cY, f, q, jR, ft, fr, w, O, kY, yE, aX, fy, u, y); #c1(WFDC1) c2(NP_001269395) c3(12600) c4(38714, 51771, 64828, 25657, 77885) c5(A, arP, b, cY, B, aC, P, aX, fs); #c1(WFDC2) c2(XP_011526797) c3(12601) c4(38715, 51772, 64829, 25658, 77886) c5(pb, A, b, X, cU, T, av, iA); #c1(WFS1) c2(NP_001139325) c3(12602) c4(38716, 51773, 64830, 25659, 77887) c5(cUq, ux, ak, axK, HD, cUr, ns, Ey, nm, nt, nq, nr, nn, cA, bf, no, np, bj, ey, cM, cUs, bQ, kW, f, adR, aqA, awS, aE, adQ, mz, dj, hW, l, bK, Bx, bCN, bp, v, aA, eX, gF, cz, aON, aM, P, aOO, aY, MP, mA, na, dc, mD, cUt, vL); #c1(WHSC1) c2(NP_015627) c3(12603) c4(38717, 51774, 64831, 25660, 77888) c5(afE, aOO, b, t, B, J, fO, axK, G, co, A, KE, u, eG, y); #c1(WHSC1LI) c2(NP_060248) c3(12604) c4(38718, 51775, 64832, 25661, 77889) c5(fU, b, kJ, bm, h, bp, co, fv, fO, fx, fy, u, y); #c1(WIF1) c2(NP_009122) c3(12605) c4(38719, 51776, 64833, 25662, 77890) c5(A, aw, b, sO, fr, iP, dB, w, et, U, hP, aeC, y, cp, jh, bxr, aX, apG, jk, h, k, q, jV, bu, ik, ff, cs, ar, PH, fy, u, iT, iF, V, cV, aC, be, Zg, J, bp, ad, W, gO, jo, co, T, fi, aif, cy, fx, ft, cW, aai, ag, i, Mp, re, gl); #c1(WIPF1) c2(NP_003378) c3(12606) c4(38720, 51777, 64834, 25663, 77891) c5(BO, Ei, V, aGk, BV, fl, cUu, U, BW); #c1(WIPF2) c2(NP_573571) c3(12607) c4(38721, 51778, 64835, 25664, 77892) c5(BW); #c1(WIPF3) c2(NP_001073998) c3(12608) c4(38722, 51779, 64836, 25665, 77893) c5(wn, BW); #c1(WIPI1) c2(NP_060453) c3(12609) c4(38723, 51780, 64837, 25666, 77894) c5(ep, b); #c1(WIPI2) c2(NP_001028690) c3(12610) c4(38724, 51781, 64838, 25667, 77895) c5(bq); #c1(WISP1) c2(NP_001191798) c3(12611) c4(38725, 51782, 64839, 25668, 77896) c5(by, b, fr, gG, kB, di, U, Uh, y, MT, co, cy, q, X, do, cs, gg, u, LR, V, qC, bp, ft, T, x, ad, jU, jH, cId); #c1(WISP2) c2(XP_005260660) c3(12612) c4(38726, 51783, 64840, 25669, 77897) c5(iF, wh, V, b, ja, Jq, ag, ar, oJ, fl, fv, U, u, y); #c1(WISP3) c2(NP_003871) c3(12613) c4(38727, 51784, 64841, 25670, 77898) c5(A, b, LX, iU, eR, Ak, kB, U, y, MT, B, q, hb, WF, u, zW, dj, ax, V, aC, be, dt, T, x, wd, dH, rM, LW, LY, aRt, ag, LZ, ap); #c1(WLS) c2(XP_011540493) c3(12614) c4(38728, 51785, 64842, 25671, 77899) c5(A, jE, b, k, X, iP, jL, dB, O, w, ly, O, hP, fx, y, cp, d, co, rY, ae, kW, gW, h, f, e, q, bu, cU, IA, It, ik, B, iv, av, fy, u, da, fU, V, il, iw, cs, J, bp, ad, dt, P, lC, T, fO, cV, aX, iA, by, Pw, if, hX, bm, G, jR, ag, cT, jT, i, ji, bT); #c1(WNK1) c2(NP_001171914) c3(12615) c4(38729, 51786, 64843, 25672, 77900) c5(B, ud, DT, aN, w, aic, bf, O, e, cmn, cy, kJ, nV, cI, azx, g, jH, lb, fO, iU, axM, x, qt, ag, cT, pt, asL, X, jz, bqU, U, y, f, mx, bu, xl, av, iT, V, BV, bt, pi, Fu, jR, uK, oM, hc, ap, b, aF, oi, aFh, cbK, ey, d, jh, bb, cN, fv, re, hV, q, dQ, cFB, pB, ar, u, alc, o, fh, fs, j, by, uw, et, et, jU, cUv, ao, PL, aAs, eQ, fl, hd, cqT, A, bjC, aOv, di, lv, bWE, brx, yw, jQ, oy, m, qs, aX, fq, h, F, aC, ik, n, aV, aq, cV, J, bEC, T, bh, azY, ac, aM, ii, Y, Jh, fP, XO, eG); #c1(WNK2) c2(NP_001269323) c3(12616) c4(38730, 51787, 64844, 25673, 77901) c5(g, bn, MI, b, kJ, jd, DO, w, bb, aX, et, O); #c1(WNK3) c2(NP_065973) c3(12617) c4(38731, 51788, 64845, 25674, 77902) c5(bqR, nz, cz); #c1(WNK4) c2(NP_115763) c3(12618) c4(38732, 51789, 64846, 25675, 77903) c5(bP, dt, qs, uw, Fu, f, hv, jR, aOv, cUw, cUx, aeP, di, bWE, aic, cp, cqT); #c1(WNT10A) c2(NP_079492) c3(12619) c4(38733, 51790, 64847, 25676, 77904) c5(bjA, b, dB, cUA, ic, U, cUz, amQ, bu, ik, HE, cUB, bjD, V, il, by, cUy, bt, amR, et, bjF, bjG); #c1

(WNT10B) c2(NP_003385) c3(12620) c4(38734, 51791, 64848, 25677, 77905) c5(pb, cU, ao, arl, kY, b, X, by, re, bu, cUC, fr, yU, iT, aRY, T, aA, ft, u, y); #c1(WNTI1) c2(NP_004617) c3(12621) c4(38735, 51792, 64849, 25678, 77906) c5(A, aw, b, dB, hA, cO, U, y, bb, ip, h, B, q, ar, cs, Hs, u, Fg, bmf, V, J, ad, ny, et, pi, ac, BX, Nq, Ns); #c1(WNTI6) c2(NP_057171) c3(12622) c4(38736, 51793, 64850, 25679, 77907) c5(cr, agv, aeh, J, oO, aA, ap, cp); #c1(WNT1) c2(NP_005421) c3(12623) c4(38737, 51794, 64851, 25680, 77908) c5(A, aw, b, zF, jB, gN, cUE, iL, ct, U, e, y, cp, d, MT, aX, h, B, q, bu, aC, ik, O, cB, cUD, gg, u, n, aqP, fU, V, aeM, qL, LR, v, by, P, T, x, cy, rQ, bm, Nq, jR, ag, fP, QP, qh, rr); #c1(WNT2B) c2(NP_001278809) c3(12624) c4(38738, 51795, 64852, 25681, 77909) c5(g, ak, V, b, X, re, Bt, bu, ip, ik, ll, ny, HE, Bu, by, fp, iT, BX); #c1(WNT2) c2(NP_003382) c3(12625) c4(38739, 51796, 64853, 25682, 77910) c5(b, X, iP, oi, aVb, U, hP, y, yK, aX, DP, bu, cU, O, u, iT, cI, gG, V, j, cz, W, T, by, pq, QG, ag, cUE, bk, ap); #c1(WNT3A) c2(NP_149122) c3(12626) c4(38740, 51797, 64854, 25683, 77911) c5(A, dN, X, dB, Nq, w, ds, U, O, aX, f, q, B, cs, av, u, V, J, fO, ad, jo, mb, G, zM, Ns, hM, eG, y); #c1(WNT3) c2(NP_110380) c3(12627) c4(38741, 51798, 64855, 25684, 77912) c5(acE, b, bKn, iU, ig, bj, co, aX, q, bu, cs, CX, u, NO, bmf, cUG, j, ad, T, aZ, bb, by, et, pq, fy, Nq, Ns, Bm, bq); #c1(WNT4) c2(XP_011539899) c3(12628) c4(38742, 51799, 64856, 25685, 77913) c5(bP, A, b, X, jw, e, y, d, UZ, DP, UV, cU, UF, av, bxK, u, iF, xE, bfV, J, xF, vF, cUH, Ca, Ap, et, jH, aH, Hs, hX, gd, fD, I, aA, eG); #c1(WNT5A) c2(NP_001243034) c3(12629) c4(38743, 51800, 64857, 25686, 77914) c5(dx, da, by, A, kE, b, jR, cY, aF, jz, Vz, aN, MS, w, lv, iL, gE, bw, U, bu, aK, e, y, jb, d, M, fe, co, aX, ajn, i, cfy, h, B, Ll, q, es, dl, X, ar, O, cs, UF, av, fy, u, iT, g, jQ, du, bmf, V, Be, LR, gm, bp, J, gO, G, dv, T, fO, bt, Qt, x, cl, fx, ad, fv, ao, nV, hX, Nq, Ns, ag, og, cmo, tI, aC, aA); #c1(WNT5B) c2(NP_110402) c3(12630) c4(38744, 51801, 64858, 25687, 77915) c5(d, wh, l, fr, ft, oJ, rb, aA, u, e, y); #c1(WNT6) c2(NP_006513) c3(12631) c4(38745, 51802, 64859, 25688, 77916) c5(bt, bu, i, fx, by, u, y); #c1(WNT7A) c2(NP_004616) c3(12632) c4(38746, 51803, 64860, 25689, 77917) c5(b, X, iP, dB, Nq, xl, oy, atj, t, ak, oJ, UF, av, fy, u, Ij, Yj, hh, bfV, cUI, bp, J, cUJ, G, co, wh, aY, PY, Ns, eG); #c1(WNT7B) c2(NP_478679) c3(12633) c4(38747, 51804, 64861, 25690, 77918) c5(VF, A, Dx, b, B, bu, ag, co, DP, i, fx, by, u, y); #c1(WNT8A) c2(NP_490645) c3(12634) c4(38748, 51805, 64862, 25691, 77919) c5(bmf, sX, Nq, by, Ns, bu); #c1(WNT8B) c2(NP_003384) c3(12635) c4(38749, 51806, 64863, 25692, 77920) c5(by, V, bu, ar, T, U, YY); #c1(WNT9A) c2(NP_003386) c3(12636) c4(38750, 51807, 64864, 25693, 77921) c5(ie, u, b, et); #c1(WNT9B) c2(NP_003387) c3(12637) c4(38751, 51808, 64865, 25694, 77922) c5(Ns, bmf, Il, bfV, Nq); #c1(WRAP53) c2(NP_001137462) c3(12638) c4(38752, 51809, 64866, 25695, 77923) c5(GK, ip, b, asr, cUK, GB, ik, GM, i, ss, l, u, y); #c1(WRB) c2(NP_001139690) c3(12639) c4(38753, 51810, 64867, 25696, 77924) c5(A, b, X, U, e, O, d, co, aX, q, bu, y, av, aq, V, cV, J, by, T, st, u, DO, Ez, at, eG); #c1(WRN) c2(NP_000544) c3(12640) c4(38754, 51811, 64868, 25697, 77925) c5(dx, ji, eX, b, rT, eu, QY, Lq, bf, U, yw, y, Ov, dv, bb, il, f, F, es, DZ, O, pt, bos, ik, jG, aV, u, Qx, aEq, aIU, V, I, asr, du, JY, ad, dt, iJ, P, cUL, T, j, aAB, Nh, jl, cq, jT, ac, aM, wU, ast, at, Ou, i, bq, l, oM, aA, IA, fj, Mb); #c1(WRNIP1) c2(NP_064520) c3(12641) c4(38755, 51812, 64869, 25698, 77926) c5(Nh); #c1(WSB1) c2(NP_056441) c3(12642) c4(38756, 51813, 64870, 25699, 77927) c5(ag, f, b, cV); #c1(WSCD1) c2(NP_056068) c3(12643) c4(38757, 51814, 64871, 25700, 77928) c5(bm); #c1(WSCD2) c2(NP_001291376) c3(12644) c4(38758, 51815, 64872, 25701, 77929) c5(aQv, ak, di); #c1(WT1) c2(NP_000369) c3(12645) c4(38759, 51816, 64873, 25702, 77930) c5(B, aw, afg, F, jt, dB, w, cUM, O, kJ, t, cUS, dl, et, PH, UP, fe, Ls, ft, cs, bp, azo, azg, x, bvG, jT, kI, bfD, lq, jE, fy, BX, aq, ie, ag, pH, fD, pt, aA, bP, X, iP, aNH, wy, NH, iG, bw, U, y, co, f, e, iv, iJ, afA, av, PX, bm, cj, V, hf, bd, aEt, iA, pk, uJ, cUT, jR, gR, oM, hc, cUQ, ck, b, cUR, z, jy, mF, d, jd, nU, q, es, ZB, ar, ff, VM, hV, jG, u, aqS, cUO, ld, wp, cUN, ad, G, wd, P, nV, hU, hX, Cr, yy, o, asg, aKD, A, fr, Lv, pR, cUP, agj, di, JG, iK, aX, h, wN, M, Gs, n, cB, UR, te, oS, J, W, jo, T, ji, cz, fM, aGi, NG, ci, XH, Ez, eG, Bi); #c1(WTAP) c2(NP_001257460) c3(12646) c4(38760, 51817, 64874, 25703, 77931) c5(b, gG, jZ, w, PH, aI); #c1(WTIP) c2(NP_001073905) c3(12647) c4(38761, 51818, 64875, 25704, 77932) c5(PH, fe); #c1(WWC1) c2(NP_001155133) c3(12648) c4(38762, 51819, 64876, 25705, 77933) c5(o, b, Gm, aY, Mn, cV, he, bu, dl, tF, Ey, oN, y, dc, by, u, cM); #c1(WWC2) c2(NP_079225) c3(12649) c4(38763, 51820, 64877, 25706, 77934) c5(oy); #c1(WWOX) c2(NP_001278926) c3(12650) c4(38764, 51821, 64878, 25707, 77935) c5(fA, jp, by, nU, d, b, em, X, cs, dB, ar, cUU, O, hS, jc, w, ak, bw, bf, U, bu, A, e, y, oy, hO, fe, co, jd, bj, re, f, F, g, gT, fr, ik, B, iv, hV, av, fy, u, Xc, o, is, hh, fU, V, nQ, dA, Be, gG, Qf, Dt, J, fO, ad, P, T, II, cV, pt, QZ, fx, ft, kS, PJ, JY, nV, bsX, hX, iR, cf, jh, adr, ag, iT, i, bq, oM, aA, at, ap); #c1(WWP1) c2(XP_005250817) c3(12651) c4(38765, 51822, 64879, 25708, 77936) c5(A, b, B, u, y, jb); #c1(WWP2) c2(NP_001257384) c3(12652) c4(38766, 51823, 64880, 25709, 77937) c5(aRv, bq); #c1(WWTR1) c2(NP_001161750) c3(12653) c4(38767, 51824, 64881, 25710, 77938) c5(dx, ats, b, X, w, cO, U, cSL, y, co, aX, aoW, azO, hN, mR, D, cg, cs, av, fy, u, cc, xc, V, du, fO, ad, dt, cmK, wt, cK, et, bgc, iw, cbd, yC, er, DO, QI, ix, aeI); #c1(XAB2) c2(NP_064581) c3(12654) c4(38768, 51825, 64882, 25711, 77939) c5(aXL, b, lb, jV, cl, aV); #c1(XAF1) c2(NP_059993) c3(12655) c4(38769, 51826, 64883, 25712, 77940) c5(en, aw, b, dB, sJ, A, iL, hP, aX, AX, f, q, bu, ar, B, Rh, cs, aV, bm, ff, V, cV, fO, ad, T, x, fx, by, jE, w, i, re); #c1(XAGE1B) c2(NP_001091065) c3(12656) c4(38770, 51827, 64884, 25713, 77941) c5(ck, aX, b, B, bp, A, XH, ji, rb); #c1(XAGE1E) c2(NP_001091073) c3(12657) c4(38771, 51828, 64885, 25714, 77942) c5(ck, aX, b, B, A, XH, ji); #c1(XBP1) c2(NP_001073007) c3(12658) c4(38772, 51829, 64886, 25715, 77943) c5(dx, oC, ak, pV, aov, X, aiW, jz, nm, nq, Ou, cA, NY, y, jQ, Ov, dv, aX, b, h, f, q, aC, vu, ar, O, qB, fH, av, fy, u, dh, l, ER, yY, du, gm, fO, IR, IX, T, eX, jl, gF, jT, dL, fJ, px, jH, ao, aY, fN, PY, fP, ex, zM, cT, IS, i, dc, l, aA, aau, Nu, wr, jU, xa); #c1(XCL1) c2(XP_011508167) c3(12659) c4(38773, 51830, 64887, 25716, 77944) c5(P, ed, fl, cy, aC, MU, q, j, bu, cT, T, y, Dc, aCQ, di, av, by, u, ajt, cp); #c1(XCL2) c2(NP_003166) c3(12660) c4(38774, 51831, 64888, 25717, 77945) c5(av, q); #c1(XCR1) c2(NP_001019815) c3(12661) c4(38775, 51832, 64889, 25718, 77946) c5(ig, av, ix, P); #c1(XDH) c2(NP_000370) c3(12662) c4(38776, 51833, 64890, 25719, 77947) c5(dx, by, bn, b, X, aF, eO, sv, dv, di, HS, cO, cLR, U, e, y, gO, d, Ag, co, cy, dN, jd, t, f, XA, q, bu, ik, wY, cs, sR, av, Hs, u, dh, g, ma, V, ob, du, gL, ad, dt, Ei, T, rB, ji, gn, cK, hR, et, xd, aH, cz, fP, Af, l, bh, ap); #c1(XG) c2(NP_001135391) c3(12663) c4(38777, 51834, 64891, 25720, 77948) c5(KC, c, cUW, buV, Rx, bty, Lm, yD, iE, cUV, xI); #c1(XIAP) c2(XP_011529631) c3(12664) c4(38778, 51835, 64892, 25721, 77949) c5(B, iq, Zq, gG, dB, sJ, w, cO, bf, O, cy, kJ, cI, Rh, fH, og, aC, cs, gm, bp, x, fx, jT, zQ, aZn, BX, ag, cT, i, X, vD, jz, eu, kB, dV, bw, U, y, co, pp, f, bu, dZ, iv, av, fy, iT, V, Bs, alf, ny, fJ, iP, er, PY, in, DG, WH, b, wn, oi, bQO, ey, On, Zk, re, q, ar, ff, hb, jG, u, dh, aDu, Mi, LR, wV, gL, by, aeC, ao, nV, pS, eQ, wP, Iv, A, iV, jQ, MT, aX, h, F, ik, n, aV, fU, cV, J, jo, hl, T, fO, ad, aM, ip, fP, Af); #c1(XIRP1) c2(NP_001185550) c3(12665) c4(38779, 51836, 64893, 25722, 77950) c5(bf); #c1(XIRP2) c2(NP_001073278) c3(12666) c4(38780, 51837, 64894, 25723, 77951) c5(bq, aWt, cz); #c1(XK) c2(NP_066569) c3(12667) c4(38781, 51838, 64895, 25724, 77952) c5(bgq, b, k, dB, aN, AA, ps, ZZ, jk, f, bu, mL, o, aag, hW, cV, v, by, jo, ac, xM, ji); #c1(XKR4) c2(NP_443130) c3(12668) c4(38782, 51839, 64896, 25725, 77953) c5(oy, bq, IV, cO); #c1(XKR6) c2(NP_775954) c3(12669) c4(38783, 51840, 64897, 25726, 77954) c5(m, dK); #c1(XKR9) c2(NP_001274188) c3(12670) c4(38784, 51841, 64898, 25727, 77955) c5(A); #c1(XPA) c2(NP_000371) c3(12671) c4(38785, 51842, 64899, 25728, 77956) c5(GD, ji, A, aw, b, X, rR, rT, i, ar, mk, ck, ic, Lq, bw, U, yw, y, d, M, co, aX, am, ip, ag, h, B, F, q, bu, cU, fr, hN, ky, oJ, ik, av, aV, u, e, ff, QD, V, aeM, cV, dB, bp, ft, GB, T, Qt, iA, by, yA, Vx, jT, fy, aXL, Dj, in, avI, Zu, tl, fl, pt, gh); #c1(XPC) c2(NP_004619) c3(12672) c4(38786, 51843, 64900, 25729, 77957) c5(B, aw, dB, w, e, O, az, am, NR, Gp, fH, jM, g, Xc, is, sy, bp, zU, fx, of, DO, ag, cT, au, i, GD, X, W, bw, U, y, co, ip, f, bu, av, fy, bm, iT, QD, V, Qz, sc, iA, fJ, dt, aen, py, tl, ji, b, wn, aBx, ic, Lq, d, jh, jd, q, ar, ff, VM, u, NT, il, cz, iw, iR, kM, Dj, Zu, l, yA, A, fr, gN, jc, iL, gE, yw, aX, h, F, cU, hN, ik, rR, aV, si, GB, P, T, by); #c1(XPNPEP1) c2(NP_001161076) c3(12673) c4(38787, 51844, 64901, 25730, 77958) c5(cV, aN, et, EG, aq, o); #c1(XPNPEP2) c2(NP_003390) c3(12674) c4(38788, 51845, 64902, 25731, 77959) c5(cUX, cUY); #c1(XPNPEP3) c2(NP_071381) c3(12675) c4(38789, 51846, 64903, 25732, 77960) c5(cUZ, et, vU); #c1(XPO1) c2(XP_011531399) c3(12676) c4(38790, 51847, 64904, 25733, 77961) c5(A, iL, b, X, jz, dB, kY, et, G, O, jQ, cr, t, h, f, q, fr, B, av, fy, bm, ff, ae, el, J, fO, cz, jo, T, aX, qT, jE, rQ, P, ag, cT, pt, Nu); #c1(XPO4) c2(NP_071904) c3(12677) c4(38791, 51848, 64905, 25734, 77962) c5(qf, jE, cV, ak, q, iL, bh, bm, jZ); #c1(XPO5) c2(NP_065801) c3(12678) c4(38792, 51849, 64906, 25735, 77963) c5(b, wp, E, dB, ip, T, ff, ny, jw, iR, BX); #c1(XPO6) c2(NP_001257869) c3(12679) c4(38793, 51850, 64907, 25736, 77964) c5(IV); #c1(XPO7) c2(NP_055839) c3(12680) c4(38794, 51851, 64908, 25737, 77965) c5(bq); #c1(XPR1) c2(NP_001129141) c3(12681) c4(38795, 51852, 64909, 25738, 77966) c5(dx, B, b, ka, gE, dB, eY, A, iL, z, U, y, gB, wZ, co, ag, hV, q, jV, az, fr, ar, aW, cs, pB, fy, u, V, I, cV, lb, du, ad, dv, eX, ft, Mp, jU, jE, f, au, bm, gd, gu, yM, fN, aC, ej, aA, pO, bca); #c1(XRCC1) c2(NP_006288) c3(12682) c4(38796, 51853, 64910, 25739, 77967) c5(B, pV, bx, Zy, dB, Ty, aw, adr, e, O, hO, iy, b, NR, t, dI, Gp, zb, fH, Zv, Qx, rR, g, og, aeM, iw, aC, bK, sH, cs, gm, bp, gY, zU, fx, jT, kN, cq, wh, QJ, BX, bm, DO, jh, os, ag, cT, oi, bk, i, sg, bq, aA, bP, GD, iI, GM, cY, iP, wy, fU, Xc, Dj, kY, bf, ot, bw, U, Oh, y, ez, tp, co, ip, f, bbG, bu, gX, awd, Mp, iv, av, fy, QD, iT, is, d, V, aub, Qz, J, cU, ny, QM, VP, iA, fJ, Vx, W, hp, in, sh, tl, ji, iu, Dr, ck, am, aWN, wn, vY, au, ic, Og, nS, jD, hh, Ag, bb, lz, jd, re, hV, PA, q, cVa, WO, Zx, ar, RF, oO, fv, jG, Tv, u, o, ff, PJ, qy, l, atr, j, ad, gO, Sq, pD, rB, Vw, Be, M, adA, au, nV, aJA, fD, iR, py, Bg, gd, Zu, dn, l, yA, fh, GK, A, axH, pR, aHJ, gN, jc, C, iL, Lr, hP, buk, aW, cOU, RX, Ez, aX, Zw, h, F, qr, Uq, az, hN, ik, oJ, cB, qB, aV, jZ, jH, ma, Sv, m, an, asq, GB, jo, T, ll, Oi, jl, by, iG, ast, Xu, Rd, so, Yv, bh, X, at, eG, as); #c1(XRCC2) c2(NP_005422) c3(12683) c4(38797, 51854, 64911, 25740, 77968) c5(QD, b, GK, X, QB, Og, bw, U, Oh, e, y, V, d, aX, ip, bkU, jd, bu, ik, O, ar, av, aV, u, g, i, J, Qz, GB, qO, zU, pt, fy, jl, fx, wh, nV, GM, ag, cT, tl, oM, yA); #c1(XRCC3) c2(XP_005268103) c3(12684) c4(38798, 51855, 64912, 25741, 77969) c5(bx, dB, w, e, O, dl, fH, aLt, aeM, Xc, bp, fx, wh, aOi, BX, QD, os, ag, i, bq, Dr, GD, X, DO, iP, mk, GM, bw, U, y, co, ip, B, bu, bIQ, av, fy, iT, yJ, V, aub, Qz, J, pt, iA, fJ, GB, py, in, qO, CA, b, GK, ic, nS, d, Ag, jd, re, hV, q, ND, fv, RF, ar, u, ff, il, by, WZ, nV, Dj, dn, l, yA, g, A, k, m, aX, Zw, h, F, hN, ik, n, aV, tl, asq, W, T, fO, jl, ac, Af, Oi, at); #c1(XRCC4) c2(NP_072044) c3(12685) c4(38799, 51856, 64913, 25742, 77970) c5(Dr, A, b, fO, jE, eu, O, z, U, e, y, jx, d, co, jl, jd, jT, q, bu, ar, oJ, av, aV, u, g, V, I, cV, dB, J, Qz, cx, aHG, j, pt, fy, avF, fx, by, wh, nV, bm, cT, i, l, oM, eG); #c1(XRCC5) c2(NP_066964) c3(12686) c4(38800, 51857, 64914, 25743, 77971) c5(aw, iL, b, F, mW, iG, ji, U, e, y, d, jh, co, aX, RD, ip, jd, all, CR, q, bu, M, ar, O, pt, av, aV, u, gl, g, bm, V, m, hZ, cs, fO, ad, W, pF, T, ny, bh, fy, fx, by, jG, cq, qW, jE, nV, BX, iR, OJ, cT, i, fl, l, oM, at); #c1(XRCCGBP1) c2(NP_150592) c3(12687) c4(38801, 51858, 64915, 25744, 77972) c5(qP, w, O, HG); #c1(XRCC6) c2(NP_001275905) c3(12688) c4(38802, 51859, 64916, 25745, 77973) c5(A, aw, b, iP, eu, mW, w, fH, U, e, y, d, m, co, aX, Vx, ip, all, B, F, q, bu, M, ik, O, cs, Yr, ar, av, aV, u, dh, iT, R, g, si, V, il, cV, dB, fO, ad, W, T, pt, fx, by, jG, fJ, WZ, fy, iR, gl, cT, i, fl, oM, re); #c1(XRN1) c2(NP_001269786) c3(12689) c4(38803, 51860, 64917, 25746, 77974) c5(aiW, d, ao, f, e); #c1(XRN2) c2(NP_036387) c3(12690) c4(38804, 51861, 64918, 25747, 77975) c5(co, bp); #c1(XRRA1) c2(NP_001257309) c3(12691) c4(38805, 51862, 64919, 25748, 77976) c5(b); #c1(XXYLT1) c2(NP_689744) c3(12692) c4(38806, 51863, 64920, 25749, 77977) c5(fy); #c1(XYLB) c2(NP_005099) c3(12693) c4(38807, 51864, 64921, 25750, 77978) c5(Fg, aO); #c1(XYLT1) c2(NP_071449) c3(12694) c4(38808, 51865, 64922, 25751, 77979) c5(oy, dy, dA, cd, di, bW, lV, et, aE, gI); #c1(XYLT2) c2(NP_071450) c3(12695) c4(38809, 51866, 64923, 25752, 77980) c5(oy, qs, dy, aE, di, et, dr); #c1(YAEID1) c2(NP_001269375) c3(12696) c4(38810, 51867, 64924, 25753, 77981) c5(bb); #c1(YAP1) c2(NP_001123617) c3(12697) c4(38811, 51868, 64925, 25754, 77982) c5(gG, by, A, b, X, EM, sE, di, iG, jC, U, e, y, d, jh, co, cVb, kH, jd, re, f, F, q, bu, fr, Mr, ik, B, cs, hV, av, fy, u, o, jB, fU, kF, V, il, J, ad, bQ, T, aX, nP, ft, JY, jE, nV, iP, bm, QG, hT, DO, nJ, ag, QI, iT, bq); #c1(YARS2) c2(NP_001035526) c3(12698) c4(38812, 51869, 64926, 25755, 77983) c5(aNN, cG, kU, cVc, Y, cxJ, oD); #c1(YBX2) c2(NP_057066) c3(12699) c4(38813, 51870, 64927, 25756, 77984) c5(aMC, wV, NT, am, wn, Lu, wP); #c1(YBX3) c2(NP_001138898) c3(12700) c4(38814, 51871, 64928, 25757, 77985) c5(awa, b, Pv, h, q, HM, pR, jT, u, dh, y); #c1(YDJC) c2(NP_001017964) c3(12701) c4(38815, 51872, 64929, 25758, 77986) c5(da, ig); #c1(YEATS4) c2(NP_006521) c3(12702) c4(38816, 51873, 64930, 25759, 77987) c5(qf, co, k, w, di, bo, fT, fy, D); #c1(YES1) c2(XP_011524038) c3(12703) c4(38817, 51874, 64931, 25760, 77988) c5(by, fl, aX, b, f, q, bu, ag, P, w, cs, bq, ad, u); #c1(YIF1A) c2(NP_065203) c3(12704) c4(38818, 51875, 64932, 25761, 77989) c5(bm); #c1(YIPF1) c2(XP_011539907) c3(12705) c4(38819, 51876, 64933, 25762, 77990) c5(h); #c1(YIPF3) c2(NP_056203) c3(12706) c4(38820, 51877, 64934, 25763, 77991) c5(cUP, dB); #c1(YIPF5) c2(NP_001020118) c3(12707) c4(38821, 51878, 64935, 25764, 77992) c5(ig, fl); #c1(YKT6) c2(NP_006546) c3(12708) c4(38822, 51879, 64936, 25765, 77993) c5(u); #c1(YLPM1) c2(NP_062535) c3(12709) c4(38823, 51880, 64937, 25766, 77994) c5(u, Bj, y); #c1(YME1L1) c2(NP_001240795)

c3(12710) c4(38824, 51881, 64938, 25767, 77995) c5(aC, HK, al, f, jU); #c1(YPEL1) c2(NP_037445) c3(12711) c4(38825, 51882, 64939, 25768, 77996) c5(u); #c1(YPEL2) c2(NP_001005404) c3(12712) c4(38826, 51883, 64940, 25769, 77997) c5(u, y); #c1(YPEL3) c2(NP_001138996) c3(12713) c4(38827, 51884, 64941, 25770, 77998) c5(X, ad, ar, cs, x, at, u, y); #c1(YPEL4) c2(NP_659445) c3(12714) c4(38828, 51885, 64942, 25771, 77999) c5(u); #c1(YPEL5) c2(NP_001120872) c3(12715) c4(38829, 51886, 64943, 25772, 78000) c5(u, ac); #c1(YTHDC1) c2(NP_001026902) c3(12716) c4(38830, 51887, 64944, 25773, 78001) c5(cU, iA, EM, b); #c1(YTHDC2) c2(NP_073739) c3(12717) c4(38831, 51888, 64945, 25774, 78002) c5(qt); #c1(YWHAB) c2(NP_647539) c3(12718) c4(38832, 51889, 64946, 25775, 78003) c5(eJ, by, iy, b, m, GS, cz, cT, ji, bu, O, fh); #c1(YWHAE) c2(NP_006752) c3(12719) c4(38833, 51890, 64947, 25776, 78004) c5(ux, afE, aiF, pF, b, dB, pz, Tw, G, JE, A, NH, jV, pK, eM, bdZ, aw, O, bu, ps, eV, cM, yt, aev, jT, aX, kT, t, h, ak, N, q, n, gT, M, y, iv, kX, jG, ji, hD, pH, aiH, JI, ae, FR, kt, cs, FT, J, bp, ad, jo, Q, fO, bM, Vm, cK, oV, wd, pJ, pc, pq, P, iw, NG, cz, u, MP, pj, by, cT, qP, fg, aEj, biO, acb, aeu, ci, pv); #c1(YWHAG) c2(NP_036611) c3(12720) c4(38834, 51891, 64948, 25777, 78005) c5(wh, co, hX, bK, aq, nU, blz, fw, bp, oJ, ji, aV, u, y, aIM); #c1(YWHAH) c2(NP_003396) c3(12721) c4(38835, 51892, 64949, 25778, 78006) c5(fl, hW, b, ch, tW, ak, F, M, w, bj, cK, u); #c1(YWHAQ) c2(NP_006817) c3(12722) c4(38836, 51893, 64950, 25779, 78007) c5(aaQ, ao, u, bK, HN, v, gL, eo, acE, m, cT, eJ, Pn, aaR, ai, bp, aaH, o, cc); #c1(YWHAZ) c2(NP_001129172) c3(12723) c4(38837, 51894, 64951, 25780, 78008) c5(dx, B, aw, eC, hC, et, bf, e, aAt, dv, cy, aD, mz, aC, bK, du, bp, zU, cV, x, Yp, aaz, fD, bq, aA, fl, X, Id, PE, U, xw, y, co, RD, f, bu, cs, av, fy, bm, fi, ali, YD, V, cJ, NZ, v, gv, ny, JY, dP, cz, ji, ap, b, aF, ey, d, Ag, q, u, dh, o, kF, qA, by, Fo, ZF, axi, kS, bZn, jU, jH, aO, I, bL, A, ka, di, bj, auC, F, aV, dj, Eg, be, W, T, HK, ad, aM, Af, bh, at, gf, bUs); #c1(YY1AP1) c2(NP_001185832) c3(12724) c4(38838, 51895, 64952, 25781, 78009) c5(A, b, X, gG, di, iG, U, y, jh, aX, B, q, bu, aW, cs, av, fy, bm, V, by, QI, jC, ad, jE, u, DO, ag, bq); #c1(YY1) c2(NP_003394) c3(12725) c4(38839, 51896, 64953, 25782, 78010) c5(jJ, akQ, A, b, X, bge, ey, iP, Mz, aN, EN, ig, bgd, lv, iL, cO, bf, U, aK, yw, cM, aqQ, awa, co, aX, kJ, jd, t, h, nU, yh, q, M, fr, ra, y, bqb, iv, av, sK, u, aE, iT, n, bga, V, I, B, aC, ft, cs, dB, J, fO, ad, dj, P, jG, T, mD, cy, O, RV, aM, bgc, G, jT, Y, pP, ie, Ck, bcR, ih, m, cT, pI, di, aA, jI, aDD); #c1(ZACN) c2(NP_851321) c3(12726) c4(38840, 51897, 64954, 25783, 78011) c5(d, iF, e, I, b, X, mB, F, mq, W, yE, T, mF, tl, Km, Dd, av, ZU, u, ey, y); #c1(ZAK) c2(NP_598407) c3(12727) c4(38841, 51898, 64955, 25784, 78012) c5(P, G, co, aw, kJ, t, h, cs, To, gm, fO, ad, ag, cT, w, cO, bb, jT, u, ask); #c1(ZAP70) c2(NP_001070) c3(12728) c4(38842, 51899, 64956, 25785, 78013) c5(A, b, k, ie, eu, Xo, bRh, Ou, baQ, ps, O, BO, amY, G, Im, BI, t, re, aDm, fH, jG, iT, aBz, Ov, m, aC, be, gm, J, GB, P, T, cVd, cVe, jT, fJ, alf, pp, SJ, ala, aEa, cT, CL, gR, ry, alg, pv); #c1(ZAR1) c2(NP_783318) c3(12729) c4(38843, 51900, 64957, 25786, 78014) c5(g, re, aX, iT, b); #c1(ZAR1L) c2(NP_001130043) c3(12730) c4(38844, 51901, 64958, 25787, 78015) c5(u, y); #c1(ZASP) c2(NP_001276862) c3(12731) c4(38845, 51902, 64959, 25788, 78016) c5(WG, oD, f, mR, cK); #c1(ZBED1) c2(NP_001164606) c3(12732) c4(38846, 51903, 64960, 25789, 78017) c5(Fp, A, aeq, b, dk, f, afz, T, B, fl, ar); #c1(ZBED4) c2(NP_055653) c3(12733) c4(38847, 51904, 64961, 25790, 78018) c5(vu, fl); #c1(ZBED5) c2(NP_001137139) c3(12734) c4(38848, 51905, 64962, 25791, 78019) c5(di, I, Eg, dA); #c1(ZBP1) c2(NP_001153890) c3(12735) c4(38849, 51906, 64963, 25792, 78020) c5(m, b, mW, Eo, j, at, u, gI, y); #c1(ZBTB10) c2(NP_001099009) c3(12736) c4(38850, 51907, 64964, 25793, 78021) c5(u, by, hM, y, bu); #c1(ZBTB12) c2(NP_862825) c3(12737) c4(38851, 51908, 64965, 25794, 78022) c5(da, m, q, aV, aE, aW); #c1(ZBTB14) c2(NP_001137295) c3(12738) c4(38852, 51909, 64966, 25795, 78023) c5(Bu); #c1(ZBTB16) c2(NP_001018011) c3(12739) c4(38853, 51910, 64967, 25796, 78024) c5(A, cY, cr, bb, cA, U, cVf, jI, h, B, jV, lb, pB, jG, zW, V, aC, J, ll, aX, av, X, re); #c1(ZBTB17) c2(XP_011540387) c3(12740) c4(38854, 51911, 64968, 25797, 78025) c5(Bd, b, cV, X, f, gm, mR, av, jT); #c1(ZBTB18) c2(NP_991331) c3(12741) c4(38855, 51912, 64969, 25798, 78026) c5(g, jR, cVg, cVh, eg, vI); #c1(ZBTB20) c2(NP_001157814) c3(12742) c4(38856, 51913, 64970, 25799, 78027) c5(jE, co, aw, cVi, q, bu, fy, eO, by, bm); #c1(ZBTB21) c2(NP_001091872) c3(12743) c4(38857, 51914, 64971, 25800, 78028) c5(at, aq); #c1(ZBTB22) c2(NP_001138810) c3(12744) c4(38858, 51915, 64972, 25801, 78029) c5(m); #c1(ZBTB24) c2(NP_055612) c3(12745) c4(38859, 51916, 64973, 25802, 78030) c5(b, cVj, bm, nU, q, u, y); #c1(ZBTB2) c2(NP_065912) c3(12746) c4(38860, 51917, 64974, 25803, 78031) c5(U, by, V, bu); #c1(ZBTB32) c2(NP_055198) c3(12747) c4(38861, 51918, 64975, 25804, 78032) c5(lb, oM, jV, pt); #c1(ZBTB33) c2(NP_006768) c3(12748) c4(38862, 51919, 64976, 25805, 78033) c5(x, ar, b); #c1(ZBTB34) c2(NP_001092740) c3(12749) c4(38863, 51920, 64977, 25806, 78034) c5(ag); #c1(ZBTB38) c2(NP_001073881) c3(12750) c4(38864, 51921, 64978, 25807, 78035) c5(eJ, xr, A, eo); #c1(ZBTB41) c2(NP_919290) c3(12751) c4(38865, 51922, 64979, 25808, 78036) c5(aW); #c1(ZBTB46) c2(XP_005260254) c3(12752) c4(38866, 51923, 64980, 25809, 78037) c5(aV, O); #c1(ZBTB48) c2(XP_011539612) c3(12753) c4(38867, 51924, 64981, 25810, 78038) c5(b, cV); #c1(ZBTB49) c2(NP_660334) c3(12754) c4(38868, 51925, 64982, 25811, 78039) c5(f); #c1(ZBTB4) c2(NP_065950) c3(12755) c4(38869, 51926, 64983, 25812, 78040) c5(ag, A, u, B, y); #c1(ZBTB5) c2(NP_055687) c3(12756) c4(38870, 51927, 64984, 25813, 78041) c5(bOO, cB); #c1(ZBTB7C) c2(NP_001034449) c3(12757) c4(38871, 51928, 64985, 25814, 78042) c5(bP, em, fD, I, mz, jd, re, eX, cs, ad, jo, ff, aM, bf, Hh, ey, at, P, aA, ap); #c1(ZBTB9) c2(NP_689948) c3(12758) c4(38872, 51929, 64986, 25815, 78043) c5(l, m); #c1(ZC2HC1B) c2(NP_001013645) c3(12759) c4(38873, 51930, 64987, 25816, 78044) c5(bb); #c1(ZC3H10) c2(NP_116175) c3(12760) c4(38874, 51931, 64988, 25817, 78045) c5(j); #c1(ZC3H11A) c2(NP_055642) c3(12761) c4(38875, 51932, 64989, 25818, 78046) c5(di, Bu, u, y); #c1(ZC3H12C) c2(NP_203748) c3(12762) c4(38876, 51933, 64990, 25819, 78047) c5(da, ed); #c1(ZC3H12D) c2(NP_997243) c3(12763) c4(38877, 51934, 64991, 25820, 78048) c5(co, cr, ad, cs, et, jT, cq); #c1(ZC3H14) c2(NP_001153575) c3(12764) c4(38878, 51935, 64992, 25821, 78049) c5(HN); #c1(ZC3H15) c2(NP_060941) c3(12765) c4(38879, 51936, 64993, 25822, 78050) c5(h, J); #c1(ZC3H3) c2(NP_055932) c3(12766) c4(38880, 51937, 64994, 25823, 78051) c5(bb); #c1(ZC3H4) c2(NP_055983) c3(12767) c4(38881, 51938, 64995, 25824, 78052) c5(dA); #c1(ZC3H7A) c2(NP_054872) c3(12768) c4(38882, 51939, 64996, 25825, 78053) c5(b, Tw); #c1(ZC3H7B) c2(NP_060060) c3(12769) c4(38883, 51940, 64997, 25826, 78054) c5(BT, Tw); #c1(ZC3HAV1) c2(NP_064504) c3(12770) c4(38884, 51941, 64998, 25827, 78055) c5(P, y, iL, aV, u, Bj); #c1(ZC3HC1) c2(NP_001269119) c3(12771)

c4(38885, 51942, 64999, 25828, 78056) c5(dx, dv, du, at, aC); #c1(Zc4H2) c2(NP_001171504) c3(12772) c4(38886, 51943, 65000, 25829, 78057) c5(Iv, nU, cVk, pI); #c1(ZCCHC11) c2(XP_011539402) c3(12773) c4(38887, 51944, 65001, 25830, 78058) c5(b); #c1(ZCCHC12) c2(NP_776159) c3(12774) c4(38888, 51945, 65002, 25831, 78059) c5(nz); #c1(ZCCHC14) c2(NP_055959) c3(12775) c4(38889, 51946, 65003, 25832, 78060) c5(axf); #c1(ZCCHC2) c2(NP_060212) c3(12776) c4(38890, 51947, 65004, 25833, 78061) c5(aC, en, fl, cO); #c1(ZCCHC3) c2(NP_149080) c3(12777) c4(38891, 51948, 65005, 25834, 78062) c5(ak); #c1(ZCCHC6) c2(NP_001171988) c3(12778) c4(38892, 51949, 65006, 25835, 78063) c5(cp); #c1(ZCCHC8) c2(NP_060082) c3(12779) c4(38893, 51950, 65007, 25836, 78064) c5(n0); #c1(ZCRB1) c2(NP_149105) c3(12780) c4(38894, 51951, 65008, 25837, 78065) c5(cVI, q); #c1(ZCWPW1) c2(NP_001244937) c3(12781) c4(38895, 51952, 65009, 25838, 78066) c5(aW); #c1(ZDBF2) c2(NP_065974) c3(12782) c4(38896, 51953, 65010, 25839, 78067) c5(fU); #c1(ZDHHC11) c2(NP_079062) c3(12783) c4(38897, 51954, 65011, 25840, 78068) c5(fx, i); #c1(ZDHHC12) c2(NP_116188) c3(12784) c4(38898, 51955, 65012, 25841, 78069) c5(si); #c1(ZDHHC13) c2(NP_001001483) c3(12785) c4(38899, 51956, 65013, 25842, 78070) c5(afW, si, aT, bb, cp); #c1(ZDHHC14) c2(NP_078906) c3(12786) c4(38900, 51957, 65014, 25843, 78071) c5(A, B, b); #c1(ZDHHC15) c2(NP_001139728) c3(12787) c4(38901, 51958, 65015, 25844, 78072) c5(nz, cVm, si, sp); #c1(ZDHHC17) c2(NP_056151) c3(12788) c4(38902, 51959, 65016, 25845, 78073) c5(si); #c1(ZDHHC1) c2(NP_037436) c3(12789) c4(38903, 51960, 65017, 25846, 78074) c5(aC, at, di, aE, I); #c1(ZDHHC2) c2(NP_057437) c3(12790) c4(38904, 51961, 65018, 25847, 78075) c5(aX, b, aC, q, bu, by, bm, JY); #c1(ZDHHC7) c2(NP_001139020) c3(12791) c4(38905, 51962, 65019, 25848, 78076) c5(y); #c1(ZDHHC8) c2(NP_037505) c3(12792) c4(38906, 51963, 65020, 25849, 78077) c5(ahi, afb, iP, K, iG, bj); #c1(ZDHHC9) c2(NP_001008223) c3(12793) c4(38907, 51964, 65021, 25850, 78078) c5(fi, V, b, cVn, ar, x, U); #c1(ZEB1) c2(NP_001121600) c3(12794) c4(38908, 51965, 65022, 25851, 78079) c5(gG, is, by, An, aw, iG, b, X, QB, iP, jz, at, w, kY, U, ba, A, fx, boz, aIP, d, jh, co, aX, aSW, cVp, hV, e, q, bu, cU, fr, bmI, ji, y, cs, av, fy, u, LK, yJ, fi, fU, V, m, cVo, ad, T, pt, x, iA, ft, jQ, nV, iK, rS, kJ, in, B, ag, jT, i, oM, aOB, kD); #c1(ZEB2) c2(NP_001165124) c3(12795) c4(38909, 51966, 65023, 25852, 78080) c5(fr, dM, b, WW, iP, ahS, dB, jf, A, iG, O, U, e, y, d, aIS, aX, bTc, nU, F, q, bu, X, kz, Gs, boz, gg, av, fy, u, ff, yJ, fU, V, jh, ft, cs, bjS, J, jo, ahO, T, cr, fx, ad, PH, Tu, iK, aY, bm, Bu, P, B, by, ag, i, OA, aAp); #c1(ZFAND3) c2(NP_068762) c3(12796) c4(38910, 51967, 65024, 25853, 78081) c5(l); #c1(ZFAND5) c2(NP_001095891) c3(12797) c4(38911, 51968, 65025, 25854, 78082) c5(A); #c1(ZFAND6) c2(NP_001229846) c3(12798) c4(38912, 51969, 65026, 25855, 78083) c5(awr, Pz, I, aC, mk, di, at, aE); #c1(ZFAT) c2(NP_001025110) c3(12799) c4(38913, 51970, 65027, 25856, 78084) c5(iq, yV, I, aC, di, cLI, Lz, at, iu, aE); #c1(ZFC3H1) c2(NP_659419) c3(12800) c4(38914, 51971, 65028, 25857, 78085) c5(at); #c1(ZFHX2) c2(XP_006720345) c3(12801) c4(38915, 51972, 65029, 25858, 78086) c5(dA); #c1(ZFHX3) c2(NP_001158238) c3(12802) c4(38916, 51973, 65030, 25859, 78087) c5(A, lo, b, ql, bf, y, bb, re, B, F, q, bu, mL, aO, as, bm, iT, fh, dA, an, sX, by, cV, u, bq, at, ap); #c1(ZFHX4) c2(XP_011515897) c3(12803) c4(38917, 51974, 65031, 25860, 78088) c5(KW, jq, w, O, cVq); #c1(ZFP1) c2(XP_011521223) c3(12804) c4(38918, 51975, 65032, 25861, 78089) c5(A, cB, B, b, cp); #c1(ZFP30) c2(NP_055713) c3(12805) c4(38919, 51976, 65033, 25862, 78090) c5(bb); #c1(ZFP36) c2(NP_003398) c3(12806) c4(38920, 51977, 65034, 25863, 78091) c5(dx, A, jT, b, w, Ku, iL, Eh, bf, O, y, Ej, ed, dv, Ec, re, eX, F, q, jV, dI, afW, ky, cM, cs, u, iT, DU, fi, be, Ea, Ib, du, hv, J, W, P, T, Il, ad, qD, aM, jE, eE, bm, fD, fI, aC, aA, at); #c1(ZFP36L1) c2(NP_001231630) c3(12807) c4(38921, 51978, 65035, 25864, 78092) c5(DE, aiT, t, ie, cU, ig, G, ar, av, aV, u, y); #c1(ZFP3GL2) c2(NP_008818) c3(12808) c4(38922, 51979, 65036, 25865, 78093) c5(d, jT, A, b, t, h, ie, J, G, od, fy, iv, Dd, QJ, u, e, y); #c1(ZFP37) c2(NP_001269444) c3(12809) c4(38923, 51980, 65037, 25866, 78094) c5(atj, cwc, f, cVr); #c1(ZFP42) c2(NP_001291287) c3(12810) c4(38924, 51981, 65038, 25867, 78095) c5(Dr, wV, A, IO, b, B, jz, dB, nJ, Uq, wP, w, T, ff, HE, Mn, fp, O, jQ); #c1(ZFP57) c2(XP_006715150) c3(12811) c4(38925, 51982, 65039, 25868, 78096) c5(m, dA, mB, mq, w, ix, bf, mF, aE, aM); #c1(ZFP64) c2(NP_060667) c3(12812) c4(38926, 51983, 65040, 25869, 78097) c5(ao, bu); #c1(ZFP82) c2(NP_597723) c3(12813) c4(38927, 51984, 65041, 25870, 78098) c5(by, bu); #c1(ZFP91) c2(NP_444251) c3(12814) c4(38928, 51985, 65042, 25871, 78099) c5(h); #c1(ZFPM1) c2(NP_722520) c3(12815) c4(38929, 51986, 65043, 25872, 78100) c5(Ei, aGk, Ck, bzF, i, l, pz, pq); #c1(ZFPM2) c2(NP_036214) c3(12816) c4(38930, 51987, 65044, 25873, 78101) c5(cj, fe, cVs, aLv, wp, afg, X, cV, wN, cVt, acw, aLq, agd, Ni, cO, cr, Mw, UR, ci, n); #c1(ZFR2) c2(NP_001139112) c3(12817) c4(38931, 51988, 65045, 25874, 78102) c5(di); #c1(ZFR) c2(NP_057191) c3(12818) c4(38932, 51989, 65046, 25875, 78103) c5(ti); #c1(ZFX) C2(NP_001171557) c3(12819) c4(38933, 51990, 65047, 25876, 78104) c5(A, wp, b, B, q, bu, O, Ez, fy, Fr, by, u, y); #c1(ZFY) c2(NP_001138747) c3(12820) c4(38934, 51991, 65048, 25877, 78105) c5(bfo, wp, aq, bfm, Fr, agd, ar, Dv, cIY, PH, UR); #c1(ZFYVE19) c2(NP_001070736) c3(12821) c4(38935, 51992, 65049, 25878, 78106) c5(J); #c1(ZFYVE21) c2(NP_001185882) c3(12822) c4(38936, 51993, 65050, 25879, 78107) c5(aX, ic); #c1(ZFYVE26) c2(NP_056161) c3(12823) c4(38937, 51994, 65051, 25880, 78108) c5(cb, nQ, hS, u, KA, nU, QC, bN, uI, bcZ, cIA, kS, y); #c1(ZFYVE27) c2(NP_001002261) c3(12824) c4(38938, 51995, 65052, 25881, 78109) c5(cVu, bN); #c1(ZFYVE28) c2(NP_001166127) c3(12825) c4(38939, 51996, 65053, 25882, 78110) c5(Eo); #c1(ZFYVE9) c2(XP_011540739) c3(12826) c4(38940, 51997, 65054, 25883, 78111) c5(gG, en, b, X, sB, F, gm, uH, A, aC, aoe, aZ, av, akB, u, U, y); #c1(ZG16B) c2(NP_660295) c3(12827) c4(38941, 51998, 65055, 25884, 78112) c5(bw, b, ag); #c1(ZGLP1) C2(NP_001096637) c3(12828) c4(38942, 51999, 65056, 25885, 78113) c5(id, I, mD, bII, rr, eu, aE, gF, aM, bh, bf, ey, at, aA, ap); #c1(ZGPAT) c2(NP_001076582) c3(12829) c4(38943, 52000, 65057, 25886, 78114) c5(A, I, pS, aC, f, q, fP, ag, zN, di, B, yM, bf, at, kD, aE, O, aM); #c1(ZHX1) c2(NP_009153) c3(12830) c4(38944, 52001, 65058, 25887, 78115) c5(by, bu); #c1(ZHX2) c2(XP_011515234) c3(12831) c4(38945, 52002, 65059, 25888, 78116) c5(QL, pm, hV, b, k, cY, EM, HG, mk, A, O, cA, fs, U, adr, nP, y, M, co, aX, QE, h, f, q, bu, cU, gX, ar, RF, aaR, cs, nB, fH, jG, fy, u, zi, kP, g, og, nV, V, cyp, J, fO, ad, Ce, T, jC, nF, ft, Ut, gQ, jE, qp, aen, fr, bm, kJ, DO, B, by, ag, fJ, QI, yA, eG, zD); #c1(ZIC1) c2(NP_003403) c3(12832) c4(38946, 52003, 65060, 25889, 78117) c5(KC, IJ, b, og, bo, Nw, hP, U, co, XE, hV, q, bu, Zh, cs, aV, g, fU, V, bK, by, MW, ad, atn, nV, aai, jR, oi); #c1(ZIC2) c2(NP_009060) c3(12833)

c4(38947, 52004, 65061, 25890, 78118) c5(d, MW, IJ, fU, asQ, V, aai, FR, bPw, bK, re, Bu, jR, cU, A, dV, bPL, U, e, iT, XE); #c1(ZIC3) c2(NP_003404) c3(12834) c4(38948, 52005, 65062, 25891, 78119) c5(iw, IJ, byh, cr, dA, nX, ckp, cVv, mx, brg, aMZ, bgM, hN, Gs, CI, ho, AP, at); #c1(ZIc4) c2(NP_001161850) c3(12835) c4(38949, 52006, 65063, 25892, 78120) c5(atn, Nw, fU, MW, XE); #c1(ZIC5) c2(NP_149123) c3(12836) c4(38950, 52007, 65064, 25893, 78121) c5(AP, XE, aai, FR); #c1(ZIK1) C2(NP_001010879) c3(12837) c4(38951, 52008, 65065, 25894, 78122) c5(b); #c1(ZIM2) c2(NP_001139799) c3(12838) c4(38952, 52009, 65066, 25895, 78123) c5(rb); #c1(ZKSCAN1) c2(NP_001273983) c3(12839) c4(38953, 52010, 65067, 25896, 78124) c5(by, eX, cOQ, mF, bu); #c1(ZKSCAN3) c2(NP_001229824) c3(12840) c4(38954, 52011, 65068, 25897, 78125) c5(A, V, b, f, fO, ad, Kz, B, cs, U); #c1 (ZKSCAN7) c2(NP_001275520) c3(12841) c4(38955, 52012, 65069, 25898, 78126) c5(wh, b, cV, Ls, vD, oJ, cO, bf, aM); #c1(ZMAT3) c2(XP_005247763) c3(12842) c4(38956, 52013, 65070, 25899, 78127) c5(d, jh, il, b, cV, ad, cT, ik, HS, cs, QJ, e); #c1(ZMAT4) c2(NP_001129203) c3(12843) c4(38957, 52014, 65071, 25900, 78128) c5(Bu, Bt, bj, ak); #c1(ZMIZ1) c2(NP_065071) c3(12844) c4(38958, 52015, 65072, 25901, 78129) c5(d, QD, I, b, jH, t, ak, e, q, qB, J, da, ig, qi, fP, ic, ad, aV, u, aE, y); #c1(ZMYM2) c2(XP_011533519) c3(12845) c4(38959, 52016, 65073, 25902, 78130) c5(jE, aw, lb, pz, btA, N, q, fO, bu, X, T, iL, fg, av, by, bm, nz); #c1(ZMYM3) c2(NP_001164633) c3(12846) c4(38960, 52017, 65074, 25903, 78131) c5(nz, cT, jR); #c1(ZMYM4) c2(XP_011540726) c3(12847) c4(38961, 52018, 65075, 25904, 78132) c5(d, ar, e); #c1(ZMYM5) c2(NP_001034738) c3(12848) c4(38962, 52019, 65076, 25905, 78133) c5(kF); #c1(ZMYND10) c2(NP_056980) c3(12849) c4(38963, 52020, 65077, 25906, 78134) c5(gG, en, b, k, X, aiW, jc, fx, O, d, jh, co, bxB, f, q, e, cU, ar, n, av, fy, iT, Pu, cV, bp, MW, Nz, T, II, cVw, iA, agQ, i, ci); #c1(ZMYND11) c2(NP_001189394) c3(12850) c4(38964, 52021, 65078, 25907, 78135) c5(bq, nU, u, y, cz); #c1 (ZMYND8) c2(NP_001268698) c3(12851) c4(38965, 52022, 65079, 25908, 78136) c5(A, B, I); #c1(ZNF106) c2(NP_001271236) c3(12852) c4(38966, 52023, 65080, 25909, 78137) c5(dA); #c1(ZNF107) c2(NP_001013768) c3(12853) c4(38967, 52024, 65081, 25910, 78138) c5(P); #c1(ZNF10) c2(NP_056209) c3(12854) c4(38968, 52025, 65082, 25911, 78139) c5(hX); #c1(ZNF112) c2(NP_001076804) c3(12855) c4(38969, 52026, 65083, 25912, 78140) c5(m); #c1(ZNF121) c2(XP_011526569) c3(12856) c4(38970, 52027, 65084, 25913, 78141) c5(Dr, hV, nV); #c1(ZNF131) c2(NP_001284477) c3(12857) c4(38971, 52028, 65085, 25914, 78142) c5(fl, u, y); #c1 (ZNF132) c2(NP_003424) c3(12858) c4(38972, 52029, 65086, 25915, 78143) c5(fh, at, bb, bq, ap); #c1(ZNF133) c2(NP_001269925) c3(12859) c4(38973, 52030, 65087, 25916, 78144) c5(acH); #c1(ZNF141) c2(NP_003432) c3(12860) c4(38974, 52031, 65088, 25917, 78145) c5(si, zW, axK, cVx, fH, fJ); #c1(ZNF143) c2(NP_001269585) c3(12861) c4(38975, 52032, 65089, 25918, 78146) c5(A, cOQ, b, B, ad, co, aIM, cs, mF); #c1(ZNF146) c2(XP_005259271) c3(12862) c4(38976, 52033, 65090, 25919, 78147) c5(T); #c1(ZNF148) c2(NP_068799) c3(12863) c4(38977, 52034, 65091, 25920, 78148) c5(dx, qs, co, aX, awX, du, q, dv, iL, x, bm, eg); #c1(ZNF154) c2(NP_001078853) c3(12864) c4(38978, 52035, 65092, 25921, 78149) c5(fx, aw, i); #c1(ZNF160) c2(XP_005259436) c3(12865) c4(38979, 52036, 65093, 25922, 78150) c5(A, bpu, bu); #c1(ZNF169) c2(NP_003439) c3(12866) c4(38980, 52037, 65094, 25923, 78151) c5(aIm, dA); #c1(ZNF175) c2(NP_009078) c3(12867) c4(38981, 52038, 65095, 25924, 78152) c5(aC, hZ, CR, gL, P, amW); #c1(ZNF177) c2(NP_001166122) c3(12868) c4(38982, 52039, 65096, 25925, 78153) c5(bu); #c1(ZNF182) c2(NP_001007089) c3(12869) c4(38983, 52040, 65097, 25926, 78154) c5(jx); #c1(ZNF184) c2(NP_009080) c3(12870) c4(38984, 52041, 65098, 25927, 78155) c5(cV); #c1(ZNF185) c2(NP_001171586) c3(12871) c4(38985, 52042, 65099, 25928, 78156) c5(wh, co, B, bp, A, vx, oJ); #c1(ZNF189) c2(NP_001265160) c3(12872) c4(38986, 52043, 65100, 25929, 78157) c5(d, fx, e, i); #c1(ZNF197) c2(NP_001020026) c3(12873) c4(38987, 52044, 65101, 25930, 78158) c5(Dr, wa, nV, aX, f, jd, hV, q, fO, J, jF, n, iv, aA, fy); #c1(ZNF202) c2(NP_001288709) c3(12874) c4(38988, 52045, 65102, 25931, 78159) c5(dx dv, du, bu, bq, at, fp); #c1(ZNF205) c2(XP_005255615) c3(12875) c4(38989, 52046, 65103, 25932, 78160) c5(kF); #c1(ZNF20) c2(NP_066966) c3(12876) c4(38990, 52047, 65104, 25933, 78161) c5(Dr, hV, nV); #c1(ZNF212) c2(NP_036388) c3(12877) c4(38991, 52048, 65105, 25934, 78162) c5(at); #c1 (ZNF214) c2(XP_006718371) c3(12878) c4(38992, 52049, 65106, 25935, 78163) c5(Bl, yy, NT); #c1(ZNF215) c2(NP_037382) c3(12879) c4(38993, 52050, 65107, 25936, 78164) c5(Bl, yy, mF, bAJ); #c1(ZNF217) c2(NP_006517) c3(12880) c4(38994, 52051, 65108, 25937, 78165) c5(hg, IO, b, X, fE, w, O, B, bu, y, cs, avh, av, u, V, dT, by, W, T, J, ad, i); #c1(ZNF224) c2(XP_005259278) c3(12881) c4(38995, 52052, 65109, 25938, 78166) c5(fx, fe, i, o); #c1(ZNF22) c2(NP_008894) c3(12882) c4(38996, 52053, 65110, 25939, 78167) c5(cVy); #c1(ZNF230) c2(XP_011525595) c3(12883) c4(38997, 52054, 65111, 25940, 78168) c5(l, wn, ie, i); #c1(ZNF236) c2(NP_031371) c3(12884) c4(38998, 52055, 65112, 25941, 78169) c5(bf, f, et, cV, aM); #c1(ZNF239) c2(XP_011538534) c3(12885) c4(38999, 52056, 65113, 25942, 78170) c5(l, cp); #c1 (ZNF23) c2(NP_001291421) c3(12886) c4(39000, 52057, 65114, 25943, 78171) c5(h, bb, q, b); #c1(ZNF248) c2(XP_011517899) c3(12887) c4(39001, 52058, 65115, 25944, 78172) c5(Dd, GQ, od, gm); #c1(ZNF24) c2(NP_008896) c3(12888) c4(39002, 52059, 65116, 25945, 78173) c5(b, u, q, aIM, bm, y); #c1(ZNF253) c2(NP_066385) c3(12889) c4(39003, 52060, 65117, 25946, 78174) c5(fn, b, k, eu, bg, w, iL, xw, aoa, h, f, q, M, Xi, Cp, Qx, jB, wB, v, j, J, P, T, II, avY, cq, ao, PY, Dj, fl); #c1(ZNF260) c2(NP_001012774) c3(12890) c4(39004, 52061, 65118, 25947, 78175) c5(bE, bK, nf, bB, mY, ajH); #c1(ZNF263) c2(NP_005732) c3(12891) c4(39005, 52062, 65119, 25948, 78176) c5(dx, dv, du); #c1(ZNF264) c2(NP_003408) c3(12892) c4(39006, 52063, 65120, 25949, 78177) c5(at, dA); #c1(ZNF266) c2(NP_006622) c3(12893) c4(39007, 52064, 65121, 25950, 78178) c5(A, cB, B, b, cp); #c1(ZNF267) c2(NP_001252517) c3(12894) c4(39008, 52065, 65122, 25951, 78179) c5(mk, bh, Pz, q, gv); #c1 (ZNF268) c2(NP_001159353) c3(12895) c4(39009, 52066, 65123, 25952, 78180) c5(cW, re, J, iT); #c1(ZNF273) c2(NP_066971) c3(12896) c4(39010, 52067, 65124, 25953, 78181) c5(aPt); #c1(ZNF274) c2(NP_057409) c3(12897) c4(39011, 52068, 65125, 25954, 78182) c5(HS); #c1 (ZNF276) c2(NP_001106997) c3(12898) c4(39012, 52069, 65126, 25955, 78183) c5(oM, pt); #c1(ZNF277) c2(NP_068834) c3(12899) c4(39013, 52070, 65127, 25956, 78184) c5(oy, cs, ad); #c1(ZNF280B) c2(XP_011545198) c3(12900) c4(39014, 52071, 65128, 25957, 78185) c5(A); #c1(ZNF280D) c2(NP_001002843) c3(12901) c4(39015, 52072, 65129, 25958, 78186) c5(bj); #c1(ZNF281)

c2(NP_001268222) c3(12902) c4(39016, 52073, 65130, 25959, 78187) c5(U, aw, V); #c1(ZNF282) c2(NP_001290410) c3(12903) c4(39017, 52074, 65131, 25960, 78188) c5(jz, Iv, jQ); #c1(ZNF286B) c2(NP_001138517) c3(12904) c4(39018, 52075, 65132, 25961, 78189) c5(oy); #c1(ZNF296) c2(NP_660331) c3(12905) c4(39019, 52076, 65133, 25962, 78190) c5(t, h, Fs, J, M, G, O); #c1(ZNF2) c2(NP_001017396) c3(12906) c4(39020, 52077, 65134, 25963, 78191) c5(NX); #c1(ZNF300) c2(NP_001166302) c3(12907) c4(39021, 52078, 65135, 25964, 78192) c5(d, jT, I, hX, e, gm, jV, J, aC, cT, di, at, u, aE, y); #c1(ZNF311) c2(NP_001010877) c3(12908) c4(39022, 52079, 65136, 25965, 78193) c5(aC, m); #c1(ZNF318) c2(NP_055160) c3(12909) c4(39023, 52080, 65137, 25966, 78194) c5(dx, dv, X, du, av, aA, ap); #c1(ZNF320) c2(NP_997216) c3(12910) c4(39024, 52081, 65138, 25967, 78195) c5(n); #c1(ZNF322) c2(NP_001229728) c3(12911) c4(39025, 52082, 65139, 25968, 78196) c5(oy); #c1(ZNF32) c2(NP_001005368) c3(12912) c4(39026, 52083, 65140, 25969, 78197) c5(jT, 8, b, dA); #c1(ZNF330) c2(NP_001278931) c3(12913) c4(39027, 52084, 65141, 25970, 78198) c5(oy, GF, aW, cV); #c1(ZNF331) c2(NP_061025) c3(12914) c4(39028, 52085, 65142, 25971, 78199) c5(by, nV, Pz, b, cV, u, h, cs, q, fO, es, mk, cT, T, ad, fv, J, bu, hP, y); #c1(ZNF334) c2(XP_011527196) c3(12915) c4(39029, 52086, 65143, 25972, 78200) c5(aC, at); #c1(ZNF335) c2(NP_071378) c3(12916) c4(39030, 52087, 65144, 25973, 78201) c5(cVz); #c1(ZNF343) c2(NP_001269424) c3(12917) c4(39031, 52088, 65145, 25974, 78202) c5(Eo); #c1(ZNF350) c2(NP_067645) c3(12918) c4(39032, 52089, 65146, 25975, 78203) c5(g, Ag, X, re, Qz, iT, I, T, Iv, i, x, O, jd, u, y); #c1(ZNF354A) c2(NP_005640) c3(12919) c4(39033, 52090, 65147, 25976, 78204) c5(wV, ma, b, X, wy, wP, BY, ck, fp); #c1(ZNF35) c2(NP_003411) c3(12920) c4(39034, 52091, 65148, 25977, 78205) c5(aX, b, Nv, ag, jo, ff, i, fl, fx, u, y); #c1(ZNF365) c2(NP_055766) c3(12921) c4(39035, 52092, 65149, 25978, 78206) c5(b, cVA, X, fq, f, bu, HQ, fP, y, PT, av, u, yd); #c1(ZNF366) c2(NP_689838) c3(12922) c4(39036, 52093, 65150, 25979, 78207) c5(dx, IV, du, u); #c1(ZNF367) c2(NP_710162) c3(12923) c4(39037, 52094, 65151, 25980, 78208) c5(alm, pR, w, aw, k); #c1(ZNF382) c2(NP_001243767) c3(12924) c4(39038, 52095, 65152, 25981, 78209) c5(T); #c1(ZNF383) c2(XP_011524892) c3(12925) c4(39039, 52096, 65153, 25982, 78210) c5(cy); #c1(ZNF384) c2(NP_001035009) c3(12926) c4(39040, 52097, 65154, 25983, 78211) c5(t, J, G, T, iv, cp); #c1(ZNF385A) c2(NP_001124439) c3(12927) c4(39041, 52098, 65155, 25984, 78212) c5(ml); #c1(ZNF385B) c2(NP_001106868) c3(12928) c4(39042, 52099, 65156, 25985, 78213) c5(ao, nU, Nq, cz, Ns, avY, bf, aA, bj, av, ac); #c1(ZNF385D) c2(NP_078973) c3(12929) c4(39043, 52100, 65157, 25986, 78214) c5(oy, dA, ak, Wh, xq, IL, IV, at, ap); #c1(ZNF391) c2(XP_011512871) c3(12930) c4(39044, 52101, 65158, 25987, 78215) c5(aC); #c1(ZNF395) c2(NP_061130) c3(12931) c4(39045, 52102, 65159, 25988, 78216) c5(m, jE, ax, iq, pp, b, pS, fr, bm, hV, ft, pr, P, nV, bdI, ne, u, aE, y, dH); #c1(ZNF398) c2(NP_065832) c3(12932) c4(39046, 52103, 65160, 25989, 78217) c5(d, co, b, X, B, q, e, P, av, fy, u, yA); #c1(ZNF407) c2(NP_001139661) c3(12933) c4(39047, 52104, 65161, 25990, 78218) c5(dA); #c1(ZNF410) c2(NP_001229853) c3(12934) c4(39048, 52105, 65162, 25991, 78219) c5(iU, eX, pV, V, b, qB, cs, ad, HC, fP, aE, fD, z, Fh, U, U, u, vI, y, n); #c1(ZNF415) c2(NP_001129510) c3(12935) c4(39049, 52106, 65163, 25992, 78220) c5(b); #c1(ZNF419) c2(NP_001091961) c3(12936) c4(39050, 52107, 65164, 25993, 78221) c5(dB); #c1(ZNF41) c2(NP_700359) c3(12937) c4(39051, 52108, 65165, 25994, 78222) c5(hW, nx, nz, nU, xw, jx); #c1(ZNF423) c2(NP_001258549) c3(12938) c4(39052, 52109, 65166, 25995, 78223) c5(cVB, cy, XE, cV, aC, m, xq, iv, jG, u, y); #c1(ZNF430) c2(NP_001166142) c3(12939) c4(39053, 52110, 65167, 25996, 78224) c5(kF); #c1(ZNF432) c2(XP_011525850) c3(12940) c4(39054, 52111, 65168, 25997, 78225) c5(fP, u); #c1(ZNF433) c2(NP_001073880) c3(12941) c4(39055, 52112, 65169, 25998, 78226) c5(aV); #c1(ZNF438) c2(NP_001137240) c3(12942) c4(39056, 52113, 65170, 25999, 78227) c5(aX); #c1(ZNF443) c2(NP_005806) c3(12943) c4(39057, 52114, 65171, 26000, 78228) c5(q); #c1(ZNF444) c2(XP_011525370) c3(12944) c4(39058, 52115, 65172, 26001, 78229) c5(Zc); #c1(ZNF44) c2(NP_001157748) c3(12945) c4(39059, 52116, 65173, 26002, 78230) c5(cOQ, J, fM); #c1(ZNF451) c2(NP_001026794) c3(12946) c4(39060, 52117, 65174, 26003, 78231) c5(lb, A, B, jV, J); #c1(ZNF45) c2(NP_003416) c3(12947) c4(39061, 52118, 65175, 26004, 78232) c5(aV); #c1(ZNF462) c2(NP_067047) c3(12948) c4(39062, 52119, 65176, 26005, 78233) c5(A); #c1(ZNF469) c2(NP_001120936) c3(12949) c4(39063, 52120, 65177, 26006, 78234) c5(fi, aTm, or, aqn, f, cTO, Ij, aOs, aOt, ha); #c1(ZNF483) c2(NP_001007170) c3(12950) c4(39064, 52121, 65178, 26007, 78235) c5(aA); #c1(ZNF490) c2(NP_065765) c3(12951) c4(39065, 52122, 65179, 26008, 78236) c5(ak); #c1(ZNF492) c2(NP_065906) c3(12952) c4(39066, 52123, 65180, 26009, 78237) c5(bq, ba); #c1(ZNF496) c2(NP_116141) c3(12953) c4(39067, 52124, 65181, 26010, 78238) c5(ao); #c1(ZNF501) c2(NP_659481) c3(12954) c4(39068, 52125, 65182, 26011, 78239) c5(cOQ, J, fM); #c1(ZNF507) c2(NP_001129628) c3(12955) c4(39069, 52126, 65183, 26012, 78240) c5(hW, cz); #c1(ZNF512B) c2(NP_065764) c3(12956) c4(39070, 52127, 65184, 26013, 78241) c5(ao); #c1(ZNF512) c2(NP_001258215) c3(12957) c4(39071, 52128, 65185, 26014, 78242) c5(oG); #c1(ZNF513) c2(NP_001188388) c3(12958) c4(39072, 52129, 65186, 26015, 78243) c5(nE, g, vI, cVC); #c1(ZNF516) c2(NP_055458) c3(12959) c4(39073, 52130, 65187, 26016, 78244) c5(I, V); #c1(ZNF519) c2(XP_011523906) c3(12960) c4(39074, 52131, 65188, 26017, 78245) c5(ao); #c1(ZNF521) c2(NP_056276) c3(12961) c4(39075, 52132, 65189, 26018, 78246) c5(g, t, G, J, jR); #c1(ZNF536) c2(NP_055532) c3(12962) c4(39076, 52133, 65190, 26019, 78247) c5(ap, dB, dA); #c1(ZNF555) c2(NP_001166246) c3(12963) c4(39077, 52134, 65191, 26020, 78248) c5(bb); #c1(ZNF559) c2(NP_001189335) c3(12964) c4(39078, 52135, 65192, 26021, 78249) c5(by, bu); #c1(ZNF568) c2(NP_001191766) c3(12965) c4(39079, 52136, 65193, 26022, 78250) c5(at); #c1(ZNF569) c2(NP_689697) c3(12966) c4(39080, 52137, 65194, 26023, 78251) c5(fn, b, k, eu, bg, w, iL, xw, aoa, h, f, q, M, Xi, avY, Cp, Qx, jB, cOQ, wB, v, j, J, P, T, II, fM, cq, ao, PY, Dj, fl); #c1(ZNF577) c2(NP_001129062) c3(12967) c4(39081, 52138, 65195, 26024, 78252) c5(d, ar, e, pF); #c1(ZNF580) c2(NP_057286) c3(12968) c4(39082, 52139, 65196, 26025, 78253) c5(at); #c1(ZNF581) c2(XP_006723303) c3(12969) c4(39083, 52140, 65197, 26026, 78254) c5(at); #c1(ZNF582) c2(NP_653291) c3(12970) c4(39084, 52141, 65198, 26027, 78255) c5(re, Rd, iT); #c1(ZNF583) c2(XP_011524819) c3(12971) c4(39085, 52142, 65199, 26028, 78256) c5(V); #c1(ZNF585B) c2(NP_689492) c3(12972) c4(39086, 52143, 65200, 26029, 78257) c5(cy); #c1(ZNF592) c2(NP_055445) c3(12973) c4(39087, 52144, 65201, 26030, 78258) c5(hR, nU, cVD, bFx); #c1(ZNF596)

c2(XP_011533044) c3(12974) c4(39088, 52145, 65202, 26031, 78259) c5(ac); #c1(ZNF606) c2(NP_079303) c3(12975) c4(39089, 52146, 65203, 26032, 78260) c5(IV); #c1(ZNF607) c2(NP_001166148) c3(12976) c4(39090, 52147, 65204, 26033, 78261) c5(bb); #c1(ZNF608) c2(NP_065798) c3(12977) c4(39091, 52148, 65205, 26034, 78262) c5(aA, cO); #c1(ZNF615) c2(XP_011525128) c3(12978) c4(39092, 52149, 65206, 26035, 78263) c5(bj); #c1(ZNF618) c2(NP_588615) c3(12979) c4(39093, 52150, 65207, 26036, 78264) c5(oy, bb, Ns, et, Nq); #c1(ZNF627) c2(NP_660338) c3(12980) c4(39094, 52151, 65208, 26037, 78265) c5(bq, dD); #c1(ZNF629) c2(NP_001073886) c3(12981) c4(39095, 52152, 65209, 26038, 78266) c5(fn, b, k, eu, bg, w, iL, xw, aoa, h, f, q, M, Xi, avY, Cp, Qx, jB, cOQ, wB, v, j, J, P, T, II, fM, eq, ao, PY, Dj, fl); #c1(ZNF639) c2(NP_001290355) c3(12982) c4(39096, 52153, 65210, 26039, 78267) c5(oy, d, P, e); #c1(ZNF644) c2(XP_011540563) c3(12983) c4(39097, 52154, 65211, 26040, 78268) c5(aso, cVE); #c1(ZNF645) c2(NP_689790) c3(12984) c4(39098, 52155, 65212, 26041, 78269) c5(bP, bL, nU, iL, b, cG, aF, pR, dB, bAr, bg, cc, A, jV, H, O, bf, U, TD, bj, y, rN, co, aX, LI, zk, h, f, q, MV, M, zi, pn, zp, jT, B, pt, pB, n, JY, u, nz, ff, da, em, zj, V, lb, cnV, cs, cnW, gm, kp, v, arB, jo, bTz, T, II, bh, VP, iy, J, ad, ajd, pJ, eJ, jE, fy, Ip, bm, P, BV, eo, ih, ag, cz, agw, fI, aC, oM, aA, et, aIM); #c1(ZNF646) c2(NP_055514) c3(12985) c4(39099, 52156, 65213, 26042, 78270) c5(bj); #c1(ZNF652) c2(NP_001138837) c3(12986) c4(39100, 52157, 65214, 26043, 78271) c5(oy, A, b, di, u, y); #c1(ZNF654) c2(NP_060763) c3(12987) c4(39101, 52158, 65215, 26044, 78272) c5(ck, b, X, eu, w, U, e, O, d, co, aX, pp, hV, q, y, fy, bm, V, T, jC, fp, nV, u, aA); #c1(ZNF664) c2(NP_689650) c3(12988) c4(39102, 52159, 65216, 26045, 78273) c5(bg); #c1(ZNF667) c2(NP_071386) c3(12989) c4(39103, 52160, 65217, 26046, 78274) c5(oy); #c1(ZNF668) c2(NP_078982) c3(12990) c4(39104, 52161, 65218, 26047, 78275) c5(Yi, u, y); #c1(ZNF674) c2(NP_001139763) c3(12991) c4(39105, 52162, 65219, 26048, 78276) c5(nz, nU, nR); #c1(ZNF676) c2(XP_011526034) c3(12992) c4(39106, 52163, 65220, 26049, 78277) c5(ig); #c1(ZNF678) c2(NP_848644) c3(12993) c4(39107, 52164, 65221, 26050, 78278) c5(xr); #c1(ZNF683) c2(XP_011539498) c3(12994) c4(39108, 52165, 65222, 26051, 78279) c5(NB, A, B); #c1(ZNF687) c2(NP_001291693) c3(12995) c4(39109, 52166, 65223, 26052, 78280) c5(h); #c1(ZNF689) c2(NP_612456) c3(12996) c4(39110, 52167, 65224, 26053, 78281) c5(m, jE, bm, g); #c1(ZNF703) c2(NP_079345) c3(12997) c4(39111, 52168, 65225, 26054, 78282) c5(u, y, b); #c1(ZNF704) c2(NP_001028895) c3(12998) c4(39112, 52169, 65226, 26055, 78283) c5(ao, jG, h); #c1(ZNF706) c2(NP_001254638) c3(12999) c4(39113, 52170, 65227, 26056, 78284) c5(c0); #c1(ZNF711) c2(NP_068838) c3(13000) c4(39114, 52171, 65228, 26057, 78285) c5(nz, cVE); #c1(ZNF716) c2(NP_001152751) c3(13001) c4(39115, 52172, 65229, 26058, 78286) c5(Eo, dA); #c1(ZNF717) c2(NP_001277137) c3(13002) c4(39116, 52173, 65230, 26059, 78287) c5(oy, Ks, eO, auz, bf); #c1(ZNF746) c2(NP_001156946) c3(13003) c4(39117, 52174, 65231, 26060, 78288) c5(ao, f); #c1(ZNF74) c2(NP_001243453) c3(13004) c4(39118, 52175, 65232, 26061, 78289) c5(K); #c1(ZNF750) c2(NP_078978) c3(13005) c4(39119, 52176, 65233, 26062, 78290) c5(cVG, da, azW, aOY); #c1(ZNF763) c2(NP_001012771) c3(13006) c4(39120, 52177, 65234, 26063, 78291) c5(fn, b, k, eu, bg, w, iL, xw, aoa, h, f, q, M, Xi, avY, Cp, Qx, jB, cOQ, wB, v, j, J, P, T, II, fM, cq, ao, PY, Dj, fl); #c1(ZNF764) c2(NP_001166150) c3(13007) c4(39121, 52178, 65235, 26064, 78292) c5(pO); #c1(ZNF765) c2(XP_006723529) c3(13008) c4(39122, 52179, 65236, 26065, 78293) c5(dB); #c1(ZNF76) c2(NP_001278961) c3(13009) c4(39123, 52180, 65237, 26066, 78294) c5(oy); #c1(ZNF774) c2(NP_001004309) c3(13010) c4(39124, 52181, 65238, 26067, 78295) c5(aC); #c1(ZNF776) c2(NP_775903) c3(13011) c4(39125, 52182, 65239, 26068, 78296) c5(dA); #c1(ZNF778) c2(NP_001188336) c3(13012) c4(39126, 52183, 65240, 26069, 78297) c5(cz); #c1(ZNF784) c2(NP_976308) c3(13013) c4(39127, 52184, 65241, 26070, 78298) c5(bq); #c1(ZNF79) c2(NP_001273625) c3(13014) c4(39128, 52185, 65242, 26071, 78299) c5(bb); #c1(ZNF7) c2(NP_001269725) c3(13015) c4(39129, 52186, 65243, 26072, 78300) c5(pD, I); #c1(ZNF800) c2(XP_005250238) c3(13016) c4(39130, 52187, 65244, 26073, 78301) c5(l); #c1(ZNF804A) c2(NP_919226) c3(13017) c4(39131, 52188, 65245, 26074, 78302) c5(dj, rQ, hW, yQ, vu, ak, dB, he, cz, ns, hS, nm, nt, nq, nr, nn, no, np, IV); #c1(ZNF804B) c2(NP_857597) c3(13018) c4(39132, 52189, 65246, 26075, 78303) c5(bb, hM, jJ, dA); #c1(ZNF80) c2(NP_009067) c3(13019) c4(39133, 52190, 65247, 26076, 78304) c5(aY, cM, dc); #c1(ZNF812) c2(XP_011526544) c3(13020) c4(39134, 52191, 65248, 26077, 78305) c5(ak); #c1(ZNF813) c2(NP_001004301) c3(13021) c4(39135, 52192, 65249, 26078, 78306) c5(at); #c1(ZNF816) c2(NP_001189386) c3(13022) c4(39136, 52193, 65250, 26079, 78307) c5(da, JH); #c1(ZNF81) c2(XP_011542204) c3(13023) c4(39137, 52194, 65251, 26080, 78308) c5(nz, nU, cVH, jx); #c1(ZNF823) c2(NP_001073962) c3(13024) c4(39138, 52195, 65252, 26081, 78309) c5(oy, ed, aC, eX, w, iL, bf, aA, u, y, aM); #c1(ZNF827) c2(NP_849157) c3(13025) c4(39139, 52196, 65253, 26082, 78310) c5(oy); #c1(ZNF829) c2(NP_001165450) c3(13026) c4(39140, 52197, 65254, 26083, 78311) c5(U, V); #c1(ZNF831) c2(NP_848552) c3(13027) c4(39141, 52198, 65255, 26084, 78312) c5(bb, Bu, aX, bw); #c1(ZNF91) c2(NP_001287880) c3(13028) c4(39142, 52199, 65256, 26085, 78313) c5(wP, wV); #c1(ZNF92) c2(NP_001274461) c3(13029) c4(39143, 52200, 65257, 26086, 78314) c5(A, B); #c1(ZNF93) c2(NP_112495) c3(13030) c4(39144, 52201, 65258, 26087, 78315) c5(b, es); #c1(ZNF98) c2(NP_001092096) c3(13031) c4(39145, 52202, 65259, 26088, 78316) c5(bq, ha); #c1(ZNFX1) c2(NP_066363) c3(13032) c4(39146, 52203, 65260, 26089, 78317) c5(A); #c1(ZNHIT2) c2(NP_055020) c3(13033) c4(39147, 52204, 65261, 26090, 78318) c5(od, aX); #c1(ZNHIT3) c2(NP_004764) c3(13034) c4(39148, 52205, 65262, 26091, 78319) c5(hh, t, fl); #c1(ZNRD1) c2(NP_001265715) c3(13035) c4(39149, 52206, 65263, 26092, 78320) c5(m, SA, cy, il, aCU, bx, qz, J, bu, P, ik, ar, by, jD); #c1(ZNRF3) c2(NP_001193927) c3(13036) c4(39150, 52207, 65264, 26093, 78321) c5(bw, jj, b); #c1(ZP1) c2(NP_997224) c3(13037) c4(39151, 52208, 65265, 26094, 78322) c5(qI); #c1(ZP4) c2(NP_067009) c3(13038) c4(39152, 52209, 65266, 26095, 78323) c5(aV, di, qr); #c1(ZPBP2) c2(NP_942141) c3(13039) c4(39153, 52210, 65267, 26096, 78324) c5(jH, cy, ob, m, aC, aE); #c1(ZPLD1) c2(NP_778226) c3(13040) c4(39154, 52211, 65268, 26097, 78325) c5(bb, I, cO, bq, aA, at); #c1(ZPR1) c2(NP_003895) c3(13041) c4(39155, 52212, 65269, 26098, 78326) c5(A, B, dK, kz, at, oG, ap); #c1(ZRANB3) c2(NP_001273497) c3(13042) c4(39156, 52213, 65270, 26099, 78327) c5(f, fw, cV); #c1(ZRSR2) c2(NP_005080) c3(13043) c4(39157, 52214, 65271, 26100, 78328) c5(cj, b, h, hN, n, ci, o); #c1(ZSCAN18) c2(NP_001139014) c3(13044) c4(39158, 52215, 65272, 26101, 78329) c5(U, gG, hP, V, dB); #c1(ZSCAN22) c2(NP_862829) c3(13045) c4(39159, 52216, 65273, 26102, 78330) c5(bm); #c1(ZSCAN26) c2(NP_001104509) c3(13046) c4(39160, 52217, 65274, 26103, 78331) c5(m); #c1(ZSCAN31) c2(NP_001230173) c3(13047) c4(39161, 52218, 65275, 26104, 78332) c5(m, dA); #c1(ZSCAN32) c2(NP_001271458) c3(13048) c4(39162, 52219, 65276, 26105, 78333) c5(oy); #c1(ZSCAN9) c2(NP_001186408) c3(13049) c4(39163, 52220, 65277, 26106, 78334) c5(m, dA); #c1(ZSWIM2) c2(NP_872327) c3(13050) c4(39164, 52221, 65278, 26107, 78335) c5(bb); #c1(ZSWIM6) c2(NP_065979) c3(13051) c4(39165, 52222, 65279, 26108, 78336) c5(atj, cVI); #c1(ZW10) c2(NP_004715) c3(13052) c4(39166, 52223, 65280, 26109, 78337) c5(fr); #c1(ZWILCH) c2(NP_001274752) c3(13053) c4(39167, 52224, 65281, 26110, 78338) c5(u, y); #c1(ZWINT) c2(NP_001005413) c3(13054) c4(39168, 52225, 65282, 26111, 78339) c5(A, u, B, fl, y, bj, o); #c1(ZYX) c2(NP_001010972) c3(13055) c4(39169, 52226, 65283, 26112, 78340) c5(d, GD, co, aX, dN, b, f, q, es, rR, cs, J, ad, e, ib); #c1(ZZEF1) c2(NP_055928) c3(13056) c4(39170, 52227, 65284, 26113, 78341) c5(b); #c1(ZZZ3) c2(XP_011539507) c3(13057) c4(39171, 52228, 65285, 26114, 78342) c5(aA);

Table C: Abbreviation Dictionary for the "Related disease, disorder nr condition" corresponding to feature "c5", whereby each Related disease, disorder nr condition is depicted with a specific abbreviation and its written form, i.e. prostate cancer corresponds to the abbreviation "A" and vice versa.

Formula: Related disease, disorder nr condition= Abbreviation;

prostate cancer=A; primary cutaneous follicle center lymphoma=Aa; obesity=aA; neuromuscular disease AA; brachial plexus neuropathy=aa; thickening of pleura=aAa; krabbe disease=aAA; cerebral amyloid angiopathy, familial=aaA; alcoholic steatnhepatitis=aaa; ruptured cerebral aneurysm=aab; vulva cancer=aAB; listeriosis=aAb; alcohol withdrawal seizures=aaB; speech-sound disorder=aaC; candidiasis familial chronic mucocutaneous, autosomal recessive=aAc; fat intolerance=aac; encephalyitozoonosis=aAC; enteropathyngenic Escherichia coli gastrointestinal tract infection=aAD; plague, atherosclerotic=aaD; candidemia=aAd; triple vessel disease=aad; tissue sensitivity=aAE; adult growth hormone deficiency=aae; dermatophytosis=aAe; fetal nutrition disorders=aaE; invasive aspergillosis=aAf; stage, neurnblastoma=aAE; mercury poisoning, nervous system=aaF; bulimia nervosa=aaf; abetalipoponteinemia=aag; microcephaly, primary autosomal recessive, 4=aAg; terminal ileitis=aAG; mercury poisoning=aaG; turners in children=aAH; amyotrophyic lateral sclerosis-parkinsonism/dementia complex 1=aaH; hypobetalipoproteinemia=aah; ascending colon cancer=aAh; neurobehavioral manifestations=aaI; mental retardation and microcephaly with pontine and cerebellar hypoplasia=aAi; high grade dysplastic nodule=aAI; holoprosencephaly=aai; sensation disorders=aaJ; fg syndrome 4=aAj; ariboflavinosis=aaj; lupus-like syndrome=aAJ; scaly skin=aak; x-linked infantile nystagmus=aAk; amyloidosis, primary cutaneous=aaK; low grade dysplastic nodule=aAK; tubular adenocarcinoma=aaI; head injuries, closed=aaL; anthracosis=aAL; fg syndrome=aAI; autoimmune lymphoproliferative syndrome, type iia=aAm; chlamydophila infections=aaM; germinoma=aAM; apolipoprotein c-ii deficiency=aam; caspase 8 deficiency=aAn; postoperative confusion=aaN; supratentorial primitive neuroectodermal tumor=aAN; chylomicronemia syndrome=aao; hyperparathyroidism I=aAO; carbon monoxide poisoning=aaO; hydrosalpinx=aAn; myotonic muscular dystrophy=aan; marden-walker syndrome=aAp; deficiency of triacylglycerol lipase=aap; warfarin sensitivity=aaP; hyperparathyroidism, neonatal severe primary=aAP; steatorrhea=aag; epilepsy, idiopathyic generalized, susceptibility to, 8=aAQ; acquired cjd=aaO; bacterial sepsis=aAg; cystinosis=aAr; hypocalcemia, autosomal dominant 1=aAR; apolipoprotein c-iii deficiency=aar; corticobasal degeneration=aaR; alzheimers disease with early onset=aaS; hyperparathyroidism 3=aAS; amebiasis=aAs; fat redistribution=aas; akathisia, drug-induced=aaT; intestinal carcinoma=aat; hypercalciuric hypercalcemia=aAT; neuroferritinopathy=aAt; nephrolithiasis, calcium oxalate=aAU; reoviridae infections=aAu; subarachnoid hemorrhage, aneurysmal=aaU; hypotriglyceridaemia=aau; dermatofibrosarcoma protuberans=aav; spinal osteophytosis=aaV; hyperparathyroid=aAV; posterior capsule opacification=aAv; vertebral artery dissection=aaW; idiopathyic hypercalciuria=aAW; spinal cord stroke=aAw; lipoprotein glomerulopathy=aaw; dementia, familial danish=aax; perceptual disorders=aaX; neonatal hyperparathyroidism=aAX erosisve esophagitis=aAx; disorders of excessive somnolence=aaY; infiltrating duct carcinoma=aAy; calcium metabolism disease=aAY; pyruvate dehydrogenase e3-binding protein deficiency=aay; inclusion body myopathy, sporadic=aaZ; lactose intolerance=aAZ; fragile x tremor ataxia syndrome=aaz; hypocapnia=aAz; fibre dysplasia ossificans progressiva=aB; hemoglobinopathy=ah; ophthalmoplegia=AB; hodgkin's-like=Ah; soft drusen=aba; ebola hemorrhagic fever=aBa; actinomycosis=aBA; cerebrovascular amyloidosis=abA; glaucomatous retinal degeneration=aBb; spermatogenic failure 7=aBB; toxicosis=abb; severe dementia=abB; stomatitis, herpetic=abc; vulvovaginal atrophy=aBc; mobility limitation=abC; lipodystrophy, congenital generalized, type 3=aBC; pulmonary hypertension, primary, 3=aBD; depressive syndrome=abd; iatrogenic creutzfeldt-jakob disease=abD; recessive dystrophyic epidermaolysis bullosa=aBd; hypersensitive syndrome=abe; abnormalities, drug-induced=aBe; hypopharyngeal carcinoma=aBE; iodine deficiency syndrome=abE; keratitis, herpetic=abf; mixed oligoastrocytoma=aBF; acatalasemia Japanese type=aBf; tetralogy of fallot with pulmonary atresia=abF; lupus vasculitis, central nervous system=abg; renoprival hypertension=aBg; frontal dementia=abG; uterine carcinoma=aBG; circulatory arrest=abH; cross infection=abh; radiotoxicity=aBh; muscular dystrophy, limb-girdle, type 1c=aBH; long gt syndrome 9=aBI; yin deficiency=abi; hypothalamic-pituitary-adrenal axis dysfunction=abI; deficiency of catalase=aBi; closed head injuries=abj; creatine phosphokinase, elevated serum=aBJ; triplegia=abJ; hypocatalasemia=aBj; persistent vegetative state=abk; rippling muscle disease, 1=aBK; embryopathy=aBk; intracranial atherosclerosis=abK; cerebral hemorrhage, traumatic=abl; reproductive tract infections=aBl; intravenous drug abuse=abL; myopathy, distal, tateyama type=aBL; rippling muscle disease 2 (disorder)=aBM; arteriosclerosis of aorta=abM; female genital tract infection=aBm; diarrhea, infantile=abm; arterial leg ulcer=aBn; hyperirritability=aBN; Paramyxoviridae infections=abn; progressive multiple sclerosis=abN; mitral valve endocarditis=aBo; forgetting=abO; rippling muscle disease=aBO; dementia in parkinson's disease=abo; core binding factor acute myeloid leukemia=aBP; acute ulcer=aBp; chronic anxiety=abP; mixed dementia=abp; sexual abuse=abq; pipecolic acidemia=aBq; soft neurological signs=abQ; sarcoma of mesentery=aBQ; aspergilloma=aBr; progressive dementia=abr; post-concussion syndrome=abR; legius syndrome=aBR; leprosy-patients=abs; aspergillosis=aBs; noonan syndrome-like disorder with or without juvenile myelomaonocytic leukemia=aBS; subcortical vascular dementia=abS; pericarditis=aBt; executive dysfunction=abt; loss of memory ability=abT; clubbing of nail=aBT; primary hypertrophyic osteoarthropathy=aBU; prodromal period=abU; anxiety and fear=abu; refsum disease=aBu; cystathionine beta-synthase deficiency=aBV; visuospatial deficit=abV; allergic bronchopulmonary aspergillosis=aBv; osteoporosis risk=abv; acatalasia=aBw; dysphoric mood=abw; daytime somnolence=abW; carotid artery, internal, dissection=aBW; homocystinuria, pyridoxine-responsive=abX; prodrome=abX; photosensitive trichothiodystrophy=aBx; dementia associated with alcoholism=abx; early onset schizephrenia=aby; intracranial sinus thrombosis=aBY; mobility poor=abY; variegate porphyria=aBy; gonorrhea=aBz; post-traumatic amnesia=abz; recurrent genital herpes simplex=abZ; 46, xy sex reversal 5=aBZ; rheumatoid arthritis=aC; peripheral nervous system disease=ac; nemaline myopathy=AC; lown-ganong-levine syndrome=Ac; macular retinal edema=acA; congenital dyserythropoietic anemia, type i=aCa; sensory denervation=aca; high grade astrocytic turner=aCA; nominal aphasia=acB; otitis media, susceptibility to=aCb; morphine dependencye=aCB; severe depression=acb; acute nephropathy=acc; mental retardation, autosomal recessive 3=aCc; holoprosencephalyy=acC; multiple chemical sensitivity=aCC; clinical depression=acd; chronic constipation=aCD; coach syndrome=aCd; arteriolosclerosis=acD; joubert syndrome 9=aCe; asthma, susceptibility to=aCE; progressive supranuclear palsy=acE; cardiovascular infections=ace; meckel syndrome, type 6=aCf; herpes zoster=acF; tuberous xanthoma=acf; granuloma, respiratory tract=aCF; pityriasis versicolor=acG; human immunodeficiency virus type 1, susceptibility to=aCG; disease=acg; meckel syndrome=aCg; allergic conjunctivitis=aCH; hennekam syndrome=aCh; alagille syndrome=acH; optic neuritis=ach; carotid artery dissection=acI; ciliary dyskinesia, primary, 17=aCi; herpes gestationis=aCI; siderosis=aci; nasopharyngitis=acj; ciliary dyskinesia, primary, 20=aCj; exophthalmos=acJ; macular degeneration, age-related, 2=aCJ; tic disorder=ack; hypopituitarism=acK; ciliary dyskinesia, primary, 14=aCk; recurrent respiratory papillomatosis=aCK; pulmonary aspergillosis=aCL; intracranial hypertension=acl; ciliary dyskinesia, primary, 15=aCl; hypoplastic left heart syndrome=acL; exanthem=acM; skin symptom=aCM; vitamin k deficiency hemorrhagic disease=acm; deafness, autosomal dominant 44=aCm; ciliary dyskinesia, primary, 27=aCn; paragonimiasis=aCN; schizophreniform disorder=acn; leprosy, multibacillary=acN; aids (disease)=aCO; choroid disease=aco; leprosy, paucibacillary=acO; generalized progressive retinal atrophy=aCo; mandibuloacral dysplasia with type a lipodystrophy=aCp; patau syndrome=acp; focal segmental glomerulosclerosis 4, susceptibility to=acP; extrinsic allergic alveolitis=aCP; complex partial epilepsy=acq; adenomatous goiter=aCq; familial hematuria=acQ; alveolitis=aCQ; pseudopelade=acR; pancreatic cystadenoma=aCR; color blindness=aCr; communication disorder=acr; quadriplegia=acs; lichen planus follicularis=acS; t-lymphocytopenia=aCS; myopathy, centronuclear, 4=aCs; dermatomycosis=act; phencyclidine abuse=acT; three m syndrome 1=aCt; myasthenia=aCT; aspirin-sensitive asthma with nasal polyps=aCU; three m syndrome 3=aCu; intracranial vasospasm=acu; cytochrome-c oxidase deficiency disease=acU; *Mycobacterium tuberculosis*, susceptibility to=aCV; cerebral amyloid angiopathy, app-related=acV; 3-m syndrome=aCv; cadasil=acv; ventricular septal defect=acw; coronary artery disease, modifier of=aCW; angiomyolipom=aCw; alzheimer disease type 4=acW; neuropathy, painful=aCX; dementia, familial british=acX spondylosis=acx; chronic dermatitis=aCx; ampulla of vater carcinoma=acy; nephropathy, chronic tubulointerstitial=aCY; chronic ulcer of skin=aCy; cerebral hemorrhage with amyloidosis, hereditary, dutch type=acY; acute recurrent pancreatitis=aCZ; sea-blue histiocyte syndrome=acz; idiopathyic environmental intolerance=aCz; alzheimer disease, familial, 1=acZ; malonic aciduria=Ad; van der woude syndrome=AD; colon cancer=ad; allergic asthma=aD; bacterial peritonitis=aDa; bronchiolitis=aDA; alzheimer disease, early-onset, with cerebral amyloid angiopathy=ada; early-onset ataxia with oculomotor apraxia and hypoalbuminemia=adA; cerebral amyloid angiopathy, hereditary=adb; endocervicitis=aDB; ataxia telangiectasisa like disorder=adB; coronary occlusion=aOb; cumulative trauma disorders=aDc; varicose veinss=aDC; general paresis=adc; marinesco-sjogren syndrome=adC; carotid artery occlusion=add; cutaneous leishmaniasis=aDD; cancer pain=aDd; early onset cerebellar ataxia=adD; cross-dependencye=adE; asthmatic pulmonary eosinophilia=aDe; behavior disturbance=ade; mucocutaneous leishmaniasis=aDE; cancer angiogenesis=aDf; limb-girdle muscular dystrophy, type 2b=adF; pulmonary eosinophilia=aDF; phenylketonuria=adf; edema, cardiac=adG; viral myocarditis=aDg; muscle amp deaminase deficiency=adg; rocio virus encephalyitis=aDG; congenital dyserythropoietic anemia=adH; viral arthritis=aDh; sandhoff disease=aDH; fibrous dysplasia=adh; retinal veins occlusion=adI; intestinal schistosomiasis=aDI; osteodystrophy=adi; infection by leishmania braziliensis=aDi; deficiency of phosphorylase kinase=adj; leishmaniasis=adJ; nondisjunction=aDJ; leishmaniasis, diffuse cutaneous=aDj; toxoplasmosis, animal=aDK; otitis=aDk; gains deficiency=adk; visceral leishmaniasis=aDK; acute miliary tuberculosis=aDl; pregnancy complications, infectious=aDL; priapism=adL; cardiac glycogenosis=adl; diabetes insipidus, nephrogenic, x-linked=adM; seronegative rheumatoid arthritis=aDm; lobar pneumonia=aDM; conduction system abnormalities=adm; viral meningoencephalyitis=aDn; methemoglobinemia=adn; late onset asthma=aDN; diabetes insipidus, nephrogenic, autosomal=adN; viral respiratory infection=aDO; congenital nephrogenic diabetes insipidus=adO; digestive system cancers=aDo; glycogen storage disease vii=ado; mucopolysaccharidosis iv=adp; borderline tuberculoid leprosy=aDp; balance disorder=adP; pneumonia in children=aDP; neurohypophyseal diabetes insipidus=adQ; collagen-vascular disease=aDQ; mccune albright syndrome=adq; arthritis symptoms=aDq; diabetes insipidus=adR; lung disease granulomatous=aDr; skin damage=aDR; skin squamous cell carcinoma=adr; yusho disease=aDS; renal vasculitis=aDs; giI blood group=adS; wolff-parkinson-white syndrome=ads; dysequilibrium syndrome=adT; pseudopseudohypoparathyroidism=adt; auricular swelling=aDt; posterior uveitis=aDT; pelvic inflammatory disease=aDu; boutonneuse fever=aDU; clear cell sarcoma=adu; recurrent optic neuritis=adU; yellow fever=aDV; optic nerve glioma=adv; acute myocarditis=aDv; myelitis, transverse=adV; nonspecific interstitial pneumonia=aDW; periapical periodontitis=aDw; acute myocardial ischemia=adW; danon disease=adw; dengue hemorrhagic fever=aDx; atrioventricular block=adx; bilateral optic neuritis=adX; idiopathyic osteoarthritis=aDX; orchitis=aDy; hyponatremic=adY; degenerative joint disease involving multiple joints=aDY; adenine phosphoribosyltransferase deficiency=ady; granulomatous angiitis=aDz; spastic ataxia charlevoix-saguenay type=adz; obstructive hydrocephalyus=adZ; cerebral cavernous malformations 2=aDZ; aortic aneurysm, familial thoracic 6=AE; type 1 diabetes mellitus=aE; combined malonic and methylmalonic aciduria=Ae; malaria=ae; richter's syndrome=aEa; anterior uveitis idiopathyic=aEA; carbamoyl phosphate synthetase i deficiency disease=aeA; myelitis=aea; alphaviral infection=aEB; inflammatory cardiomyopathy=aEb; diffuse palmoplantar keratoderma, bothnian type=aeb; hunger=aeB; asymptomatic multiple myeloma=aEc; pleomorphic adenoma=aeC; pediatric human immunodeficiency virus infection=aEC; morphologically altered structure=aec; recurrent aphthous ulcer=aED; esophageal disease=aEd; embryonal testis carcinoma=aeD; keratitis-ichthyosis-deafness syndrome=aed; coxsackievirus infections=aEe; adams-oliver syndrome=aeE; perivascular turner=aee; lymphoma, extranodal nk-t-cell=aEE; microphthalmia, syndromeic 7=aeF; hereditary allergy=aEF; acute heart failure=aef; gastrooesophageal cancer=aEf; epithelial hyperplasia=aEg; chancroid=aEG; coronary spastic angina=aeG; arthrogryposis renal dysfunction cholestasis syndrome=aeg; nephrotic syndrome, idiopathyic, steroid-resistant=aeH; giving-way=aeh; diabetes mellitus, insulin-dependent, 22=aEH; mantle lymphoma=aEh; primary graft dysfunction=aEI; neutropenia, severe congenital, autosomal recessive 3=ael; respiratory tract infections=aei; stage, kaposi's sarcoma=aEi; hiv disease progression=aEJ; endometrial sarcoma=aEj; nephrotic syndrome, type 8=aeJ; mannose-binding protein deficiency=aej; obstructive disease=aek; substance abuse, intravenous=aEK; tomaculous neuropathy=aeK; maladjustment=aEk; high grade endometrial stromal sarcoma=aEl; copd, severe early-onset=ael; infertility tubal factor=aEL; slowed nerve conduction velocity, autosomal dominant=aeL; basal cell carcinoma=aeM; endometrial stromal sarcoma, high grade=aEm; hiv-1 infection=aEM; bronchiectasis=aem; asymptomatic human immunodeficiency virus infection=aEN; palisaded myofibroblastoma=aEn; lichen simplex chronicus=aeN; keratoacanthoma=aen; neurodermatitis=aeO; cecal benign neoplasm=aEo; morning stiffness (>1 hour)=aEO; tonsillitis=aeo; laryngeal disease=aEp; gitelman syndrome=aeP; infections specific to perinatal period=aEP; myoclonic epilepsy, familial infantile=aep; x-linked retinitis pigmentosa=aeQ; vesicular stomatitis=aeq; vulva carcinoma=aEq; ocular surface disease=aEQ; flaviviral diseases=aER; adenomayoma=aEr; congenital heart block=aer; echinococcosis=aeR; atrioventricular bloc=aes; biliary stricture=aES; cardiac sarcoidosis=aeS; verrucous carcinoma=aEs; end stage aids=aET; heterotopia, periventricular, autosomal recessive=aet; endometrial stromal turner=aEt; aarskog-scott syndrome=aeT; primary hiv infection=aEU; mean platelet volume=aeU; anus neoplasm=aEu; periventricular heterotopia=aeu; mohr-tranebjaerg syndrome=aeV; upper urinary tract infection=aEV; hypoplasia of corpus callosum=aev; atypical polypoid adenomayoma=aEv; bubonic plague=aEW; periventricular nodular heterotopia=aew; mental retardation, x-linked 46=aeW; malignant ciliary body melanoma=aEw; double cortex=aeX retinoschisis 1, x-linked, juvenile=aex senile angioma=aEx female reproductive system disease=aEX; schizoaffective disorder, bipolar type=aeY; natural killer cell leukemia=aEY; hair disease=aey; thoracic injuries=aEy; alphavirus infections=aEz; hyperargininemia=aez; prodromal symptoms=aeZ; biliary tract disease=aEZ; aortic aneurysm, familial thoracic 1=AF; mucinous adenocarcinoma=af; sepsis=aF; mammary neoplasms, experimental=Af; congenital malformation of genital organs=afA; appendicitis=aFA; acute kidney tubular necrosis=aFa; schizotypal personality disorder=afa; velocardiofacial syndrome=afb; west nile fever=aFb; subfertility, male=aFB; choledochal cyst=aFB; eczema herpeticum=aFC; *Mycobacterium avium* complex disease=aFc; bulbospinal neuronopathy=afC; acquired polycythemia=afc; nephropathy with pretibial epidermaolysis bullosa and deafness=aFD; loss of scalp hair=afD; netherton syndrome=aFd; kidney hypertrophy=afd; primary disease=afE; myelomaonocytic leukemia=aFe; hyperekplexia and epilepsy=afe; opioid abuse=aFE; friedreich ataxia 1=aff; mitochondrial pathyology=aFf; female infertility associated with anovulation=afF; capillary malformations, congenital, 1=aFF; apocrine gland carcinoma=afG; thalassemia minor=aFG; neuropathy, hereditary sensory, with spastic paraplegia, autosomal recessive=aFg; 46, xy disorders of sex development=afg; congenital adrenal hyperplasia due to 21 hydroxylase deficiency=afh; idiopathyic hirsutism=afH; hereditary sensory and autonomic neuropathyies=afh; transfusion related acute lung injury=aFH; hereditary motor neuron disease=afI; hypospadias 1, x-linked=afi; immune neutropenia=aFI; alveolar bone loss=aFi; enterovirus infections=aFj; pseudohermaphrodite (non-specific)=afJ; relative polycythemia=aFJ; 21-hydroxylase deficiency=afj; reactive thrombocytosis=afK; antibody deficiency due to defect in cd19=aFK; bulbospinal neuronopathy, x-linked recessive=afk; gram-negative bacterial infections=aFk; pemphigus foliaceus=aFL; periodontal attachment loss=aFl; gonadal dysgenesis, 45,x=afL; heredodegenerative disorders, nervous system=afl; testicular dysgenesis syndrome=afM; male hypogonadism=afm; antibody deficiency syndrome=aFM; community-acquired infections=aFm; hernia congenital=afN; malignant neoplasm of male breast=afn; viral meningitis=aFN; *Chlamydia pneumoniae* infection=aFn; prurigo=aFo; diseases or conditions=afO; acne vulgaris=afo; alveolar pyorrhea=aFO; septicemia due to gram-negative organism, unspecified=aFp; spinal diseases=afp; arthritis by pattern of joint involvement=aFP; supernumerary structure=afP; cholestasis in newborn=aFq; bilateral inguinal hernia=afQ; condyloma=aFQ; transsexualism=afq; acute lyme disease=aFr; genital infection=aFR; phenotypic heterogeneity=afr; intratubular malignant germ cells=afR; neoplasms, hormone-dependent=afs; disorder of neutrophyils=afS; birbeck granule deficiency=aFS; coronary arteritis=aFs; large prostate=aft; cavitation of lung=aFT; endocrine glands-cancer=afT; acute malaria=aFt; 46, xx testicular disorders of sex development=afu; summer-type hypersensitivity pneumoniatis=afU; immunodeficiency due to defect in cd3-zeta=aFU; distal colitis=aFu; dysplastic nodule=afV; refractory cytopenia with multilineage dysplasia (rcmd)=aFv; 5-alpha reductase deficiency=afv; sepsis of the newborn=aFV; bacterial sepsis of newborn=aFW; alopecia=afW; acute arthritis=aFw; lower motor neuron disease=afw; motor symptoms=afx; sympathyetic ophthalmia=aFX; prostate malignant phyllodes turner=afX; bacterial diarrhoea=aFx chromosome lip deletion syndrome=afy; peripheral nervous system neoplasm=afY; inflammatory neuropathy=aFY; bacterial vaginosis=aFy;

burning mouth syndrome=aFz; hypertrophyic pyloric stenosis=afZ; poorly differentiated carcinoma=afz; paracoccidioidomycosis=aFZ; multisystemic smooth muscle dysfunction syndrome=AG; wounds and injuries=aG; mammary neoplasms, animal=Ag; pancreatic carcinoma=ag; gynecomastia=aga; retinitis pigmentosa with or without situs inversus=agA; peeling skin syndrome=aGa; septal hypertrophy=aGA; neurofibroma=agb; lymphoproliferative syndrome 2=aGb; retinitis pigmentosa 55=agB; exercise-induced angina=aGB; rheumatoid vasculitis=aGc; bardet-biedl syndrome 3=agC; breast liposarcoma=aGC; amenorrhea=agc; spastic paraplegia 61, autosomal recessive=agD; pulmonary paracoccidioidomycosis=aGd; 46 xy gonadal dysgenesis=agd; lymphocytosis—absolute=aGD; ciliary dyskinesia, primary, 23=agE; male breast cancer=age; fuchs' heterochromic uveitis=aGe; severe combined immunodeficiency, autosomal recessive, t cell negative, b cell positive, nk cell positive=aGE; hyperaldosteronis=agE; benign breast phyllodes turner=agf; myasthenic syndrome, congenital, slew-channel=aGf; severe combined immunodeficiency, autosomal recessive, t cell-negative, b cell-positive, nk cell-negative=aGF; currarino triad=agG; benign prostate phyllodes turner=agg; immunodeficiency 19=aGG; focal segmental glomerulosclerosis 3, susceptibility to=aGg; talkativeness=aGh; pleomorphic adenoma carcinoma=agh; lymphoid depletion=aGH; incontinentia pigmenti, familial male-lethal type=agH; tenosynovial giant cell turner=agi; human immunodeficiency virus, type 2 [hiv-2]=agI; immunodeficiency 18=aGI; feasier syndrome=aGi; Sertoli cell turner=agj; t lymphocyte deficiency=aGJ; methylmalonic aciduria due to transcobalamin receptor defect=aGj; bloch-sulzberger syndrome=agj; thrombocytopenia 1=aGk; placental site trophyoblastic turner=agk; immunodeficiency 17=aGK; macular degeneration, age-related, 8=agK; retinal pigment epithelial detachment=agL; infertility=agl; immunodeficiency with hyper-igm, type 3=aGL; gaucher disease, type i=aGl; choroiditis=agM; gaucher disease, type iii=aGm; hereditary breast ovarian cancer=agm; subacute combined degeneration=aGM; pulmonary sclerosisng hemangioma=agn; heat stroke=aGn; retinal drusen=agN; osteoporosis (osteopenia)=aGN; rupture, spontaneous=aGO; hypopituitaris=agO; quebec platelet disorder=aGo; acne=ago; mucopolysaccharidosis ii=agP; sclerosis of the skin=aGP; cancer regression=aGp; aicardi syndrome=agp; immunoglobulin deposition disease=aGQ; atrophyic muscular disease=agq; ovary serous adenocarcinoma=agQ; acute-on-chronic liver failure=aGq; gingival fibromatosi=agr; spastic dysphonia=aGR; pern keratosis, disseminated superficial actinic 1=agR; fibrous papule of nose=aGr; mental retardation, autosomal dominant 12=ags; poxviridae infections=aGS; retinal vasculitis=agS; fibrous papule of face=aGs; meige syndrome=aGT; lymphangioma=aGt; scaphycephaly=agt; neurotic disorder=agT; synostosis=agu; diverticulitis=aGU; fibrous histiocytoma=aGu; anxiety, separation=agU; coffin-siris syndrome=agv; erythema infectiosum=aGV; cutaneous fibrous histiocytoma=aGv; metachromatic leukodystrophy, congenital type=agV; metachromatic leukodystrophy, juvenile type=agW; platelet glycoprotein iv deficiency=aGw; oral hairy leukoplakia=aGW; angelman syndrome=agw; *Plasmodium falciparum* blood infection level=aGx metachromatic leukodystrophy, adult type=agX; maple syrup urine disease=agx; toxoplasmosis, cerebral=aGX; coronary heart disease, susceptibility to, 7=aGy; immunodeficiency congenital=aGY; arylsulfatase a deficiency=agY; adult disease=agy; joubert syndrome 8=agz; chronic psychosis=agZ; autoimmune thrombocytopenia=aGZ; pterygium of conjunctiva and cornea=aGz; brachial plexus neuritis=ah; moyamoya disease 5=AH; starvation=Ah; acute kidney injury=aH; hyper-igm immunodeficiency, x-linked, with ectodermal dysplasia, hypohidrotic=aHa; pseudoarylsulfatase a deficiency=aha; cryptogenic west syndrome=ahA; wound, healed=aHA; sulfatiduria=ahb; buffalo hump=aHB; brain cyst=ahB; tuberculoid leprosy=aHb; cavity=ahc; partington syndrome=ahC; lichen disease=aHC; mixed connective tissue disease=aHc; hydranencephaly=ahD; urban schosser spohn syndrome=aHd; 22q13.3 deletion syndrome=aHD; unverricht-lundborg syndrome=ahd; demyelinating polyneuropathy=ahe; ideomotor apraxia=ahE; incoherent thinking=aHe; lipomatosis, multiple=aHE; stage ib cervical cancer=aHf; hexadactyly=aHF; mucosulfatidosis=ahf; neoplasms, glandular and epithelial=ahF; pneumonia due to gram negative bacteria=aHg; combined saposin deficiency=ahG; cardiac symptom=ahg; myoma=aHG; porphyria cutanea tarda=aHH; jankovic rivera syndrome=ahH; lubs x-linked mental retardation syndrome=ahh; intraductal papilloma=aHh; 22q11 deletion syndrome=ahi; lipomatous cancer=aHI; gliomatosis cerebri=aHi; pseudohypoparathyroidism type 1b=ahI; omodysplasia=aHj; congenital mesoblastic nephroma=aHJ; saposin d (disease)=ahJ; cognitive function 1, social=ahj; farber lipogranulomatosis=ahK; cellular myxoid liposarcoma=aHK; hemolytic uremic syndrome, atypical, susceptibility to, 2=aHk; specific language impairment=ahk; facial hemihypertrophy=ahl; glaucoma 1, open angle, f=ahL; intravenous leiomyomatosis=aHL; diarrhea-negative hemolytic uremic syndrome=aHl; autistic behavior=ahm; visual symptoms=ahM; myxoid chondrosarcoma=aHM; *Streptococcus pyogenes* infection=aHm; infection by human herpesvirus 7=aHn; congenital fibrosarcoma=aHN; orofaciodigital syndrome=ahN; chromosome 22q11.2 microduplication syndrome=ahn; shipyard eye=aHo; Hirschsprung disease 1=ahO; synpolydactyly=aHO; obsession=aho; cchs with hirschsprung disease=ahP; autoimmune hemolytic anemia=aHp; patent foramen ovale=ahp; agammaglobulinemia 3, autosomal recessive=aHP; okt4 epitope deficiency=aHq; mucoepidermaoid turner=ahQ; agammaglobulinemia 6, autosomal recessive=aHQ; asperger syndrome=ahq; chromosome 12, 12p trisomy=aHR; cerebrovascular occlusion=ahR; cd59 deficiency=aHr; chondrodysplasia punctata, brachytelephalangic=ahr; cromer blood group system=aHs; hirschsprung's disease=ahS; neuroborreliosis=aHS; x-linked chondrodysplasia punctata 1=ahs; chondrodysplasia punctata=aht; swine vesicular disease=aHt; islet cell turner=ahT; nephrotic syndrome in children=aHT; intravascular hemolysis=aHu; olfactory neuroblastoma=ahU; vitreoretinochoroidopathy=ahu; functional proteinuria=aHU; lissencephaly, x-linked, 2=ahv; hemoglobinuria=aHv; differentiating neuroblastoma=ahV; immunodeficiency, common variable, 6=aHV; taste sour=ahW; anticoagulants causing adverse effects in therapeutic use=aHW; epileptic encephalyopathy, early infantile, 1=ahw; mastitis-metritis-agalactia syndrome=aHw; poisoning by anticoagulant=aHX; thymus squamous cell carcinoma=aHx; primary progressive multiple sclerosis=ahX; mental retardation, x-linked, with or without seizures, arx-related=ahx; aquagenic pruritus=aHy; bladder cancer stage=aHY; proud syndrome=ahy; hyperalgesia, primary=ahY; basophilic leukemia=aHz; autonomic nervous system imbalance=ahZ; dental pulp exposure=aHZ; partington x-linked mental retardation syndrome=ahz; symptoms in children=Ai; hepatitis c, chronic=aI; aortic aneurysm and dissection=AI; frontotemporal lobar degeneration=ai; decubitus ulce=aia; vulvar disease=aIA; cd8 deficiency, familial=aIa; argininosuccinic acid synthetase deficiency, complete=aiA; paroxysmal nonkinesigenic dyskinesia=aib; multiple sclerosis, chronic progressive=aIb; familial tremor=aiB; lobular neoplasmia=aIB; spongiotic dermatitis=aIC; pseudohypoaldosteronism=aic; plasmodium ovale infection=aIc; citrullinemia=aiC; opitz trigonocephaly syndrome=aid; bohring syndrome=aiD; skin/hair/eye pigmentation, variation in, 9=aId; gastric signet ring cell adenocarcinoma=aID; hypereosinophilia=aiE; usher syndrome, type i=aIE; pigment deposition=aie; glomus turner=aIe; usher syndrome, type id=aIF; single gene defect=aiF; blastema predominant kidney wilms' turner=aIf; skin pigmentation disorder=aif; anemia hemoglobin=aiG; acute hiv infection=aIg; urea cycle disorder=aig; usher syndrome, type 1d=aIG; secondary malignant neoplasm=aiH; pineal gland cancer=aih; deafness, autosomal recessive=aIH; secondary hemochromatosis=aIh; juvenile macular degeneration and hypotrichosis=aII; unilateral multicystic dysplastic kidney=aIi; asparagine synthetase deficiency=aii; bainbridge-ropers syndrome=aiI; plexiform neurofibroma=aIJ; pectus excavatum=aIj; congenital hypotrichia=aIJ; microcephaly, congenital=aij; hypertyrosinemia, richner-hanhart type=aiK; neonatal anemia=aIk; no-reflow phenomenon=aIK; aminoacylase 2 deficiency=aik; cone-rod dystrophy 15=aIL; cerebral degeneration=ail; pica disease=aIl; ductal breast carcinoma=aiL; leber congenital amaurosi=aIM; canavan disease=aim; antithrombin iii deficiency=aiM; keratoacanthoma familial=aim; purine nucleoside phosphorylase deficiency=aiN; choledocholithiasis=ain; hermaphroditis=aIN; pemphigus and fogo selvagem=ain; meier-gorlin syndrome 5=aIo; ectopia lentis, spontaneous filtering blebs, and craniofacial dysmorphism=aio; cerebellar ataxia, cayman type=aiO; corneal dystrophy and perceptive deafness=aIO; meier-gorlin syndrome=aIp; clear cell sarcoma, of tendons and aponeuroses=aiP; vascular degeneration=aip; chandler syndrome=aIP; vascular ischemia=aIQ; hereditary wilms' turner=aIq; round cell sarcoma=aiQ; hepatobiliary benign neoplasm=aiq; acquired atrophy of ovary=aIR; microcephaly, primary autosomal recessive, 5=air; polyp of corpus uter=air; myoepithelioma=aiR; melanoma, cutaneous malignant, susceptibility to, 3=aIS; cerebellar lesion=aiS; autosomal recessive primary microcephaly=ais; malignant mesenchymoma=aIs; primary microcephaly=ait; hyperplastic lymph node=aIt; inflammatory mfh=aIT; varicose ulcer=aiT; invasive tubular breast carcinoma=aIu; intracortical osteogenic sarcoma=aIU; intervertebral disc disease=aiu; secondary infection=aiU; ectodermal dysplasia, ectrodactyly, and macular dystrophy=aIv; heartburn=aiV; congenital torticollis=aiv; multiple pathyologies=aIV; mental retardation, autosomal dominant 3=aIw; childhood kidney cell carcinoma=aiw; developmental reading disorder=aIW; west nile viral infection=aiW; hypotrichosis=aIx; isodicentric chromosome 15 syndrome=aIX; thromboembolism in children=aix infective dermatitis=aiX; compulsive personality disorder=aIy; masa syndrome=aiy; supraglottis squamous cell carcinoma=aIY; recurrent depression=aiY; chronic myelopathy=aiZ; microcephaly, primary autosomal recessive, 3=aIZ; hyperammonemia=aiz; gastric cancer stage=aIz; grn-related frontotemporal dementia=aj; prostatic hyperplasia=aJ; mydriasis, congenital=AJ; poliomayelitis=Aj; inflammatory disease of the central nervous system=aja; hodgkin's disease in children=ajA; gastro-esophageal reflux disease with esophagitis=aJA; transient myeloproliferative disorder of down syndrome=aJa; chromosome 10, monosomy 10q=aJB; isolated cervical dystonia=ajB; central nervous system lesion=ajb; epileptic encephalyopathy, early infantile, 2=aJb; nance-horan syndrome=aJc; idiopathyic polypoidal choroidal vasculopathy=ajC; glandular neoplasms=aJC; bone marrow disease=ajc; rna virus infections=ajd; eales disease=ajD; rett syndrome, atypical=aJd; neuroblastoma recurrent=aJD; laryngopharyngeal cancer=ajE; neonatal hemochromatosis=aJe; human t-cell lymphotrophyic virus, type i [htlv-i]=aJE; inflammatory bowel disease 10=aje; vulval intraepithelial neoplasmia grade 3=aJF; cryptococcosis=ajf; myoclonic encephalyopathy=aJf; li-fraumeni syndrome=ajF; coats disease=ajG; blackout=aJg; leukemia, chronic lymphocytic, susceptibility to, 2=aJG; vacuolar myopathy=ajg; aicar transformylase inosine monophosphate cyclohydrolase deficiency=ajh; familial primary gastric lymphoma=aJH; infantile refsum disease=ajH; nodular ganglioneuroblastoma=aJh; meningitis, meningococcal=ajI; invasive bladder transitional cell carcinoma=aJi; autosomal aneuploidy=aJI; spastic paraplegia 3, autosomal dominant=aji; meningitis, pneumococcal=ajJ; spastic paraplegia 10, autosomal dominant=ajj; immunodeficiency 13=aJj; superficial gastritis=aJJ; multiple endocrine neoplasmia, type iv=aJk; leukemias infiltration=ajK; neuropathy, hereditary sensory, type id=ajk; proliferative verrucous oral leukoplakia=aJK; hereditary autosomal dominant spastic paraplegia=ajl; megacolon, not hirschsprung's=aJl; metastases to ovary=ajL; retinomas (translucent, grayish retinal mass protruding into the vitreous)=aJL; cerebral palsy, spastic, diplegiac=ajm; megacolon=aJm; chronic pelvic pain of female=ajM; tubular adenomas and adenocarcinomas=aJM; vaginal cancer=aJN; clear cell adenofibroma=aJn; idiopathyic interstitial pneumonia=ajn; chondritis=ajN; polychondritis=ajO; cervicitis=aJO; donohue syndrome=ajo; cystadenofibroma=aJo; intrauterine growth retardation, metaphyseal dysplasia, adrenal hypoplasia congenita, and genital anomalies=aJp; neuropathy, hereditary sensory, type if=ajp; pelvic pain=ajP; peniale neoplasm=aJP; gestational choriocarcinoma=aJq; anus cancer=aJQ; at, complementation group e=ajq; myoclonic cerebellar dyssynergia=ajQ; supratentorial cancer=aJR; ulnar-mammary syndrome=aJr; ataxia-telangiectasisa variant=ajr; sly syndrome=ajR; diurnal dystonia=ajs; ovarian brenner turner=aJS; dacryoadenitis=ajS; sarcoma family syndrome of li and fraumeni=aJs; trichoepithelioma multiple familial=aJt; central nervous system leukemia=ajT; liver angiosarcoma=aJT; contralateral breast cancer=ajt; bladder squamous cell carcinoma=aJU; Polyomavirus infections=aju; melanoma-pancreatic cancer syndrome=aJu; relapsing polychondritis=ajU; aggressive periodontitis, generalized=ajv; melanoma, cutaneous malignant, susceptibility to, 2=aJv; amelanotic melanoma=aJV; krukenberg carcinoma=ajV; aggressive non-hodgkin lymphoma=ajw; brugada syndrome=ajW; papillary squamous carcinoma=aJW; melanoma astrocytoma syndrome=aJw; radiation damage=ajx cerebellar liponeurocytoma=ajX; benign meningioma=aJX; oculopalateocerebral syndrome=aJx cerebral small vessel diseases=aJy; brain stem astrocytic neoplasm=aJY; retinal nonattachment, nonsyndromeic congenital=ajY; lymphoblastic leukemia in children=ajy; eye carcinoma in situ=ajZ; physical function=aJz; microcystic adenoma=aJZ; cervical cancer stage=ajz; bipolar disorder=ak; plaque, amyloid=aK; patent ductus arteriosus=AK; syndactyly=Ak; chromosome 10, monosomy 10p=aKA; benign familial neonatal epilepsy=akA; keratinizing squamous cell carcinoma=aKa; persistent hyperplastic primary vitreou=aka; vascular: intracranial=akb; episodic ataxia=akB; cervix small cell carcinoma=aLB; amyloidosis, hereditary, transthyretin-related=aKB; neuropathy ataxia and retinis pigmentosa=akc; pineal region germinoma=aKc; dystonia 12=akC; maturity-onset diabetes of the young, type 8, with exocrine dysfunction=aKC; hypopharynx cancer=aKd; renal tubular acidosis=akd; cerebral palsy, ataxias, autosomal recessive=aKD; dystonia 3, torsion, x-linked=akD; alternating hemiplegia of childhood 2=akE; senile cardiac amyloidosis=aKE; juvenile myelomonocytic leukemia=aKe; leigh disease=ake; gastrointestinal symptom=akf; capes syndrome=akF; benign symmetrical lipomatosis=aKF; alcohol dependence=aKf; infantile malignant osteopetrosis=akg; late-onset disorders=a KG; neonatal infection=akG; holoprosencephaly 11=aKg; meier-gorlin syndrome 4=aKh; sensorineural hearing loss, bilateral=akh; protein misfolding disorders=aKH; motor disorder=akH; ulnar nerve entrapment=aKI; deformity of bone=aki; chronic mountain sickness=akl; barrett's esophagu=aKi; atrophy of pancreas=aKJ; recurrent ulcer=akj; brody myopathy=akJ; bile reflux=aKj; non-st elevation (nstemi) myocardial infarction=akk; acute respiratory disease=aKK; muscle relaxation=akK; glandular cystitis=aKk; central core myopathy=akL; mucinous intrahepatic cholangiocarcinoma=aKI; hyperostosis=akl; alcohol-induced chronic pancreatitis=aKL; darier disease, segmental=akM; lipomatosis=a KM; deafness, autosomal dominant 4=a Km; eosinophilic esophagitis=a km; darier disease, acral hemorrhagic type=akN; wolman disease=aKN; deafness, autosomal dominant 4b=aKn; dyspepsia=akn; disseminated eosinophilic collagen disease=aKO; follicular carcinoma, widely invasive=aKo; keratosis follicularis=akO; speech and language disorder=akn; myocardial stunning=akP; benign epilepsy with centrotemporal spikes=akp; colon carcinoma in situ=aKp; loeffler syndrome=aKP; hailey-hailey disease=akQ; microcephaly, primary autosomal recessive, 6=aKQ; myeloid turner suppressor=aKq; episodic ataxia with nystagmus=akq; hemiplegiac migraine, familial type 2=akr; pericentrin=aKR; familial acute myeloid leukemia with mutated cebpa=aKr; sphingolipidosis=akR; deafness, autosomal recessive 12=akS; histiocytic leukemia=aKs; microcephaly 8, primary, autosomal recessive=aKS; alternating hemiplegia of childhood=aks; alternating hemiplegia of childhood 1=akt; microcephaly 9, primary, autosomal recessive=aKT; encephalyomyelitis=akT; specific granule deficiency=aKt; polyarteritis nodes=aKu; migraine, familial basilar=aku; spinocerebellar ataxia, x-linked 1=akU; seckel syndrome 5=aKU; ataxia telangiectasis=aKV; olivopontocerebellar atrophy=akV; ventilator-induced lung injury=akv; symptoms/complaints of eyelids=aKv; hemiplegiac migraine=akw; mitochondrial complex v (atp synthase) deficiency, nuclear type 4=akW; nephronophthisis 15=aKW; pancreatic insufficiency=aKw; spinocerebellar ataxia 17=akX; pancreatic malabsorption=aKx; epilepsy and migraine=akx; morbid obesity and spermatogenic failure=aKX; exocrine pancreatic insufficiency=aKy; joubert syndrome 5=aKY; mitochondrial complex v (atp synthase) deficiency, nuclear type 3=akY; transient neurological symptoms=aky; complex v deficiency=akZ; migraine with typical aura=akz; congenital hypoplasia of thymus=aKz; senior-loken syndrome 6=aKZ; aural atresia, congenital=aL; spermatogenic failure 10=al; loeys-dietz syndrome=AL; craniosynostosis=Al; leber congenital amaurosis 10=aLa; kearns-sayre syndrome=ala; deficiency of ferroxidase=alA; macular degeneration, age-related, 4=aLA; meckel syndrome, type 4=aLb; marie unna congenital hypotrichosis=alb; kayser-fleischer ring=alB; complement factor i deficiency=aLB; hereditary sensory autonomic neuropathy, type 2=alc; cirrhosis, familial, with pulmonary hypertension=aIC; basal laminar drusen=aLC; bardet-biedl syndrome 14=aLc; acute hepatitis e=ald; heart cancer=alD; reducing-body myopathy=aLD; joubert syndrome 15=aLd; scapuloperoneal myopathy=aLE; cervix disease=ale; cerebellar ataxia, mental retardation, and dyseguilibrium syndrome 4=alE; mosaic variegated aneuploidy syndrome 2=aLe; attention deficit and disruptive behavior disorders=alF; seckel syndrome 6=aLf; anogenital venereal wart=alf; properdin deficiency disease=aLF; greig cephalyopolysyndactyly syndrome=alg; cholestasis, intrahepatic, of pregnancy, 1=alG; nephronophthisis 2=aLg; multifocal choroiditis=aLG; cowpox=alh; hemorrhagic colitis=aLH; idiopathyic chronic pancreatitis=alH; retinitis pigmentosa 26=aLh; mitochondrial complex v (atp synthase) deficiency, nuclear type 1=all; renal disease (acute) nos=aLI; ichthyosis, congenital, autosomal recessive 9=aLi; esophagitis=ali; mental retardation, x-linked, with epilepsy=alj; primary hypercholesterolemia=aLj; nonexudative age-related macular degeneration=aLJ; mitochondrial complex v (atp synthase) deficiency, atpaf2 type=alJ; hiv nephropathy=aLK; parkinsonism with spasticity, x-linked=alk; cutaneous telangiectasisa and cancer syndrome, familial=alK; heterotaxy, visceral, 6, autosomal=aLk; blepharophimosis=alL; dna virus infections=all; van der woude syndrome 2=aLl; ocular sarcoidosis=aLL; verotoxigenic *Escherichia coli* gastrointestinal tract infection=aLM; hemolytic uremic syndrome, atypical, susceptibility to, 4=aLm; williams-beuren syndrome=alM; wrinkly skin syndrome=alm; complement abnormality=aLN; costeff optic atrophy syndrome=alN; complement factor b deficiency=aLn; cutis laxa, autosomal recessive, type iia=aln; enlarged vestibular agueduct=aln; necrotizing ulcerative gingivitis=aLo; endocapillary glomerulonephritis=aLO; immunodeficiency syndrome, variable=alO; alpha-thalassemia myelodysplasia syndrome=alP; panuveitis=aLP; transposition of the great arteries, dextro-looped 1=aLp; renal tubular acidosis, distal, autosomal recessive=alp; relapsing fever=aLQ; conotruncal cardiac defects=aLq; renal tubular acidosis, distal, autosomal recessive, with late-onset sensorineural hearing loss=alq; psychomotor impairment=alQ; tick-borne relapsing fever=aLR; heterotaxy, visceral, 2, autosomal=aLr; generalized pruritus=alR; renal tubular acidosis, distal, with progressive nerve deafness=air; congenital afibrinogenemia=aLS; neural hearing loss=als; rubinstein-taybi syndrome=alS; transposition of the great arteries, dextro-looped 2=aLs; adult astrocytic tumorur=alT; misalignment=aLt; distal myopathy, nonaka type=alt; proliferative glomerulonephritis=aLT; occipital horn syndrome=alu; coffin-lowry syndrome=alU; cfhr5 deficiency=aLU; polysplenia syndrome=aLu; spinocerebellar ataxia 10=alV; double outlet right ventricle=aLv; thin basement membrane disease=aLV; spinal muscular atrophy, distal, x-linked 3=alv; complement factor d deficiency=aLw; spinocerebellar ataxia 36=alW; salla disease=alw; disorder of complement=aLW; spinocerebellar ataxia 2=aIX; hemolytic uremic syndrome, atypical, susceptibility to, 3=aLX; hypocupremia=alx; neisseriaceae infections=a Lx; blotchy=aly; arthus reaction=aLy; macular degeneration, age-related, 13=aLY; spinocerebellar degenerations=alY; progressive cerebellar degeneration=alZ; sialuria=alz; rigid spine syndrome=aLz; acute hemorrhagic leukoencephalyitis=aLZ; diabetes=aM;

juvenile-onset dystonia=AM; male infertility=am; ptosi=Am; respiratory morbidity=aMA; decreased tendon reflex=ama; hypersexuality state=amA; nemaline myopathy 7=aMa; chronic hyponatremia=amB; properdin deficiency, x-linked=aMb; teratospermia=aMB; tdp-43 proteinopathyies=amb; autosomal dominant parkinsonism=amc; dysthymic disorder=amC; abnormal spermatogenesis=aMC; properdin deficiency, type iii=aMc; properdin deficiency, type ii=aMd; action tremor=amd; hypotonic dehydration=aMD; premature ejaculation=amD; paranasal sinus disease=aME; simple febrile seizure=aMe; calcaneal apophysitis=ame; inappropriate adh syndrome=amE; end-position nystagmus=amf; myotonia congenita=aMf; flat ductal epithelial atypia=amF; gastrointestinal system disease=aMF; bronchiectasis with or without elevated sweat chloride 1=aMg; maxillary sinusitis=aMG; aspartylglucosaminuria=amG; nervous system-degeneration=amg; melancholia=amH; colonic disease=aMH; lactose intolerance, adult type=aMh; dyssomnias=amh; azotemia=ami; lactase persistence=aMi; typhoid fever=aMI; cataplexy and narcolepsy=ami; genetic diseases, x-linked=amJ; hepatobiliary disease=aMJ; pancreatitis idiopathyic=aMj; amyloid polyneuropathy type i=amj; pancreas divisum=aMk; ileus=aMK; pure autonomic failure=amk; osteomalacia=amK; echngenic bowel=aMI; effects of heat=ami; x-linked hypophosphatemiac rickets=amL; mite infestation=aML; burkholderia infections=aMm; congenital secretory chloride diarrhea=aMM; conotruncal anomaly face syndrome=amM; hereditary antithrombin iii deficiency=amm; 3b-hydroxysteroid dehydrogenase deficiency=aMN; caudal duplication anomaly=amN; exotropia=amn; child nutrition disorders=aMn; bicuspid aortic valve=amO; congenital absence of vas deferens=aMo; protein c deficiency=amn; epidermaolysa bullosa simplex and limb girdle muscular dystrophy=aMO; congenital absence of kidney=aMp; choroidal dystrophy, central areolar 2=amp; thyroid cancer, follicular=aMP; oligodontia-colorectal cancer syndrome=amP; uterus leiomyosarcoma=amg; autoimmune pancreatitis=aMq; tenth agenisi, selective, 1=amQ; severe hereditary factor viii deficiency disease=aMQ; parainfluenza=aMr; hormone related neoplasm/cancer=aMR; male infertility with large-headed, multiflagellar, polyploid spermatozoa=amr; hypodontia=amR; cleft palate with cleft lip=amS; fibrocystic disease of pancreas=aMs; primary infertility=ams; temper tantrum=aMS; nephrogenic syndrome of inappropriate antidiuresis=amt; wasting syndrome=amT; pulmonary *Mycobacterium avium* complex infection=aMt; congenital myasthenic syndrome with episodic apnea=aMT; antibiotic-associated diarrhea=amU; hypertelorism with esophageal abnormality and hypospadias=amu; chronic lung injury=aMu; epileptic encephalyopathy, childhood-onset=aMU; driving under influence of alcohol or drugs=amV; scoliosis, idiopathyic, susceptibility to, 3=aMV; infectious disorder of bronchus=aMv; familial diabetes insipidus=amv; cytomaegalovirus encephalyitis=amW; familial central diabetes insipidus=amw; idiopathyic bronchiectasis=aMw; idiopathyic hypogonadotropic hypogonadism=aMW; multiple trauma=amx hypogonadotropic hypogonadism 5 with or without anosmia=aMX; bilateral agenisi=aMx amyloidosis, familial visceral=amX; distal ileal obstruction syndrome=a My; paraproteinemias=amY; mixed sensory-motor polyneuropathy=amy; kallmann syndrome 5=aMY; hemifacial microsomia=aMZ; polydipsia, psychogenic=amz; chronic emphysema=aMz; hemodialysis-associated amyloidosis=amZ; adenocarcinoma, endometrioid=An; iris coloboma with ptosis, hypertelorism, and mental retardation=AN; senile plague=aN; spots on skin=an; peripheral neuroepithelioma=ana; frontotemporal dementia, chromosome 3-linked=aNA; ear malformation=aNa; endometrial clear cell adenocarcinoma=anA; multifocal motor neuropathy=anB; amyotrophyic lateral sclerosis, chmp2b-related=aNB; plasmacytic leukemia=anb; goldenhar syndrome=aNb; blood group antigen p=anc; facial paralysis=aNc; cornea cancer=anC; anemia, hypochromic microcytic=aNC; muscular dystrophy-dystroglycanopathy (congenital with brain and eye anomalies), type a, 11=and; cataract, posterior polar, 3=aND; choanal atresia=aNd; turner predisposition syndrome=anD; krause-kivlin syndrome=ane; duane retraction syndrome 2=aNE; autism, susceptibility to, 18=aNe; benign pleural mesothelioma=anE; duane syndrome=aNF; leukemia, large granular lymphocytic=anf; right ventricular outflow tract obstruction=aNf; benign intermediate mesothelioma=anF; manifest vertical sguint=aNG; paraganglioma=anG; t-cell lymphocytosis=ang; li-fraumeni syndrome 2=aNg; exoskeletal myxoid chondrosarcoma=aNH; iridogoniodysgenesis, dominant type=anH; hodgkin's lymphoma, nodular sclerosis=anh; encounter due to estrogen receptor status=aNh; rieger eye malformation seguence=anl; chronic non-a non-b hepatitis=aNI; endometrial diseases=aNi; multiple joint dislocations, short stature, craniofacial dysmorphism, and congenital heart defects=ani; childhood teratoma=aNj; spastic paraplegia 26, autosomal recessive=anj; axenfeld-rieger syndrome=anJ; fumarase deficiency=aNJ; social anhedonia=aNK; mobius syndrome=anK; skeletal malformation=aNk; congenital disorder of glycosylation type 2d=ank; fibrous bands=anL; congenital anomaly of skeletal bone=aNI; luft disease=aNL; congenital disorder of glycosylation, type iiid=anl; carnitine deficiency=aNM; ehlers-danlos syndrome progeroid typ=anm; endometrioid ovary carcinoma=anM; islet cell turner syndrome=aNm; muscular dystrophy-dystroglycanopathy (congenital with brain and eye anomalies), type a, 13=ann; cecum adenocarcinoma=aNn; mitochondrial myopathy=aNN; bardet-biedl syndrome 10=anN; pyruvate decarboxylase deficiency=aNO; meckel syndrome, type 9=ano; small intestine neuroendocrine neoplasm=aNo; bardet-biedl syndrome 12=anO; zollinger-ellison syndrome=aNp; meckel syndrome, type 10=anp; brain stem glioma=aNP; diabetes mellitus, insulin-dependent, 4=anP; carnitine palmitoyltransferase ii deficiency=aNQ; bardet-biedl syndrome 1=anQ; collagenous colitis=aNq; hypercholanemia, familial=anq; mckusick kaufman syndrome=anR; lymphocytic colitis=aNr; mandibular hypoplasia=aNR; hemolytic uremic syndrome, atypical, susceptibility to, 1=anr; asthma-related traits, susceptibility to, 7=aNs; bardet-biedl syndrome 2=anS; cornealia de lange syndrome=aNS; down syndrome critical region=ans; herniated disk=aNt; gastrinom=anT; head-cancer=ant; megalocornea=aNT; catatonia=aNO; bardet-biedl syndrome 4=anO; gram-positive bacterial infections=aNu; periampullary adenocarcinoma=anu; myopathy, myofibrillar, bag3-related=anv; bardet-biedl syndrome 7=anV; chromosome 15q13.3 microdeletion syndrome=aNV; chitotriosisdase deficiency=aNv; filariasis=aNw; cardiomyopathy, dilated, lhh=anw; exencephaly=anW; airway constriction=aNW; infectious pustular vulvovaginitis=anx; myoglobinuria, recurrent=aNx; bardet-biedl syndrome 9=anX; pemphigu=a NX; muscular dystrophy, congenital, megaconial type=aNy; crescentic glomerulonephritis=anY; benzodiazepine abuse=any; bladder disease=aNY; myasthenic syndrome, congenital, fast-channel=aNZ; nestor-guillermo progeria syndrome=anz; rapidly progressive glomerulonephritis=anZ; pontocerebellar hypoplasia, type 8=aNz; amyotrophyic lateral sclerosis=ao; postmenopausal endometrium=Ao; familial hypophosphatemiac rickets=AO; ischemias cerebrovascular accident=aO; plasma cell neoplasm=aoA; macular corneal dystrophy, type ii=aOA; familial dilated cardiomyopathy=ana; myasthenic syndrome, congenital, postsynaptic slew-channel=aOa; fetal hemoglobin quantitative trait locus 5=aoB; contiguous abcd1/dxs1375e deletion syndrome=aob; corneal dystrophy=aOB; tobacco dependencye=aOb; epilepsy, nocturnal frontal lobe, type 4=aOc; dermatitis and eczema=aoC; macular corneal dystrophy=aOC; htlv-ii infections=aoc; developmental verbal dyspraxia=and; thoracic outlet syndrome=aoD; autosomal dominant nocturnal frontal lobe epilepsy=aOd; temtamy preaxial brachydactyly syndrome=aOD; estrogen resistance=aoe; corneal dystrophy, fuchs' endothelial, I=aoE; frontal lobe epilepsy=aOe; tumoral calcinosis, hyperphosphatemiac, familial=aOE; lung cancer susceptibility 2 (disorder)=aOf; diamond-blackfan anemia 1=aoF; oral pharyngeal disorder=aof; hyperostosis-hyperphosphatemia syndrome=aOF; smokers lung=aOg; usher syndrome, type ij=aOG; syndactyly, type iv=aoG; yersinia infections=ang; tuberculosis, extrapulmonary=aoh; persistent polyclonal b-cell lymphocytosis=aoH; deafness, autosomal recessive 48=aOH; epilepsy, nocturnal frontal lobe, type 1=aOh; electrnencephalyngram, low-voltage=aOi; hypertrichosis congenital generalized x-linked=aol; thomsen disease=aOI; breast cancer (non-specific) premenopausal=aoi; lipodystrophy, familial partial, type 5=aOJ; bamforth syndrome=aoj; ring chromosome 20 syndrome=aOj; depletion of mitochondrial dna=aoJ; uterine cervical dysplasia=aoK; bare lymphocyte syndrome, type ii, complementation group a=aOK; butyrylcholinesterase deficiency=aok; nocturnal epilepsy=aOk; venous retinal branch occlusion=aoL; north american indian childhood cirrhosis=aOL; gestational trophyoblastic disease=aol; schizephrenia 13=aOl; apnea, postanesthetic=aom; ichthyosis, leukocyte vacuoles, alopecia, and sclerosisng cholangitis=aOM; myasthenic syndrome, congenital, type id=aOm; chronic idiopathyic neutropenia=aoM; butyrylcholinesterase deficiency, fluoride-resistant, Japanese type=aon; wolfram syndrome 2=aON; superinfection=anN; epilepsy, nocturnal frontal lobe, type 3=aOn; skin manifestations=aOo; wolfram syndrome=aOO; weakness of limb=aoo; oropharynx (excludes nasopharynx)=aoO; myelokathexis=aoP; pena shokeir syndrome, type 1=aOp; diabetes insipidu=aOP; attention deficit-hyperactivity=aop; adult-onset obesity=aoq; clinically isolated syndrome=aOQ; canarypox=aoQ; pregnancy complications, parasitic=aOq; intrauterine infection=aOR; prolonged neuromuscular block=aor; mixed cryoglobulinemia=aoR; ehlers-danlos syndrome, musculocontractural type 1=aOr; churg-strauss syndrome=aos; ehlers-danlos syndrome 6b=aOs; filarial elephantiasis=aOS; primary cutaneous b-cell lymphoma=aoS; kidney clear cell sarcoma=aOT; joint instability=aOt; maple syrup urine disease, type ia=ant; growth hormone treatment=aoT; ventricular septal defect 2=aOU; lymphocytic lymphoma=anU; spondyloepiphyseal dysplasia, omani type=aOu; branched-chain ketoacid dehydrogenase kinase deficiency=aou; neoplasms, plasma cell=aov; follicular lymphoma, grade 1=aoV; atrial septal defect 8=aOV; apparent mineralocorticoid excess=aOv; multicystic dysplastic kidney=aoW; larsen syndrome, recessive type=aOw; follicular neoplasm=aow; cervical dystonia, primary=aOW; sertoli-leydig cell turner of intermediate differentiation=aOx; gastritis H pylori=anx; malignant lymphoma—lymphocytic, intermediate differentiation=aoX; adult-onset dystonias=aOX; hay-wells syndrome=aOY; in situ cancer=aoY; sertoli-leydig cell turner=aOy; plasma cell turner, malignant=aoy; rapp-hodgkin syndrome=aOZ; colon mucinous adenocarcinoma=aOz; primary cutaneous diffuse large cell b-cell lymphoma=aoZ; overnutrition=aoz; alpha-1-antitrypsin deficiency, autosomal recessive=aP; premature menopause=Ap; cardiovascular system disease=ap; craniofacial abnormalities=AP; werdnig-hoffmann disease=apA; propping zerres syndrome=aPa; follicular non-hodgkin's lymphoma, large cell (clinical)=apa; dent disease=aPA; granular cell turner=apB; stage i endometrial cancer=apb; ectrodactyly-cleft lip/palate syndrome=aPb; osteopetrosis, autosomal recessive 4=aPB; foot deformities, congenital=aPc; muscle benign neoplasm=apC; enterochromaffin-like cell carcinoid=apc; osteopetrosis, autosomal dominant 2=aPC; minor oral aphthous ulceration=aPd; cryoglobulinemia=apD; sindbis virus infection=apd; bartter syndrome, type 4a=aPD; cleft lip, isolated=aPe; bartter syndrome, type 4b=aPE; female reproductive endometrioid cancer=apE; codependency=ape; limbal stem cell deficiency=aPf; bartter syndrome, type 3, with hypocalciuria=aPF; essential mixed cryoglobulinemia=apf; inverted papilloma=apF; cervical adenocarcinoma=apG; clouston syndrome=aPg; endometrial cancer stage=apg; hypokalemic alkalosis=aPG; extranodal lymphoma=aph; mesenchymal chondrosarcoma=apH; gray zone lymphoma=aPh; deafness, autosomal recessive 29=aPH; aphthous stomatitis=aPi; follicular lymphoma, grade 3=api; focal epithelial hyperplasia=apI; manz syndrome=aPI; cerebral lymphoma=apJ; acalculous cholecystitis=aPJ; laryngeal papillomatosis=apj; ulcerative stomatitis=aPj; fibrillary astrocytoma=apK; exertional rhabdomyolysis=aPk; atypical burkitt's lymphoma=apk; gelatinous drop-like corneal dystrophy=aPK; lymphoma of intestine=aPL; epithelial inclusion cyst=apl; punctate inner choroidopathy=aPl; protoplasmic astrocytoma=apL; menstrual spotting=aPM; precursor b lymphoblastic lymphoma/leukemia=apM; hepatic encephalyopathy=aPm; cerebellar decompression injury=apm; intraocular lymphoma=apN; lymphoma, follicular, grade 2=apn; cold-induced sweating syndrome 2=aPn; piebaldism=aPN; Scheuermann's disease=aPO; liver lymphoma=apo; venous hypertension=apo; cold-induced sweating syndrome 1=aPo; mast-cell leukemia=apP; urinary outflow obstruction=app; congenital myotonia, autosomal recessive form=aPp; familial chronic mucocutaneous candidiasis=aPP; obscure african cardiomyopathy=aPq; disuse osteoporosis=apq; xeroderma pigmentosaum=apQ; vulvovaginal candidiasis=aPQ; survival motor neuron spinal muscular atrophy=apR; myotonia levior=aPr; grade 3b follicular lymphoma=apr; acute gastric mucosal erosison=aPR; functionless pituitary adenoma=apS; myotonic disease=aPs; intestinal pseudo-obstructio=aPS; drugged state=aps; morphea=apt; thymus neoplasms=apT; myotonic dystrophy type=aPt; ceroid lipofuscinosis, neuronal, 2=aPT; precursor b-cell lymphoblastic lymphoma=apu; cleft lip with or without cleft palate=apU; megalencephalyic leukoencephalyopathy with subcortical cysts=aPu; juvenile disease=aPU; otofaciocervical syndrome 1=apV; infantile disease=aPV; leukoencephalyopathy with ataxia=aPv; nervous system cancer=apv; alkalemia=aPW; epilepsy with grand mal seizures on awakening=aPw; thyroid lymphoma=apw; htlv infections=apW; rabies=apx; ceroid lipofuscinosis, neuronal 5=aPX; hodgkin lymphoma, nodular lymphocyte predominance=apX; low molecular weight proteinuria with hypercalciuria and nephrocalcinosis=aPx; parkinson disease 9=aPY; retinitis=apy; nephrolithiasis, x-linked recessive, with renal failure=aPy; primary cutaneous large b-cell lymphoma of the leg=apY; renal tubular transport disease=aPz; ceroid lipofuscinosis, neuronal 8=aPZ; oculopharyngeal muscular dystrophy=apz; idiopathic cd4-positive t-lymphocytopenia=apZ; cerebral vasospasm=Aq; down syndrome=aq; renal phosphaturia=AQ; embolism, paradoxical=aQ; adult neuronal ceroid lipofuscinosis=aQa; achromatopsia 1=aQA; psychiatric hospitalization=aqA; composite lymphoma=aqa; achromatopsia=aQB; psychiatric diagnosis=aqB; high grade b-cell non-hodgkin's lymphoma=aqb; ceroid lipofuscinosis, neuronal, 6=aQb; hypercarotenemia and vitamin a deficiency, autosomal dominant=aqc; self-induced vomiting=aqC; ceroid lipofuscinosis, neuronal, 8=aQc; retinitis pigmentosa 45=aQC; microphthalmia, syndromeic 2=aqd; feeling despair=agD; thinness=aOd; progressive retinal atrophy=aQD; microphthalmia, syndromeic 1=aqe; emotional disturbance=aqE; anorexia and bulimia syndrome=aQe; stargardt disease 1=aQE; myeloid metaplasia=aqf; clinical anxiety=aqE; winter depression=aQf; congenital hypothyroidis=aQF; sleep-wake schedule disorder, advanced phase type=aQg; acute disseminated encephalyitis=aqG; eosinophilic leukemia=aqg; hypomagnesemia 6, renal=aQG; amaurosis hypertrichosis=aQH; circadian rhythm disorder=aQh; vegetative state=aqH; autosomal recessive agammaglobulinemia=aqh; reversible cerebral vasoconstriction syndrome=aqI; jalili syndrome=aQI; stereotypic movement disorder=aqi; delayed sleep phase=aQi; post-traumatic vegetative state=aqJ; aortic valve insufficienc=aQJ; mitochondrial complex iii deficiency=aqj; high-functioning autism=aQj; iv drug use=aQK; g fever=aQk; psychosocial stressor=aqK; mitochondrial complex iii deficiency, nuclear type 1=aqk; gonadal dysgenesis xx type deafness=aQI; leigh syndrome due to mitochondrial complex iii deficiency=aqI; adult attention deficit hyperactivity disorder=aqL; polysubstance abuse=aQL; ubiguinone dehydrogenase=aqm; perfectionism=aQM; perrault syndrome 3=aQm; spine degeneration=aqM; nerve pain=aqN; deafness, autosomal recessive 81=aQn; abdominal discomfort=aQN; hepatic veins thrombosis=aqn; cold-induced sweating syndrome=aQO; hydroxyacyl-coa dehydrogenase, type 2, deficiency=aqo; intrapartum fetal hypoxia=aqO; retinitis pigmentosa 61=aQo; circling behavior=aQp; tobacco addiction, susceptibility to=aqp; dissociative disorder=aqP; myopathy, congenital, compton-north=aQP; eating disorder=aqQ; auditory system disease=aQq; epilepsy, familial adult myoclonic, 5=aQQ; wounds, penetrating=aqq; aggressive periodontitis, localized=aQr; pain, referred=aqr; pitt-hopkins syndrome=aQR; riley-day syndrome=aqR; cortical dysplasia-focal epilepsy syndrome=aQS; herein abuse=aqs; wagr syndrome=aqS; adult atopic dermatitis=aQs; social stress=aqt; conversion disorder=aqT; aortic stenosis symptomatic=aQt; language development disorders=aQT; telangiectasisa, hereditary benign=aQu; Wernicke encephalyopathy=aqU; autism, susceptibility to, 15=aQU; methamphetamine dependencye=aqu; brain morphology=aqv; pitt-hopkins-like syndrome 1=aQV; post-partum depression=aqV; porokeratosis=aQv; selective mutism=aqW; impulsive aggression=aqw; spinocerebellar ataxia 31=aqW; neurologic manifestations=aQw; marie's cerebellar ataxia=aqX; stuttering=aQX; depressive episode, unspecified=aqx retinitis pigmentosa 49=aQx; neurodegeneration with brain iron accumulation 6=aQY; spinocerebellar ataxia 4=aqY; achromatopsia 3=aQy; chronic depression=aqy; pseudohypoparathyroidism and pseudopseudohypoparathyroidism=aQZ; achromatopsia 2=aQz; depressive disorder, treatment-resistant=aqz; hemangiom=aqZ; deep thrombophlebitis=aR; adenocarcinoma=ar; familial x-linked hypophosphatemiac vitamin d refractory rickets=AR; nemaline myopathy 3=Ar; vitreous syneresis=aRA; deafness, autosomal dominant 9=aRa; bestrophyinopathy=ara; rickets=arA; saethre-chotzen syndrome=arB; doyne honeycomb retinal dystrophy=arb; fibrochondrogenesi=aRB; usher syndrome, type 1f=aRb; ossifying fibroma=arC; dominant sensorineural hearing loss=aRc; dilated cardiomyopathy 3b=arc; deafness, autosomal dominant 13=aRC; late-onset retinal degeneration=ard; pierre robin syndrome with fetal chondrodysplasia=aRD; autoimmune sensorineural hearing loss=aRd; camurati-engelmann disease=arD; inner ear disease=aRe; deafness, autosomal recessive 53=aRE; scleroatonic muscular dystrophy=arE; retinitis pigmentosa, concentric=are; ocular hypotension=aRf; chondrodysplasia punctata, x-linked dominant type=arF; megaepiphyseal dwarfism=aRF; macular dystrophy, vitelliform, adult-onset=arf; labyrinthine disease=aRg; chief cell adenocarcinoma=arG; macular dystrophy, vitelliform=arg; stickler syndrome, type 3=aRG; sarcoglycanopathyies=arh; fibrochondrogenesis 2=aRH; vestibular disease=aRh; split-hand/foot malformation with long bone deficiency=arH; grip strength decreased=aRI; macular dystrophy, concentric annular=ari; congenital disorder of glycosylation, type 2g=aRi; split-hand/foot malformation=ari; microcornea, rod-cone dystrophy, cataract, and posterior staphyloma=arj; cerebrocostomandibular-like syndrome=aRj; exostosis= aRJ; limb defects=arJ; glucose-galactose malabsorption= arK; dmd-associated dilated cardiomyopathy=ark; cerebrocostomandibular syndrome=aRk; smith-mccort dysplasia= aRK; sorsby's fundus dystrophy=ari; congenital disorder of glycosylation, type iij=aRI; paroxysmal ventricular fibrillation=arL; epidermaolysis bullosa, junctional, non-herlitz type=aRL; epidermaolysis bullosa, junctional, localisata variant (disorder)=aRM; erythrokeratoderma=arM; deformity of limb=arm; congenital disorder of glycosylation, type iii=aRm; carbohydrate intolerance=arN; myopathy with abnormal lipid metabolism=arn; linear iga bullous dermatosis=aRN; congenital disorder of glycosylation, type iiI=aRn; junctional epidermaolysis bullosa mitis=aRO; shaheen syndrome=aRo; age-related osteoporosis=aro; inherited platelet disorder=arO; high weight=arp; lichen planus pemphigoides=aRP; duane retraction syndrome=arP; congenital disorder of glycosylation type 2e=aRp; autoimmune skin disease=aRQ; idiopathyic juvenile osteoporosis=arq; congenital disorder of glycosylation, type iih=aRg; glanzmann's thrombasthenia=arQ; wet macular degeneration=arr; opitz gbbb syndrome, x-linked=aRr; localized junctional epidermaolysis bullosa=aRR; leukocyte adhesion deficiency=arR; poikiloderma of kindler=arS; cataract, cortical, juvenile-onset=ars; cicatricial pemphigoid=aRS; metaphyseal chondrodysplasia schmid type=aRs; mast-cell sarcoma=aRT; epidermaolysis bullosa letalis=arT; cataract, age-related nuclear=art; arthropathy, progressive pseudorheumatoid, of childhood=aRt; congenital anosmia=aRU; coxa vara (acguired)=aRu; generalized epidermaolysis bullosa simplex=arU; cataract, autosomal dominant=aru; cartilage disease=aRv; cataract 12, multiple types=arv; rundown=arV; d-2-hydroxyglutaric aciduria 2=aRV; weaver syndrome=aRw; epidermaolysis bullosa simplex=arW; osteogenesis imperfecta, recessive perinatal lethal=aRW; cataract, autosomal dominant, multiple types 1=arw; hyaloideoretinal degeneration of wagner=aRx short-sleeper=arX; oi/eds combined syndrome=aRX; vitamin d-resistant rickets, hereditary=arx; spinal fractures=aRY; dental fluorosis=ary; fibrochondrogenesis 1=aRy; choline deficiency disease=arY; lumbar disc herniation, susceptibility to=aRz; heterotaxy, visceral, 5, autosomal=arZ; vitamin d-resistant rickets=arz; oral manifestations=aRZ; alpha-2-macroglobulin deficiency=aS; myopathy, actin, congenital, with cores=As; motor disturbances=AS; exanthema=as; polycystic kidney disease 1=asa; soft tissue injuries=aSa; chronic venous insufficiency=asA; trichorhinophalangeal syndrome=aSA; biogenesis of lysosome-related organelles complex 1, subunit 3=asB; renal dysplasia, cystic, susceptibility to=ash; congenital infectious disease=aSB; giant cell fibroblastoma=aSb; renal dysplasia diffuse cystic=asc; bacterial osteomyelitis=asC; avascular necrosis of the capital femoral epiphysis=aSC; bruck syndrome=aSc; claudication= aSD; hermansky-pudlak syndrome 9=asD; polycystic kidney-body part=asd; brittle bone disorder=aSd; spinal muscular atrophy, lower extremity-predominant, 2, autosomal dominant=ase; emphysema, hereditary pulmonary=asE; lipodermatosclerosis=aSe; congenital vitreous anomaly=aSE; collagen disease=aSf; juvenile spinal muscular atrophy=asf; empty vitreous=aSF; hyperbiliverdinemia=asF; peritoneal mesothelioma=asg; caffey disease=aSg; pygmy=asG; legg-calve-perthes disease=aSG; maxillofacial abnormalities=aSH; nutrition disease=asH; lesion of stomach=ash; cervical incompetence=aSh; aortic aneurysm, familial abdominal I=aSI; laron syndrome=asl; sclerosteosis=aSi; extranodal marginal zone b-cell lymphoma=asi; pseudosarcomatous fibromatosis=asj; cystocele=aSJ; familial amyloid polyneuropathy, type iv=asJ; ehlers-danlos syndrome, cardiac valvular form=aSj; gastrointestinal lymphoma=ask; osteogenesis imperfecta with blue sclerae and normal teeth=aSk; autosomal recessive chronic granulomatous disease=asK; acrogeria=aSK; childhood malignant schwannoma=asl; old thrombus=aSl; brucellosis=asL; hiatus hernia=aSL; type iii ehlers-danlos syndrome=aSM; intrinsic asthma=asm; fasciitis=aSm; bruton-type agammaglobulinemia=asM; alexander disease=asN; melorheostosis=aSN; stage iv skin melanoma=asn; serum creatinine=aSn; degenerative myopia=asn; basal-like breast carcinoma=asO; rectal prolapse=aSO; platyspondylic lethal skeletal dysplasia, torrance type=aSo; angiopathy, hereditary, with nephropathy, aneurysms, and muscle cramps=aSP; maturity-onset diabetes of the young, type 11=asp; cervical polyp=asP; stickler syndrome, type i, nonsyndromeic ocular=aSp; stickler syndrome, type 1=aSq; mutagen sensitivity=asg; childhood medulloblastoma=asQ; cerebral autosomal recessive arteriopathy with subcortical infarcts and leukoencephalyopathy=aSQ; haematotoxicity=asr; ovarian dysgenesis 2=asR; spondylometaphyseal dysplasia, kozlowski type=asr; hepatitis, infectious canine=aSR; epiphyseal dysplasia, multiple, with myopia and conductive deafness=aSs; irido-corneal dysgenesis=aSS; premature ovarian failure 4=asS; chromosome instability syndromes=ass; rothmund-thomson syndrome=ast; ovarian insufficiency=asT; osteoarthritis with mild chondrodysplasia=aSt; paralytic stroke=aST; spondyloperipheral dysplasia short ulna=aSu; porencephaly 2=aSU; agammaglobulinemia 4, autosomal recessive=asu; 46 xx gonadal dysgenesis=asU; persistent generalized lymphadenopathy=asv; osteogenesis imperfecta, type xiii=asV; pierson syndrome=aSV; czech dysplasia, metatarsal type=aSv; complement component deficiency=asw; corneal dystrophy, posterior polymorphous, 1=aSW; jaw abnormalities=aSw; pneumocystis infections=asW; parasitic helminthiasis infectious disease=asx alport syndrome, autosomal recessive=aSX; epidermaolysis bullosa dystrophyica=asX rhegmatogenous retinal detachment, autosomal dominant=aSx hematuria, benign familial=aSY; vitreoretinopathy with phalangeal epiphyseal dysplasia=aSy; trichorhinophalangeal syndrome type ii=asY; mast cell neoplasm=asy; benign mastocytoma=asz; ossification of the posterior longitudinal ligament of the spine=asZ; toxoplasmosis, ocular=aSz; alport syndrome, autosomal dominant=aSZ; baraitser-winter syndrome=AT; congenital myopathy=At; coronary artery disease=at; amyloidosis=aT; cholesteatoma=ata; alport syndrome, recessive type=aTa; epidermaolysis bullosa dystrophyica inverse, autosomal recessive=aTA; diaphanospondylodysostosis=atA; epidermaolysis bullosa dystrophyica, autosomal recessive, localisata variant=aTB; trigeminal neuralgia=atb; polyposis syndrome, hereditary mixed, 2=atB; benign hematuria=aTb; retinal lattice degeneration=aTc; chromosome 10g23 deletion syndrome=atC; root resorption=ate; dominant dystrophyic epidermaolysis bullosa=aTC; chondromalacia=atD; generalized dystrophyic epidermaolysis bullosa=aTD; chondroblastoma=atd; eye diseases, hereditary=aTd; oculodentodigital dysplasia=ate; chronic idiopathyic pulmonary fibrosis=aTe; localized recessive dystrophyic epidermaolysis bullosa=aTE; ebstein anomaly=atE; orofacial cleft 11=atf; anterior lenticonus=aTf; cushing's symphalangism= atF; epidermaolysis bullosa aeguisita=aTF; corneal dystrophy, posterior polymorphous, 2=aTG; chondrodysplasia, acromesomelic, with genital anomalies=atG; axenfeld-rieger syndrome, type 3=atg; antisynthetase syndrome=aTg; microphthalmia, syndromeic 6=ath; pulmonary hypertension, primary, fenfluramine-associated=atH; epiphyseal dysplasia, multiple, 6=aTH; waardenburg's syndrome=aTh; short syndrome=ati; esophagus leiomyoma=aTi; sporadic primary pulmonary hypertension=atI; aeguired eguinovarus deformity=aTI; limb deformities, congenital=atj; vascular occlusion=atJ; epiphyseal dysplasia, multiple, 2=aTJ; deafness, x-linked 6=aTj; anorectal atresia=atk; myeloblastosis=atK; leiomyomatosis, esophageal and vulval, with nephropathy=aTk; stickler syndrome, type v=aTK; aortic sclerosis=atl; kyphoscoliosis deformity of spine=aTl; banti's syndrome=atL; chronic sciatica=aTL; oculoskeletal dysplasia=aTM; multiple mitochondrial dysfunctions syndrome 2=atM; aortic valve sclerosis=atm; corneal thinning=aTm; floppy=aTn; dysmorphism=atn; epiphyseal dysplasia, multiple, 3=aTN; multiple mitochondrial dysfunctions syndrome=atN; carnevale syndrome=aTO; incontinentia pigmenti achromians=aTo; hypertrophyic obesity=ato; bisphosphoglycerate mutase=atO; oculopalateoskeletal syndrome=aTP; cleft palate-lateral synechia syndrome=atp; deficiency of bisphosphoglycerate mutase=atP; keratosis pilaris=aTp; polycythemi=atQ; myosclerosis, autosomal recessive=aTg; malpuech facial clefting syndrome=aTQ; mucopolysaccharidosis i=atg; contagious pustular dermatitis=aTr; peptic esophagitis=atr; bacterial pneumonia=atR; dog diseases=aTR; cirrhosis and chronic liver disease=aTS; craniosynostosi=atS; benign scapuloperoneal muscular dystrophy with cardiomyopathy=aTs; holt-oram syndrome=ats; hemochromatosis, type 2=att; epiphyseal dysplasia, multiple, 1=aTT; dengue shock syndrome=atT; proximal weakness=aTt; polymyalgia rheumatica=atU; pseudochondroplasia=aTU; epidermaolysis bullosa, pretibial=aTu; sclerosteosi=atu; andersen-tawil syndrome=atV; transient bullous dermaolysis of the newborn=aTv; degenerative spondylolisthesis=atv; pain, intractable=aTV; limb-girdle muscular dystrophy type 2a=atW; renal artery occlusion=atw; hearing loss, cisplatin-induced, susceptibility to=aTW; epidermaolysis bullosa dystrophyica, pasini type=aTw; epidermaolysis bullosa pruriginosa=aTx; nociceptive pain=aTX; corneal fibrosis=atx; nephrotic syndrome, type 3=atX; noonan syndrome 7=atY; spondylolysis=aty; response to pain=aTY; toenail dystrophy, isolated=aTy; epidermaolysis bullosa with congenital localized absence of skin and deformity of nails=aTz; leopard syndrome 3=atZ; spinal stenosis=atz; disorder of endocrine ovary=aTZ; muscle degeneration=Au; qualitative abnormality of granulocyte=AU; hemolytic anemia=aU; cholelithiasis=au; nodular goiter=auA; sclerosteosis 2=aUA; abnormalities, multiple=aua; pain syndrome=aUa; preeclampsia/eclampsia 5=aUB; alexia=auB; neoplasms, multiple primary=aub; premenstrual dysphoric disorder=aUb; isovaleric acidemia=auC; skin/hair/eye pigmentation, variation in, 2=auc; polysyndactyly=aUC; chronic tension-type headache=aUc; maduromycosis=aUd; immunodeficiency 8=aUD; papillary microcarcinoma=aud; panniculitis=auD; acute postoperative pain=aUe; low grade serous carcinoma=aue; conjunctival cancer=auE; leigh syndrome due to mitochondrial complex iv deficiency=aUE; malignant conjunctiva melanoma=auF; melanoma stage=auf; cardioencephalyomyopathy, fatal infantile, due to cytochrome c oxidase deficiency 2=aUF; homicidal=aUf; anxiety generalized=aUg; desmoplastic melanoma=aug; mandibular cancer=auG; exocrine pancreatic insufficiency, dyserythropoietic anemia, and calvarial hyperostosis=aUG; struma ovarii=auH; harderoporphyria=aUH; chronic daily headache=aUh; serrated polyp=auh; aplasia cutis congenita, reticulolinear, with microcephaly, facial dysmorphism, and other congenital anomalies=aUI; manic symptom=aUi; nevus cell=aui; giant cell glioblastoma=auI; stereotyped behavior=aUj; serrated adenocarcinoma=auj; mucinous cystadenocarcinoma=auJ; familial multiple coagulation factor deficiency i=aUJ; craniopharyngioma=auK; von willebrand disease type 2n=aUK; childhood anaplastic astrocytoma=auk; narcissism=aUk; stimulant dependencye=aUI; von willebrand disease type 2m=aUL; lobular panniculitis=aul; papillary craniopharyngioma=auL; dysfibrinogenemia=aUM; widespread disease=aum; acneiform dermatitis=auM; aggressive personality=aUm; prothrombin gene mutation=aUN; chronic low back pain=aUn; familial nonmedullary thyroid cancer=aun; common bile duct neoplasm=auN; maxillary neoplasm=auO; mild hereditary factor viii deficiency disease=aUO; chronic pain syndrome=aUn; ovarian low malignant potential tumorur=aun; pleomorphic xanthoastrocytoma=auP; metastatic malignant peripheral nerve sheath tumor=aup; free-floating anxiety=aUp; moderate hereditary factor viii deficiency disease=aUP; carrier of hereditary factor viii deficiency disease=aUQ; headache severe=aUq; eruptive melanocytic nevi=auq; pilocytic astrocytoma of cerebellum=auQ; stage iii melanoma=aur; optic nerve astrocytoma=auR; familial multiple factor deficiency syndrome, type i=aUR; impulse control disorder=aUr; endocrine carcinoma=aus; ocular motility disease=aUs; ovarian germ cell teratoma=auS; acquired haemophilia=aUS; eumycotic mycetoma=aUt; severe hereditary factor viii deficiency disease without inhibitor=aUT; malignant struma ovarii=auT; urachal adenocarcinoma=aut; speech disorder=aUu; lung adenoma=auU; irreversible pulpitis=aUU; perianal fistula=auu; malignant choroid melanoma=auV; multiple system atrophy 1, susceptibility to=aUv; pseudotumor cerebri=aUV; infratentorial cancer=auv; cerebellum cancer=auw; central retinal veins occlusion=aUW; coenzyme q10 deficiency, primary, 6=aUw; follicular dendritic cell sarcoma=auW; febrile seizures, familial, 11=aUX; metanephric adenoma=auX; articulation disorder=aux; coenzyme q10 deficiency, primary, 5=aUx; malignant iris melanoma=auY; epilepsy, familial temporal lobe, 5=aUY; common cold=auy; electron transport chain deficiencyies, mitochondrial=aUy; syndactyly cenani lenz type=aUz; frontal lobe neoplasm=auz; hcl-v=auZ; pulmonary thromboembolism=aUZ; fryns-aftimos syndrome=AV; cap myopathy=Av; multiple sclerosis=aV; ovarian carcinoma=av; fallopian tube cancer=avA; muir-torre syndrome=ava; hyperproinsulinemia=aVa; leber congenital amaurosis 8=aVA; cryptosporidiosis=avb; microglandular adenosis=avB; hyperferritinemia, hereditary, with congenital cataracts=aVb; anetoderma=aVB; rigidity and multifocal seizure syndrome, lethal neonatal=avc; hyperopia=aVC; benign essential blepharospasm=aVc; familiar ovarian carcinoma=avC; retinal telangiectasisa=aVD; riddle syndrome=avd; microglandular adenosis of breast=avD; hepatitis, animal=aVd; breast cancer 3=ave; mental retardation, autosomal recessive 2=aVE; fanconi anemia, complementation group d1=avE; pasteurellaceae infections=aVe; cocaine use=aVF; li-fraumeni-like syndrome=avf; familial apoceruloplasmin deficiency=aVf; pituitary dwarfism 1=avF; small cell osteogenic sarcoma=aVG; basal ganglion degeneration=aVg; breast-ovarian cancer, familial, susceptibility to, 2=avG; high grade serous carcinoma=avg; breast cancer stage=avh; iron metabolism disease=aVh; progressive aphasia=avH; poikiloderma with neutropenia=aVH; ocular cancer=avI; hemosiderosis=aVi; atypical medullary carcinoma=avi; floating-harbor syndrome=aVI; occult malignancy=avj; turner of exocrine pancreas=avJ; infarct of liver=aVj; chromosome 16p13.3 deletion syndrome=aVJ; lupus erythematodes=aVK; blepharospasm=aVk; ovarian carcinosarcoma=avK; breast cancer, familial male=avk; breast secretory carcinoma=avL; carboxypeptidase n deficiency=aVl; pelvic cancer=avl; neonatal leukemia=aVL; sexual precocity=aVM; occult carcinoma=avm; hereditary coproporphyria=aVm; spinal cord primitive neuroectodermal neoplasm=avM; cleft palate x-linked=aVn; atrioventricular septal defect, partial, with heterotaxy syndrome=aVN; antley-bixler syndrome=avN; curb=avn; cleft palate with ankyloglossia=aVo; lobular carcinoma in situ=avo; severe anemia=avO; atrioventricular septal defect, susceptibility to, 2=aVO; coproporphyria=aVp; adrenal hyperplasia=avP; loss of interest=avp; complete atrioventricular septal defect=aVP; atrioventricular septal defect: atrial and ventricular components=aVQ; idiopathyic epilepsy=avQ; infection due to brucella suis=aVq; nonproliferative fibrocystic disease=avq; maturation defect=aVR; hypergonadotropic amenorrhea=avR; erythropoietic protoporphyri=aVr; difficulty sleeping=avr; chromosome 3, monosomy 3p=avS; malignant neoplasm of abdomen=avs; psychophysiologic disorders=aVS; la crosse encephalyitis=aVs; malaria, severe, resistance to=aVt; cystic ovaries=avT; acth deficiency, isolated=aVT; obesity in adolescence=avt; proliferative nephritis unspecified=aVu; testicular dysfunction=avU; fecal peritonitis=aVU; breast carcinoma in situ=avu; mouth disease=avv; systemic lupus erythematosus, susceptibility to, 9=aVv; gonadotrophy adenoma=avV; sarcoid arthritis=aVV; pituitary apoplexy=aVW; dysplastic nevus syndrome=avw; hyperprolactinemia=avW; immunodeficiency, common variable, 7=aVw; panhypopituitarism=avX; female reproductive organ cancer=avx; oral hairy leukoplaki=aVx; hypothalamic disease=aVX; dyspnea, paroxysmal=aVY; uveal cancer=avy; mental retardation, autosomal recessive 34=aVy; charge syndrome=avY; retinitis pigmentosa 12=aVz; perry syndrome=avZ; functional colonic disease=aVZ; fallopian tube carcinoma=avz; recurrent malignant neoplasm=aw; age related macular degeneration=aW; nemaline myopathy, autosomal recessive=Aw; severe hypoxic ischemiac encephalyopathy=AW; hereditary persistence of fetal hemoglobin thalassemia=awa; congenital posterior polar cataract=aWA; type c thymoma=awA; stuve-wiedemann syndrome=aWa; kaposi varicelliform eruption=aWb; hypogammaglobulinemia and isolated growth hormone deficiency, x-linked=awB; cataract, congenital zonular, with sutural opacities=aWB; stinging sensation=awb; xeroderma pigmentosum, group e=aWc; nut midline carcinoma=awe; cataract 23=aWC; hypogammaglobulinemia, x-linked=awC; cataract, lamellar 2=aWD; inflammatory disorder of breast=aWd; slow acetylator due to n-acetyltransferase enzyme variant=awd; recurrent bacterial infection=awD; pyoderma=awE; acute uveitis=aWe; cataract, congenital nuclear, autosomal recessive 3=aWE; incisional hernia=awe; cataract microcornea syndrome=aWF; pneumococcal bacteraemia=aWf; rubell=awF; cerebral salt-wasting syndrome=awf; bacteremia due to *Staphylococcus aureus*=aWg; cataract, coppock-like=aWG; sarcoidosis, susceptibility to, 2=awG; chorioretinitis=awg; vulva sguamous cell carcinoma=awh; cataract, congenital, cerulean type, 2=aWH; lofgrens syndrome=awH; sickle cell-beta-thalassemia=aWh; cataract, congenital nuclear, autosomal recessive 2=aWI; dentinogenesis imperfecta=awi; chronic peri-aortitis=aWi; premature chromatid separation trait=awI; legionnaires' disease=aWj; cataract 39, multiple types=aWJ; anauxetic dysplasia=awJ; dentin dysplasia=awj; fanconi anemia, complementation group j=awk; nose disease=aWk; mean corpuscular hemoglobin=awK; cataract, punctate, progressive juvenile-onset=aWK; fatty acid oxidation defects=awL; paratyphoid fever=aWl; fanconi syndrome=awl; cataract, crystalline aculeiform=aWL; albinism, oculocutaneous, type vii=awM; septic arthritis=aWm; angiomas=awm; seronegative arthritis=aWM; senile cataract=aWN; mental retardation, x-linked 93=awn; progressive external ophthalmoplegia with mitochondrial dna deletions, autosomal dominant, 3=awN; osteogenesis imperfecta type vii=aWn; hereditary motor neuronopathy=awn; cataract 20, multiple types=aWO; osteogenesis imperfecta, type 7=aWo; infantile onset spinocerebellar ataxia=awO; pseudoaphakia=aWP; sensory ataxias neuropathy, dysarthria, and ophthalmoparesis=awP; eccrine acrospiroma=aWp; blood group-ok=awp; giardiasis=aWQ; chikungunya fever=awg; clear cell hidradenoma=aWg; mitochondrial dna depletion syndrome 3 (hepatocerebral type)=awQ; hyperexplexia hereditary=aWR; delayed emergence from anesthesia=awr; parkinson disease, mitochondrial=aWr; leber congenital amaurosis 7=aWr; optic atrophy=awS; cone-rod dystrophy 2=aWs; gliosis, familial progressive subcortical=aWS; restless legs syndrome, susceptibility to, 6=aws; hereditary diffuse leukoencephalyopathy with spheroids=aWT; attention-deficit/hyperactivity disorder, predominantly inattentive type=awt; herein dependency=aWt; chronic progressive external ophthalmoplegia=awT; myopathy, myofibrillar, desmin-related=aWu; periodic limb movement disorder=awu; fibrosisng adenosis=aWU; tay-sachs disease=aWU; alpha-b crystallinopathy=aWv; melas syndrome=awV; biotin deficiency=awv; sclerosisng adenosis of breast=aWV; chondroid lipoma=awW; cardiomyopathy, dilated, lii=aWw; neutrophyilia, hereditary=aWW; multiple carboxylase deficiency=aww; cataract, posterior polar, 2=aWx; holocarboxylase synthetase deficiency=awx; benign ependymom=awX; dystonia, dopa-responsive, due to sepiapterin reductase deficiency=aWX; cataract 16, multiple types=aWy; protein-energy malnutrition=awy; localized vitisligo=awY; band-like calcification with simplified gyration and polymicrogyria=aWY; thymic carcinoma=awz; temtamy syndrome=awZ; disorder of skeletal muscle=aWz; surfactant metabolism dysfunction, pulmonary, 1=aWZ; melanoma=aX; juvenile rheumatoid arthritis=ax; dengue disease=AX; intranuclear rod myopathy=Ax; microphthalmia and mental deficiency=axa; anterior uveitis=axA; ectopic pregnac=aXA; surfactant metabolism dysfunction, pulmonary, 4=aXa; segawa syndrome, autosomal recessive=aXb; complement component 3 deficiency=axB; combined oxidative phosphorylation deficiency 7=axb; surfactant metabolism dysfunction, pulmonary, 5=aXB; spastic paraplegia 55, autosomal recessive=axe; pemphigus=axC; somatosensory disorders=aXC; purpura fulminans=aXc; methemoglobinemia, type i=axD; neutropenia, severe chronic=aXD; abdominal neoplasms=axd; bone marrow failure syndromes=aXd; follicular cyst=aXe; anemia, congenital dyserythropoietic, type ib=axe; complement component 4a deficiency=axE; severe beta thalassemia=aXE; eosinophilia, familial=aXf; salt-losing congenital adrenal hyperplasia=axF; clinical chorioamnionitis=aXF; hydronephrosi=axf; adrenal incidentaloma=axG; prostatic adenoma=axg; chronic neutrophyilia=aXG; staphylococcal skin infections=aXg; protein intolerance=aXh; neurodegeneration with brain iron accumulation 4=axh; complement component 4b deficiency=axH; primary ulcer of intestine=aXH; fatal familial insomni=axI; neurodegeneration with brain iron accumulation (nbia)=axi; acute flaccid paralysis=aXi; ectopic tenth=aXI; splenic infarction=aXJ; amelogenesis imperfecta, hypomaturation type, iia4=aXJ; spastic paraplegia 43, autosomal recessive=axj; meningitis/encephalyitis=aXj; wolf-hirschhorn syndrome=axK; pericardial mesothelioma=aXK; acute necrotizing myelitis=aXk; selenium deficiency=axk; transient myocardial ischemia=axL; homocarnosinase deficiency=aXl; cockayne syndrome a=aXL; lepromatous leprosy=axl; bronchopneumonia=axM; breast cancer and pregnancy=aXM; myeloradiculopathy=aXm; retrograde degeneration=axm; lens disease=axn; hypersensitivity reaction type iii disease=axN; pulmonary eosinophilic granuloma=aXn; isolated growth hormone deficiency, type ii=aXN; gonococcal arthritis dermatitis syndrome=axO; complement 1s deficiency=axe; periadenitis mucosa necrotica recurrens=aXo; flea infestations=aXO; stromal keratitis=aXp; complement component c1s deficiency=axp; spotted fever=aXP; joubert syndrome 17=axP; intracranial glioma=axq; mumps meningitis=aXg; amyotrophy, monomelic=axQ; typhus=aXQ; multiple sclerosis in children=aXr; ectopic pancreas=axr; complement component 6 deficiency=axR; 15g24 microdeletion=aXR; ciliary dyskinesia, primary, 26=axs; hib meningitis=aXs; c6 deficiency, subtotal=axS; parietal lobe neoplasm=aXS; brainstem encephalyitis=aXt; advanced sleep phase syndrome, familial, 2=aXT; complement component 7 deficiency=axT; macular degeneration, age-related, 14=axt; cone-rod dystrophy 16=axU; complement deficiency=axu; enterovirus meningitis=aXu; advanced sleep-phase syndrome, familial=aXU; drug exanthema=aXv; advanced sleep phase=aXV; macular degeneration, age-related, 9=axv; c9 deficiency=axV; lymphohistiocytosis=aXw; classical glioblastoma=aXW; macular degeneration, age-related, 15=axW; hemolytic uremic syndrome, atypical, susceptibility to, 5=axw; eyelid disease=aXx; joubert syndrome 21=aXX; facial dermatosis=axX; pneumonia, pneumococcal=axx; cardiomyopathy, dilated, 1m=aXY; complement component 3 deficiency, autosomal recessive=axy; polycystic lipomembranous osteodysplasia with sclerosisng leukoencephalyopathy=axY; intermittent explosive disorder=aXy; immune complex nephritis=axz; frontotemporal dementia with motor neuron disease=axZ; intracranial hypotension=aXz; cardiomyopathy, familial hypertrophic, 12=aXZ; dysostosis=AY; mitochondrial cardiomyopathy=ay; nemaline myopathy, autosomal dominant=Ay; mental depression=aY; brugada syndrome 3=ayA; familial dementia=aya; microscopic polyangiitis=aYA; hereditary nystatin c amyloid angiopathy=aYa; amyotrophyic lateral sclerosis with dementia=ayb; pretibial myxedema=aYB; hereditary cerebral amyloid angiopathy, icelandic type=aYb; feeling powerless=ayB; primary aldosteronism, seizures, and neurologic abnormalities=ayC; autoimmune response=aYC; huntington disease-like syndrome=aye; macular degeneration, age-related, 11=aYc; thyroid associated orbitopathy=aYD; progressive muscular atrophy=ayd; amyloidosis, hereditary=aYd; sinoatrial node dysfunction and deafness=ayD; chronic chagas' disease=aYE; papillon-lefevre disease=aye; sporadic cerebral amyloid angiopathy=aYe; aland island eye disease=ayE; deficiency of vitamin d3=aYE; cone-rod dystrophy 3=ayF; niemann-pick disease, type c2=aYf; hyperchlorhidrosis, isolated=ayf; exfoliative ichthyosis, autosomal recessive, ichthyosis bullosa of siemens-like=aYg; cone-rod dystrophy, x-linked, 3=ayG; ulcerative jejunitis=aYG; glaucoma both eyes=ayg; non-specific brain syndrome=ayh; mucolipidosis type i=aYh; blood autoimmune disorders=aYH; atrophy of optic disc=ayH; action myoclonus=aYi; x-linked csnb=ayI; nutritional deficiency disease=ayi; intermediate uveitis=aYI; retinitis pigmentosa 17=ayj; astigmatism=ayJ; basal ganglia calcification=aYj; arrhythmogenic right ventricular dysplasia, familial, 13=aYJ; epilepsy, childhood absence, susceptibility to, 6=ayK; cerebroretinal microangiopathy with calcifications and cysts=aYk; trichohepatoenteric syndrome=aYK; carbenic anhydrase va deficiency, hyperammonemia due to=ayk; mental retardation, autosomal dominant 19=aYL; gastric antral vascular ectasisa=aYl; epilepsy, idiopathyic generalized, susceptibility to, 6=ayL; decayed, missing and filled tooth count=ayl; cockayne syndrome b=aYm; hepatitis b and hepatitis c=aYM; malignant hyperthermia susceptibility type 5=ayM; xerophthalmia=aym; cerebellar ataxia, mental retardation, and dyseguilibrium syndrome 3=ayn; mental retardation, autosomal dominant 21=aYn; adamantinous craniopharyngioma=aYN; thyrotoxic periodic paralysis, susceptibility to, 1=ayN; neurilemmomatosis=ayn; leukemia, megakaryoblastic, of down syndrome=aYo; classic pulmonary blastoma=aYO; malignant hyperthermia, susceptibility to, 5=ayO; small intestine carcinoma=aYP; deafness, autosomal recessive 93=ayp; sibling jealousy=aYp; periodic paralysis=ayP; cri-du-chat syndrome=aYQ; congenital cataracts, facial dysmorphism, and neuropathy=aYg; night blindness, congenital stationary, type 2b=ayg; familial periodic paralysis=ayQ; pulmonary congestion=aYr; night blindness=ayr; cystinosis, late-onset juvenile or adolescent nephropathyic type=aYR; epilepsy, idiopathyic generalized, susceptibility to, 11=ayR; episodic ataxia, type 1=ays; zimmerman laband syndrome=ayS; hyperosmolality=aYs; cystinosis, ocular nonnephropathyic=aYS; cystinosis, atypical nephropathyic (disorder)=aYT; chronic back pain=ayT; severe persistent asthma=aYt; spinocerebellar ataxia 26=ayt; cystinosis, infantile nephropathyic=aYU; episodic ataxia, type 7=ayu; retinal cone dystrophy 4=ayU; skin amelanotic melanoma=aYu; brugada syndrome 4=ayV; restrictive cardiomyopathy=aYv; pancreatitis, chronic, susceptibility to=aYV; torticollis=ayv; crossed hemiplegia=ayw; episodic ataxia, type 5=ayW; gingival fibromatosis=aYw; neuraminidase deficiency with beta-galactosidase deficiency=aYW; mental retardation, autosomal dominant 10=ayX; familial migraine=ayx; diabetes mellitus, insulin-dependent, 12=aYx; neuraminidase 1 deficiency=aYX; gangliosidosis gm1=aYY; celiac disease, susceptibility to, 3=aYy; familial paroxysmal dystonia=ayY; spell=ayy; hypothyroidism, autoimmune=aYz; timothy syndrome=ayz; disease of mental healthy=ayZ; pycnodysostosis=aYZ; lung disease=aZ; actin-accumulation myopathy=Az; tonsil cancer=AZ; cholecystolithiasis=az; acute hepatitis c=aZA; keratolytic winter erythema=aZa; cancer relapse=aza; cardiomyopathy, familial hypertrophyic, 19=azA; high grade cervical sguamous intraepithelial neoplasmia=azb; oculocutaneous albinism type 1=azB; glycosphingolipidoses=aZb; erythema migrans=aZB; insulin resistance—type a=azC; pulpitis=aZC; cervical cancer sguamous cell=azc; purulent sputum=aZc; complicated pneumoconiosis=azd; geographic tongue=aZD; surrogate mother=azD; clonorchiasis=aZd; fascioliasis=aZe; periapical granuloma=aZE; ampulla of vater neoplasm=azE; familial mediaterranean feve=aze; adenofibroma=azf; onchocerciasis=azF; keratosis palmoplantaris with periodontopathyia and onychogryposis=aZf; myh9-related disorders=aZF; scarlet fever=azG; sarcomatoid mesothelioma=azg; subacromial bursitis=aZG; early onset periodontitis=aZg; agoraphobi=azH; tropical calcific pancreatitis=azh; visually threatening diabetic retinopathy=aZH; deficiency of cathepsin c=aZh; bursitis=aZI; hypotonia-cystinuria syndrome=azI; ceroid lipofuscinosis, neuronal, 10=aZi; foot ulcer=azi; isolated cystinuria=azJ; tertiary neurosyphilis=aZJ; mass of thyroid gland=azj; neuronal ceroid lipofuscinosis, congenital=aZj; c cell tumor=azk; gastric diffuse adenocarcinoma=aZK; neutropenia chronic=azK; postpartum cardiomyopathy=aZk; pain during injection=azi; dyggve-melchior-clausen syndrome=aZL; ceroid lipofuscinosis, neuronal, 13=aZI; subgingival plague=azL; neonatal necrotizing enterocolitis=aZM; rosacea=azM; platelet thrombus=aZm; hypoalgesia=azm; sprains and strains=aZn; adenoviral keratitis=aZN; cerebellar ataxia, nonprogressive, with mental retardation=azN; lung large cell carcinoma=azn; epithelioid hemangioendothelioma=azO; hyperparathyroidism=azo; aspiration pneumoniatis=aZO; secondary anemia=aZo; light chain myeloma=aZp; cherubism=azp; desbuguois dysplasia=azP; aspiration pneumonia=aZP; peritonsillar abscess=aZQ; diabetes mellitus, noninsulin-dependent, 1=azQ; pseudohypoaldosteronism, type iie=aZq; supravalvular aortic stenosis=azq; femoral neck fractures=azr; tibial muscular dystrophy, tardive=azR; mental retardation, x-linked, with brachydactyly and macroglossia=aZr; diarrhea persistent=aZR; diffuse panbronchiolitis=aZS; acute closed-angle glaucoma=azs; alpha-sarcoglycanepathyies=azS; aggressive outburst=aZs; chronic mesangial proliferative glomerulonephritis=aZt; myositis, eosinophilic=azT; arthritis, reactive=azt; lichenoid eruptions=aZT; rhinosinusitis=aZU; residual cancer=azu; periapical diseases=aZu; immunodeficiency 11=azU; whooping cough=azv; cutaneous hypersensitivity=aZv; adnexal diseases=aZV; psoriasis susceptibility 2=azV; dysentery, bacillary=aZW; leukocytoclastic vasculitis=aZw;

familial psoriasis=azW; floppy lid syndrome=azw; familial pityriasis rubra pilaris=azX; small fibre neuropathy=aZX; macular degeneration, age-related, 12=aZx; histoplasmosis=azx chronic secretory otitis media=aZY; hemangiopericytoma=azy; headache recurrent=aZy; pityriasis rubra pilaris=azY; first myocardial infarction=azZ; intestinal obstruction=aZz; fertility disorders=aZZ; orofacial cleft=azz; prostate carcinoma=B; cancer=b; metachromatic leukodystrophy=Ba; bjornstad syndrome=bA; visceral myopathy, familial=BA; keratoconus=ba; pleural plague=baA; arginine:glycine amidinotransferase deficiency=bAa; thyroid cancer metastatic=baa; hypoglycaemic episode=bAA; gamma-glutamylcysteine synthetase deficiency, hemolytic anemia due to=bAB; rapidly progressive periodontitis=bah; spastic paraplegia 46, autosomal recessive=bAb; healing ulcer=baB; coronary vessel anomalies=bAC; acute neuronopathyic gaucher's disease=bAc; renal cancer metastatic=baC; prodromal stage=bac; hyperviscosity syndrome=baD; gaucher disease, perinatal lethal=bAd; nose symptoms=bad; hypoparathyroidism, autosomal recessive=bAD; cataract, congenital or juvenile=bAE; gaucher disease, type iiic=bAe; painful bladder syndrome=baE; diarrhea in children=bae; *Clostridium difficile* diarrhoea=baf; *Mycobacterium avium* infection=baF; familial cardiomyopathy=bAF; polyglucosan body disease, adult form=bAf; t lymphoblastic leukemia/lymphoma=baG; bilis=bag; adult i blood group phenotype=bAG; gsd iv, neuromuscular form, congenital=bAg; allergic symptom=baH; urinary symptoms=bAh; incurable diseases=bah; seropositive rheumatoid arthritis=bAH; eosinophilic syndrome=bai; methemoglobinemia type iv=baI; autosomal recessive scid=bAI; glycogen storage disease iv=bAi; polymyalgia rheumatic=bAj; cells in urine=bAJ; recurrent sinusitis=baj; 17,20-lyase deficiency, isolated=bad; isocyanate induced asthma=bAK; diabetes mellitus, type ii, autosomal dominant=bAk; hemoglobin m disease=baK; *Staphylococcus aureus* endocarditis=bak; noninsulin-dependent diabetes mellitus with deafness=bAl; gastric ulcer benign=bal; nadh cytochrome b5 reductase deficiency=baL; ichthyosis exfoliativa=bAL; reactive hypoglycemia=bAm; methemoglobinemia, type ii=baM; autosomal dominant ichthyosis=bAM; salpingitis=bam; bullous keratopathy=ban; granulomatous disease, chronic, autosomal recessive, cytochrome b-negative=baN; oculopharyngodistal myopathy=bAn; protein-deficient diabetes mellitus=bAN; dhpr deficiency=bAo; bronchial disease=bao; granulomatous disease, chronic, x-linked=baU; alcohol myopathy=bAU; cecum cancer=bAP; hyperphenylalaninemia, bh4-deficient, b=bAp; splenic seguestration=bap; atypical mycobacteriosis, familial, x-linked 2=baP; dystonia 6, torsion=bAg; newborn respiratory distress syndrome=bag; zap70 deficiency=baQ; rem sleep behavior disorder=bAQ; juvenile parkinson's disease=bAr; acute pancreatitiss=bar; colon (non-specific) inflammation=baR; hyperglycinemia, transient neonatal=bAR; suicidal ideation=bAS; chronic granulomatous disease, type ii=baS; pancreatitiss=bas; childhood onset dystonias=bAs; mechanical pain=bAt; hand dermatosis=bat; charcot-marie-tooth disease, type 4a=bAT; mitochondrial complex iii deficiency, nuclear type 6=baT; thrombocytopenia 4=baU; charcot-marie-tooth disease, type 2k=bAU; oromandibular dystonia=bAu; pediatric osteosarcoma=bau; lung giant cell carcinoma=bav; charcot-marie-tooth disease, type 4a, axonal form=bAV; beta thalassemia, heterozygous=baV; secondary dystonia=bAv; non-epidermaolytic palmoplantar keratoderma=baW; charcot-marie-tooth disease, recessive intermediate a=bAW; *Clostridium difficile* colitis=baw; lumbar radiculopathy=bAw; cystitis and urethritis=bax; eccrine dermal cylindroma=baX; transposition of the great arteries, dextro-looped 3=bAX; vestibulodynia=bAx; pneumonia due to *Escherichia coli*=baY; telangiectasisa, hereditary hemorrhagic, type 5=bAY; acute cystitis=bay; hyperinsulinemiac hypoglycemia, familial, 3=bAy; mastitis=baz; transmissible mink encephalyopathy (tme)=baZ; klippel feil syndrome dominant type=bAZ; diabetes in youth=bAz; megaduodenum and/or megacystis=BB; help syndrome=Bb; cerebrovascular disease=bb; peroxisome biogenesis disorders=bB; short bowel syndrome=bba; froelich's syndrome=bbA; klippel-feil syndrome 3, autosomal dominant=bBa; neutropenia, severe congenital, autosomal dominant 2=bBA; spiradenoma=bbb; microphthalmia, isolated 7=bBb; polyp of corpus uteri=bbB; neutropenia, non-immune chronic idiopathic, adult=bBB; microphthalmia, isolated, with coloboma 6=bBc; environmental illness=bbC; lipoid congenital adrenal hyperplasia=bbc; combined oxidative phosphorylation deficiency 1=bBC; oxidative phosphorylation deficiencyies=bBD; klippel-feil syndrome=bBd; adrenal insufficiency, congenital, with 46,xy sex reversal, partial or complete=bbd; aryl hydrocarbon hydroxylase inducibility=bbD; adrenal insufficiency, congenital=bbe; hidradenitis suppurativa=bbE; myasthenic syndrome, congenital, with tubular aggregates 1=bBE; chondrodysplasia, grebe type=bBe; cystadenocarcinoma=bbF; congenital adrenal hyperplasia due to 11-beta-hydroxylase deficiency=bbf; acromesomelic dysplasia, maroteaux type=bBf; myasthenia, limb-girdle, with tubular aggregates=bBF; fibular hypoplasia and complex brachydactyly=bBg; lingual-facial-buccal dyskinesi=bBG; gastric cardia carcinoma=bbG; familial testotoxicosis=bbg; hemorrhoid=bBH; pseudoxanthoma elasticum-like disorder with multiple coagulation factor deficiency=bBH; multiple synostoses syndrome 2=bBh; 18-hydroxylase deficiency=bbh; sporadic porphyria cutanea tarda=bbI; pseudoxanthoma elasticu=bBI; corticosterone methyloxidase type ii deficiency=bbi; vertical talus, congenital=bBi; brachydactyly, type a1, c=bBj; sprays=bbJ; 11-beta-hydroxylase deficiency=bbj; glutathionuria=bBJ; endometriosis of pelvis=bbK; radial-renal syndrome=bBK; deficiency of monooxygenase=bbk; acromesomelic dysplasia=bBk; glaucoma 1, open angle, a=bbL; familial hyperaldosteronism=bbl; symphalangism, proximal, 1b=bBI; tropical eosinophilia=bBL; microphthalmia, isolated 4=bBm; glaucoma 3, primary congenital, a=bbM; familial hyperaldosteronism type 1=bbm; infection by *Wuchereria bancrofti*=bBM; leber congenital amaurosis 17=bBn; glaucoma of childhood=bbN; aldosterone to renin ratio, increased=bbn; pituitary hormone deficiency, combined, 2=bBN; aldosterone hypertension=bbo; early-onset glaucoma=bbO; spondylocostal dysostosis 4, autosomal dominant=bBn; isolated growth hormone deficiency, type ib=bBO; hyperandrogenism, nonclassic type, due to 21-hydroxylase deficiency=bbP; gdp dissociation inhibitor 1=bBp; hyperreninemiac hypoaldosteronism=bbp; kowarski syndrome=bBP; mental retardation, x-linked 3=bBg; high renin hypertension=bbg; late-onset congenital adrenal hyperplasia=bbQ; short stature, idiopathyic, autosomal=bBQ; insulin-like growth factor i deficiency=bBR; mineralocorticoid deficiency=bbR; adrenal hyperplasia, congenital, type 5=bbr; hirschsprung disease, susceptibility to, 3=bBr; mild steroid 21-hydroxylase deficiency=bbS; secondary hypothyroidism=bBS; deficiency of lyase=bbs; hirschsprung disease type 3=bBs; secondary parkinson disease=bBt; turner-induced hypoglycemia=bBT; growth control, y-chromosome influenced=bbt; hypercalcemia, idiopathyic, of infancy=bbT; osteomalacia secondary to drug=bbU; genitalia external ambiguous=bbu; potassium depletion=bBU; birdshot chorioretinopathy=bBu; keratoconjunctivitis=bBV; idiopathyic infantile hypercalcemia-mild form=bbV; urination disorders=bBv; sexual infantilism=bbv; adenocarcinoma of liver=bbW; dysmetabolic syndrome=bbw; pituitary hypoplasia=bBW; gemistocytic astrocytoma=bBw; hypothyroidism, congenital, nongoitrous, 3=bBX; coenuriasis=bbx; radiohumeral fusions with other skeletal and craniofacial anomalies=bbX; myopathy, mitochondrial progressive, with congenital cataract, hearing loss, and developmental delay=bBx; somatotrophy hyperplasia=bBY; carbon tetrachloride poisoning=bBy; focal facial dermal dysplasia 4=bbY; estrogen excess=bby; leydig cell turner=bbz; small for gestational age=bBZ; thrombasthenia-thrombocytopenia, hereditary=bBz; dementia of frontal lobe type=bbZ; endometrial adenocarcinoma=Bc; lateral meningocele syndrome=BC; thrombophilia=be; moyamoya disease 1=bC; hid syndrome=bCA; cerebrotendinous xanthomatosis=bca; acute gastrointestinal hemorrhage=bcA; prognathism=bCa; aernerythrnkeratoderma=bCB; vitamin d hydroxylation-deficient rickets, type 1a=beb; constitutional delay of growth and puberty=bCb; coumarin sensitivity=bcB; deaf mutism=bCC; vitamin d-dependent rickets, type 2a=bcc; diaphragm disease=bcC; tsh secreting adenoma=bCc; atrichia with papular lesions=bed; recessive sensorineural hearing loss=bCD; congenital deficiency of intrinsic factor=bCd; amelogenesis imperfecta, type ib=bcD; drug metabolism, poor, cyp2d6-related=bcE; congenital sensorineural hearing loss=bCE; rickets, hereditary vitamin d-resistant=bee; normal bowel habits=bCe; hearing impaired children=bCF; primary osteoporosis=bef; parkinson disease 11=bCf; wilms turner 4=bcE; debrisoguine, poor metabolism of=bcG; deafness, autosomal recessive 15=bCg; hearing loss associated with syndrome=bCG; acute lower respiratory tract infection=beg; atrichia=bch; sensorineural hearing los=bCh; eccrine nevus=bCH; debrisoguine, ultrarapid metabolism of=bcH; postoperative vomiting=bcI; follicular occlusion triad—hidradenitis, acne conglobata, dissecting cellulitis of scalp=bCI; syndactyly, type 3=bCi; multidrug-resistant tuberculosis=bci; pseudoparkinsonism=bed; mutism=bCJ; coumarin resistance=bej; atrio-ventricular septal defect 3=bCj; charent-marie-tnnth disease type 2=bCK; liver diseases, parasitic=bek; oculodentodigital dysplasia, autosomal recessive=bCk; basal ganglia disease=bcK; craniometaphyseal dysplasia, autosomal recessive type=bCl; deafness, autosomal dominant 3b=bCL; limited scleroderma=bcL; lung cancer, protection against=bcl; crisscross heart=bCm; alcoholic liver damage=bcM; deafness, autosomal recessive 1b=bCM; tegafur, poor metabolism of=hem; halothane hepatitis=bcN; hallermann-streiff syndrome=bCn; congenital hearing disorder=bCN; infestation=bcn; opisthorchiasis=bco; cirrhosis—non-alcoholic=bcO; cataract, zonular pulverulent 3=bCo; deafness, digenic, gjb2/gjb6 (disorder)=bCO; leukodystrophy, hypomyelinating, 2=bCP; bietti crystalline dystrophy=hep; cataract, zonular pulverulent 1=bCp; vitamin d hydroxylation-deficient rickets, type 1b=bcP; axonal sensorimotor neuropathy=bCg; spastic paraplegia 56, autosomal recessive=bcO; lymphedema, hereditary, ic=bCQ; lamellar ichthyosis, type 3=bcq; deficiency of isomerase=bcR; efavirenz, poor metabolism of=bcr; spastic paraplegia 44, autosomal recessive=bCR; cns symptom=bCr; arteriolar hyalinosis=bcS; drug-induced hepatitis=bcs; charcot-marie-tooth disease type=bCs; chromosome xp21 deletion syndrome=bCS; ichthyosis, nonlamellar and nonerythrodermaic, congenital, autosomal recessive=bcT; deafness, autosomal recessive 1a=bCt; food-drug interactions=bet; neurological pain=bCT; hepatic impairment=bcu; torulopsis=bcU; acroparesthesia=bCU; vohwinkel syndrome=bCu; drug metabolism, poor, cyp2c19-related=bcv; cornea verticillata=bCV; knuckle pads, leuconychia and sensorineural deafness=bCv; vegetation=bcV; keratoderma palmoplantar deafness=bCw; neuromyelitis optic=bcW; mephenytoin, poor metabolism of=bcw; pseudo-hurler polydystrophy=bCW; spastic paraplegia 5a, autosomal recessive=bcX; deafness, autosomal dominant 3a=bCx; premenstrual syndrome=hex gml-gangliosidosis, type ii=bCX; rhabdomyolysis, cerivastatin-induced=bcy; keratitis, ichthyosis, and deafness (kid) syndrome=bCy; gm1-gangliosidosis, type i=bCY; spastic paraplegia type 5a, recessive=bcY; hyperkeratosis of the palms and soles and esophageal papillomas=bCz; adult gm1 gangliosidosis=bCZ; autosomal recessive hereditary spastic paraplegia=bcZ; jaw diseases=bez; nephrotic syndrome=bd; glucocorticoid deficiency=bD; thyroid adenoma=Bd; disorder of smooth muscle=BD; hhh syndrome=bDA; sensory ataxia=bda; woodhouse sakati syndrome=bdA; spastic diplegia infantile type=bDa; langer mesomelic dysplasia=bdB; d-2-hydroxyglutaric aciduria 1=bdb; d-glyceric aciduria=bDB; nonpersistence=bDb; 2-hydroxyglutaricaciduria=bdc; occlusive thrombus=bDc; atrial standstill=bdC; d-glycericacidemia=bDC; gangliosidosis=bDd; ambras syndrome=bdD; d-2(oh) glutaric aciduria=bdd; tay-sachs disease ah variant=bDD; gangliosidosis gm2=bDe; cortical thymoma=bDE; otofaciocervical syndrome=bde; parvovirus infections=bdE; lethal arthrogryposis with anterior horn cell disease=bDf; muscular dystrophy-dystroglycanopathy (limb-girdle), type c, 9=bdf; chromosome x pentasomy=bdF; epithelial malignant thymom=bDF; necrobiosis lipoidica diabeticorum=bDg; cutaneous mucormycosis=bdG; alpha-dystroglycanopathyies=bdg; alacrima, achalasia, and mental retardation syndrome=bDG; angiokeratoma=bdH; synovial osteochondromatosis=bDh; lassa fever=bdh; muscular dystrophy-dystroglycanopathy (congenital with mental retardation), type b, 14=bDH; muscular dystrophy-dystroglycanopathy (limb-girdle), type c, 14=bDI; delusion of persecution=bdi; chromosome 15q11.2 deletion syndrome=bdl; holoprosencephaly 9=bDi; muscular dystrophy-dystroglycanopathy (congenital with brain and eye anomalies), type a, 14=bDJ; pituitary anomalies=bDj; giant axonal neuropathy, autosomal dominant=bdJ; delusional disorder=bdj; conjunctival disease=bdk; imperforate anus=bDk; hypocalciuric hypercalcemia, familial, type 2=bDK; mirror movements 1=bdK; polydactyly, preaxial 4=bDl; hypocalcemia, autosomal dominant 2=bDL; specific reading disorder=bdL; pediatric lymphoma=bdl; carpenter syndrome 1=bDm; drug resistant tuberculosis=bDM; developmental coordination disorder=bdM; mediastinal gray zone lymphoma=bdm; van maldergem syndrome=bdN; extensively drug-resistant tuberculosis=bDN; leukoencephalyopathy with brainstem and spinal cord involvement and lactate elevation=bdn; postaxial polydactyly, type b=bDn; severe combined immunodeficiency with sensitivity to ionizing radiation=bdO; familial ventricular tachycardia=bDO; spinal cord involvement=bdn; polydactyly of toes=bDn; carpenter syndrome=bDp; reticuloendotheliosis, familial, with eosinophilia=bdP; hypomyelination with brainstem and spinal cord involvement and leg spasticity=bdp; inflammatory bowel disease 12=bDP; heavy metal toxicity=bdg; severe combined immunodeficiency, partial=bdQ; nephronophthisis 7=bDg; acidophil adenoma=bDO; corneal dystrophy, congenital stromal=bdR; atrophy of kidney=bDr; dystonia 25=bDR; hantavirus infection=bdr; diabetes mellitus, neonatal, with congenital hypothyroidism=bDs; sex chromosome disorders of sex development=bds; segmental dystonia=bDS; ehlers-danlos syndrome progeroid type=bdS; epileptic encephalyopathy, early infantile, 17=bDT; dopamine beta hydroxylase deficiency=bdt; glomus vagale turners=bDt; mammary paget's disease=bdT; neuronopathy, distal hereditary motor, type viib=bdU; melanotic neurilemmoma=bDO; venous malformation=bDu; autonomic nervous system diseases=bdu; psychoticism=bdv; congenital abnormality of veins=bDv; central nervous system melanocytic neoplasm=bDV; behavioral syndrome associated with physiological disturbance and physical factors=bdV; positive and negative symptoms=bdw; foot-and-mouth disease=bdW; hyperekplexia 2=bDw; osseous heteroplasia, progressive=bDW; hypothyroidism, congenital, nongoitrous, 1=bDX; depressive psychosis=bdx bullous pemphigoi=bdX; anemia, sideroblastic, pyridoxine-refractory, autosomal recessive=bDx severe major depression with psychotic features=bdy; leucinosis=bDy; rift valley fever=bdY; pseudohypoparathyroidism type Ic=bDY; classical lissencephalyies and subcortical band heterotopias=bdZ; toxic thyroid adenoma=bDZ; glutamine deficiency, congenital=bDz; general symptom=bdz; zellweger spectrum=bE; breast ductal carcinoma=Be; arthritis=be; congenital dilatation of bladder=BE; toxic multinodular goiter=bEa; lissencephaly and agenisi of corpus callosum=bea; orofaciodigital syndrome i=beA; globozoospermia=bEA; agyria=beb; gerodermaia osteodysplastica=bEB; idiopathyic parathyroidism=bEb; infection pyogenic=beB; calcinosis cutis=bEc; tuberculosis, central nervous system=bEC; paraneoplasmtic encephalyomyelitis=beC; laminar heterotopia=bee; actinobacillus infections=beD; epilepsy, progressive myoclonic 6=bED; brachymetacarpia=bEd; epilepsy, cryptogenic=bed; adamantinoma=bEe; pentosuria=bee; hunt's syndrome=bEE; postoperative endophthalmiatis=beE; juxtacortical osteosarcoma=bEf; facial neoplasms=bef; geniculate herpes zoster=bEF; tinea circinata=beE; aspartate aminotransferase, serum level of, guantitative trait locus 1=bEG; vaginal disease=beG; oilier disease=bEg; deficiency of aromatic-1-amino-acid decarboxylase=beg; night blindness, congenital stationary, autosomal dominant 3=bEh; as if' personality=beH; von willebrand disease, platelet type=bEH; aromatic amine acid decarboxylase deficiency=beh; charcot-marie-tooth disease, dominant intermediate f=bEi; epilepsy, partial, with variable foci=bel; spastic paraplegia 28, autosomal recessive=bei; bernard-soulier syndrome, type a2, autosomal dominant=bEI; spastic paraplegia 54, autosomal recessive=bej; breast duct papilloma=beJ; inclusion body myopathy autosomal recessive=bEj; nonarteritic anterior ischemiac optic neuropathy, susceptibility to=bEJ; granulomatous disorder=bEk; viral gastroenteritis due to rotavirus=bek; chromophobe adenoma=beK; vaso-occlusive crisis=bEK; glycine n-methyltransferase deficiency=bEI; pelizaeus-merzbacher disease=beI; bleeding disorder, platelet-type, 11=bEL; hepatosplenic t-cell lymphoma=beL; spondylometaepiphyseal dysplasia, short limb-hand type=bem; rhizomelic chondrodysplasia punctata, type 2=bEm; bernard-soulier syndrome, type c=bEM; cardiomyopathy, dilated, 1i=beM; dwarfism, levi type=ben; muscular dystrophy, limb-girdle, type 2r=beN; glycosylphosphatidylinositol deficiency=bEn; ovarian embryonal carcinoma=bEN; blood vessel turner=beO; Warsaw breakage syndrome=ben; hypertriglyceridemia, transient infantile=bEO; nephrotoxic serum nephritis=bEo; sporadic disorder=beP; mucolipidosis ii alpha beta=bEp; brugada syndrome 2=bEP; roberts syndrome=hep; mucolipidosis iii gamma=bEg; spinal muscular atrophy with respiratory distress 1=beg; neoplasms, vascular tissue=beQ; adult-onset citrullinemia type 2=bEQ; deafness, autosomal dominant 5=beR; watermelon stomach disease=her; citrin deficiency=bER; cerebellar ataxia and hypogonadotropic hypogonadism=bEr; amyopathyic dermatomyositis=bes; hypogonadotropic hypogonadism 12 with or without anosmia=bEs; deafness, autosomal recessive 31=beS; molybdenum cofactor deficiency, complementation group c=bES; hemolytic anemia, nonspherocytic, due to glucose phosphate isomerase deficiency=bET; circling gait=beT; gastric antral vascular ectasis=bet; eunuchoidism, familial hypogonadotropic=bEt; opsoclonus myoclonus=bEO; deafness, autosomal recessive 59=beU; staring=bEu; hydrolethalus syndrome=beu; glaucoma-related pigment dispersion syndrome=bEV; auditory neuropathy spectrum disorder=beV; cystinuria=bev; fertile eunuch syndrome=bEv; vaccinia=bEw; flavivirus infections=hew; acromegal=bEW; t-lymphocyte deficiency=beW; hemangioma of liver=bEx; macrocephaly and epileptic encephalyopathy=beX; Sertoli cell-only syndrome, y-linked=hex nystagmus 6, congenital, x-linked=bEX; night blindness, congenital stationary, type 1e=bEY; hyperglycemi=beY; spermatocytoma=bey; grade i astrocytoma=bEy; induced hypothermia=bEZ; arterivirus infections=bez; nephrotic syndrome, type 7=beZ; urofacial syndrome=bEz; spina bifida cystica=BE; von economo's disease=Bf; nicotinamide adenine dinucleotide coenzyme g reductase deficiency=bF; diabetes mellitus=bf; chudley-mccullough syndrome=bFa; semantic impairment=bFA; mental retardation, x-linked 63=bfa; dicer1 syndrome=bfA; palinopsia=bFB; loose anagen hair syndrome=bEh; hypospadia=bfb; nonmedullary thyroid carcinoma=bfB; word finding difficulty=bFC; deoxyguanosine kinase deficiency=bfc; deafness, autosomal dominant 28=bFc; nontoxic multinodular goiter=bfC; sex cord-gonadal stromal turner=bfD; non-fluent aphasia=bFD; central nervous system viral diseases=bFd; lathosterolosis=bfd; mass lesion=bFe; dysgraphia=bFE; endemic goiter=bfE; congenital hemidysplasia with ichthyosisform erythroderma and limb defects=bfe; kidney sarcoma=bfF; subependymal glioma=bFf; central nervous system sensitization=bFF; desmosterolosis=bff; vascular dementi=bFg; pleuropulmonary blastoma=bfG; deafness, autosomal recessive 25=bFG; glycoproteinosis=bfg; abnormal extension=bFH; megaloblastic anemia due to dihydrofolate reductase deficiency=bfh; mental retardation, x-linked 94=bFh; mental retardation, fra12a type=bfH; short stature, auditory canal atresia, mandibular hypoplasia, skeletal abnormalities=bFI; rasmussen syndrome=bFi; schizephrenia 9=bfI; tetrahydrobiopterin deficiency=bfi; hepatoma, novikoff=bFJ; deficiency of dihydrofolate reductase=bfj; mental retardation, autosomal recessive 6=bFj; brain dysfunction=bfJ; mental retardation, autosomal dominant 8=bFk; 46,xy gonadal dysgenesis, partial, with minifascicular neuropathy=bfk; meretoja syndrome=bFK; severe recurrent major depression=bfK; lattice corneal dystrophy=bFL; 46,xy gonadal dysgenesis, complete or partial, dhh-related=bfl; multiple personality disorder=bFL; epilepsy, focal, with speech disorder and with or without mental retardation=bFl; rolandic epilepsy, mental retardation, and speech dyspraxia, autosomal dominant=bFm; inherited systemic amyloidosis=bFM; pure gonadal dysgenesis 46,xy=bfm; dyskeratosis congenita, x-linked=bFM; glutathione synthetase deficiency of erythrocytes, hemolytic anemia due to=bFN; continuous spikes and waves during slew-wave sleep syndrome=bFn; pure gonadal dysgenesis=bfn; hypophosphatemiac rickets, autosomal dominant=bfN; glutathione synthase deficiency with 5-oxoprolinuria=bFO; hypophosphatemiac rickets, autosomal recessive, 1=bfO; mixed gonadal dysgenesis=bfn; landau-kleffner syndrome=bFe; hyperostosis corticalis generalisata=bfP; mental retardation, autosomal dominant 6=bFp; ascorbic acid deficiency=bFP; genee-wiedemann syndrome=bfp; egg allergy=bFq; 2-aminoadipic 2-oxoadipic aciduria=bfg; unspecified infectious and parasitic diseases=bFQ; pyruvate dehydrogenase e2 deficiency=bfQ; enhanced s-cone syndrome=bFr; liver disease parenchymal=bfR; complete spermatogenic arrest=bFR; charcot-marie-tooth disease, axonal, type 2g=bfr; leukocyte adhesion deficiency, type iii=bfS; hereditary macular coloboma=bfs; norwegian scabies=bFS; amaurosis congenita of leber, type 1=bfs; lymphogranuloma venereum=bft; respiratory sounds=bFT; lactic acidosis, congenital infantile, due to lad deficiency=bfT; oguchi disease 2=bft; congenital immunodeficiency disease=bfU; deafness, autosomal dominant 64=bfu; leber congenital amaurosis 12=bFu; airway remodeling=bFU; congenital stationary night blindnes=bFv; mayer-rokitansky-kuster-hauser syndrome=bfV; formaldehyde poisoning=bFV; deafness, autosomal dominant 1=bfv; drug-induced liver injury, chronic=bFW; spinocerebellar ataxia, autosomal recessive 13=bFw; mental retardation, x-linked 90=bfW; premature ovarian failure 2a=bfw; turner virus infections=bFX; auditory neuropathy, autosomal dominant, 1=bfx; retinal cone dystrophy 1=bfX; congenital cerebellar ataxia=bFx; night blindness, congenital stationary, type 1b=bFy; non-arteritic ischemias optic neuropathy=bFY; uniparental disomy, paternal, chromosome 14=bfY; goiter, multinodular 1, with or without sertoli-leydig cell turners=bfy; rhabdomyosarcoma, embryonal, 2=bfz; anemia in children=bFZ; skeletal muscle neoplasm=bfZ; lipofuscinosis=bfz; lung oat cell carcinoma=Bg; bleeding disorder, platelet-type, 15=BG; spastic paraplegia type 7=bG; lewy body dementia=bg; cone dystrophy 3=bGa; retinoschisis=bgA; bacterial cholangitis=bGA; jarcho-levin syndrome=bga; fibrous meningioma=bgB; laurin-sandrow syndrome=bGB; delta-thalassemia=bgb; retinitis pigmentosa 48=bGb; moyamoya disease 6 with achalasia=bGc; dimethylglycine dehydrogenase deficiency=bgC; left ventricular noncompaction=bgc; perrault syndrome 2=bGC; hereditary persistence of fetal haemoglobin {hpfh}=bgd; achalasi=bGd; usher syndrome, type iiib=bGD; charcot-marie-tooth disease, x-linked, 1=bgD; diarrhea 6=bGe; polymorphic reticulosis=bGE; cardiogenic syncope=bgE; delta-beta thalassemia=bge; clivus chordoma=bGF; ovotesticular disorders of sex development=bgF; hand, foot and mouth disease=bgf; irritable bowel syndrome characterized by constipation=bGf; ige responsiveness, atopic=bGG; spondylocostal dysostosis, autosomal recessive=bgg; progressive external ophthalmoplegia with mitochondrial dna deletions, autosomal dominant, 6=bgG; retinal cone dystrophy 2=bGg; cone-rod dystrophy 5=bGh; chronic cervicitis=bGH; ciliary dyskinesia, primary, 13=bgH; amelogenesis imperfecta, type iv=bgh; mucormycosis=bGI; cone-rod dystrophy 1=bGi; taurodontism=bgi; ciliary dyskinesia, primary, 10=bgI; primary ciliary dyskinesia, 2=bgJ; choroidal dystrophy central areolar=bGj; histiocytosis with joint contractures and sensorineural deafness=bGJ; auriculo-condylar syndrome=bgj; chromosome 7, trisomy 7g=bGk; neonatal purpura fulminans (homozygous protein c deficiency)=bgK; split-hand/foot malformation with sensorineural hearing loss=bgk; heinz body anemias=bGK; nose neoplasms=bgl; ciliary dyskinesia, primary, 18=bgL; alpha-thalassemia mental retardation syndrome, deletion-type=bGL; abnormal granulation tissue=bGl; anemia of pregnancy=bGM; heterotaxy, visceral, x-linked=bgM; glycogen storage disease xv=bGm; hereditary night blindness=bgm; glycogen storage disease O, muscle=bGn; congenital stationary night blindness=bgn; severe alpha thalassemia=bGN; ciliary dyskinesia, primary, 7=bgN; limb-girdle muscular dystrophy, type 2c=bgn; glycogen storage disease O, liver=bGe; beta thalassemia minor=bGO; primary ciliary dyskinesia, 3=bgO; hyperglycerolemia=bgp; hypoparathyroidism, x-linked=bgP; hemoglobin hart's hydrops syndrome=bGP; epidermal necrosis=bGp; rhyns syndrome=bgO; polyp benign=bGg; neuroacanthocytosis, mcleod type=bgg; gamma delta beta thalassemia=bGQ; normocytic hypochromic anemia=bGR; keratosis follicularis spinulosa decalvans, x-linked=bgr; carotid stenosis, susceptibility to=bGr; hyaline body=bgR; carnitine-acylcarnitine translocase deficiency=bGs; maternally inherited leigh syndrome=bgS; muscular dystrophy, animal=bgs; delta thalassemia=bGS; acute fatty liver of pregnancy=bGt; severe childhood autosomal recessive muscular dystrophy=bgt; hemoglobin d trait=bGT; stunned myocardium=bgT; congenital absence of adrenal gland=bgu; reye-like syndrome=bGu; hemoglobin h constant spring=bGO; chronic pyelonephritis=bGO; alpha-thalassemia, deletion type=bGV; dystrophyic cardiomyopathy=bgv; hyperinsulinemiac hypoglycemia, familial, 4=bGv; mitral valve disease=bgV; muscle fibrosis=bgw; hammer toe=bGw; merrf syndrome=bgW; beta thalassemia, dominant inclusion body type=bGW; beta thalassemia major anemia=bGX; hemochromatosis, type 3=bGx; ciliary dyskinesia, primary, 9=bgX; cardiomyopathy associated with another disorder=bgx spinal muscular atrophy, distal, autosomal recessive, 5=bgY; hemochromatosis, type 2a=bGy; x-linked muscular dystrophy with abnormal dystrophyin=bgy; fetal hemoglobin guantitative trait locus 1=bGY; hemochromatosis, type 2b=bGz; beta-sarcoglycanopathy=bgz; hemoglobin e=bGZ; muscular dystrophy, limb-girdle, type 1e=bgZ; atherosclerotic occlusive disease=bH; gastrinoma=Bh; pneumonia, ventilator-associated=BH; liver cirrhosis=bh; dominant thalassemia=bHa; macrocephaly, benign familial=bHA; congenital disorder of glycosylation type Ij=bhA; 3-methylglutaconic aciduria, type v=bha; ceroid lipofuscinosis, neuronal, 4b, autosomal dominant=bhb; acute abdominal pain=bHb; oculocutaneous albinism type 2=bHB; myasthenic syndrome, congenital, with tubular aggregates 2=bhB; congenital disorder of glycosylation, type iu=bhC; hypochromic anemia=bHc; mental retardation, autosomal recessive 38=bHC; ciliary dyskinesia, primary, 16=bhc; congenital disorder of glycosylation, type in=bhD; systemic lupus erythematosus 16=bhd; hemoglobin c disease=bHd; skin/hair/eye pigmentation, variation in, 1=bHD; penias carcinoma in situ=bHe; adenomatoid turner=bhE; color of iris=bHE; parental alcoholism=bhe; hallucinogen persisting perception disorder=bhf; gamma thalassemia=bHf; spondylocostal dysostosis 4, autosomal recessive=bHF; ventricular fibrillation, paroxysmal familial, 2=bhF; neuroleptic-induced tardive dyskinesia=bhG; encephalyopathy, lethal, due to defective mitochondrial and peroxisomal fission=bhg; hypopituitarism and septooptic 'dysplasia'=bHG; delta beta thalassemia=bHg; spermatogenic failure 9=bhH; charcot-marie-tooth disease, type 2b=bhh; growth hormone deficiency with pituitary anomalies=bHH; cyanosis, transient neonatal=bHh; boomerang dysplasia=bhi; spastic paraplegia type 4=bhI; panhypopituitaris=bHI; central cyanosis=bHi; dihydropyrimidinase deficiency=bhJ; diffuse cutaneous mastocytosis=bHj; myopathy, centronuclear, autosomal dominant=bhj; tay-sachs disease, juvenile=bHJ; charcot-marie-tooth disease, dominant intermediate b=bhk; epidural abscess=bHk; tay-sachs disease, variant b1=bHK; dihydropyrimidine dehydrogenase deficiency=bhK; hexosaminidase alpha-subunit deficiency (variant b)=bHL; thymom=bhL; focal dermal hypoplasia=bHl; larsen syndrome=bhl; lethal congenital contracture syndrome 5=bhm; ciliary dyskinesia, primary, 21=bhM; infantile sandhoff disease=bHM; sick sinus syndrome 2, autosomal dominant=bHm; sandhoff disease, adult type=bHN; tracheal stenosis=bhN; brugada syndrome 8=bHn; inherited peripheral neuropathy=bhn; binge-eating disorder=bhO; sandhoff disease, infantile type=bHO; tachy-brady syndrome=bHn; hereditary sensory and autonomic neuropathy type ie=bhn; sandhoff disease, juvenile type=bHP; sick sinus syndrome=bHp; opium abuse=bhP; cerebellar ataxia, deafness, and narcolepsy, autosomal dominant=bhp; narcolepsy 1=bHg; emotional stress=bhQ; juvenile sandhoff disease=bHQ; cerebellar ataxia, deafness, and narcolepsy=bhq; latent autoimmune diabetes mellitus in adult=bhr; childhood aggression=bhR; hemochromatosis, type 4=bHR; hypersomnolence=bHr; victimizing others=bhS; hfe gene=bHS; adams-oliver syndrome 2=bhs; narcolepsy without cataplexy=bHs; hypersomnia, post-traumatic=bHt; acute schizephrenia=bhT; cortical blindness=bht; porphyria, south african type=bHT; drug use disorders=bhU; chondrodysplasia with platyspondyly, distinctive brachydactyly, hydrocephaly, and microphthalmia=bHu; air cyst=bhu; microvascular complications of diabetes, susceptibility to, 7=bHU; cornealia de lange syndrome 5=bHv; cluster a personality disorder=bhV; job's syndrome=bhv; hepatitis, viral, human=bHV; opioid use=bhW; wilson-turner x-linked mental retardation syndrome=bHw; keratoconu=bhw; chronic fatigue=bHW; pseudomyopathyic myasthenia=bhx; flaviviridae infections=bHX; acute intestinal obstruction=bHx opium addiction=bhX; megalencephalyic leukoencephalyopathy with subcortical cysts 2a=bHy; schizoid personality disorder=bhY; primary hypertriglyceridemia=bHY; proximal myopathy=bhy; congenital disorder of glycosylation, type im=bhz; pathyological gambling=bhZ; metal metabolism disorder=bHZ; megalencephalyic leukoencephalyopathy with subcortical cysts 2b, remitting, with or without mental retardation=bHz; cardiomyopathy, dilated, 1aa=BI; follicular adenoma=Bi; mural thrombus of heart=bI; alpha 1-antitrypsin deficiency=hi; naxos disease=biA; typhoid feve=bIA; gambling=bia; selective igg deficiency disease=bIa; hemolytic anemia, nonspherocytic, due to hexokinase deficiency=bIB; rapadilino syndrome=bib; tremor hereditary essential, 1=bib; ectodermal dysplasia/skin fragility syndrome=biB; obsessive-compulsive personality disorder=hie; premature ovarian failure 9=bIc; neuropathy, hereditary motor and sensory, russe type=bIC; cardiomyopathy dilated with woolly hair and keratoderma=biC; novelty seeking personality trait=bid; ochronotic arthropathy=bId; epidermaolysis bullosa, lethal acantholytic=biD; hemolytic anemia due to hexokinase deficiency=bID; eye infections, fungal=bIE; keratosis palmoplantaris striata ii=biE; hyperkinetic conduct disorder=bie; ochronotic arthritis=bIe; finding relating to sexuality and sexual activity=bif; hair morphology 2=biF; ochronosis=bIf; alveolar echinococcosis=bIF; alkaptonuri=bIg; moderate obesity=big; dentin dysplasia, type ii=biG; paraneoplasmtic syndromes, nervous system=bIG; diarrhea 3, secretory sodium, congenital=bIh; sexually transmitted diseases, viral=bIH; dentinogenesis imperfecta, shields type 3=biH; female sexual dysfunction=bih; deafness, autosomal recessive 39=bIi; deafness, autosomal dominant 39, with dentinogenesis imperfecta 1=biI; dependent personality disorder=bii; arthrofibrosis=bII; *Plasmodium falciparum* infection=bIJ; hereditary opalescent dentin (disorder)=biJ; ulcer of artery=bIj; iga pemphigus=bij; bites and stings=bIK; cutaneous neurofibroma=bIk; subcorneal pustular dermatosis=bik; epidermaolysis bullosa simplex, autosomal recessive=biK; fibrosis of urinary bladder=bII; drug reaction with eosinophilia and systemic symptoms=bIL; arrhythmogenic right ventricular dysplasia, familial, 11=biI; neuropathy, hereditary sensory and autonomic, type vi=biL; ocular myasthenia gravis=bIM; chest—diseases=bIm; epidermaolysis bullosa simplex autosomal recessive 2=biM; hypotrichosis and recurrent skin vesicles=bim; lumbar meningomyelocele=bIN; renal hypodysplasia, nonsyndromeic, 1=biN; nephronophthisis—medullary cystic disease=bIn; cardiomyopathy, right ventricular=bin; involutional paraphrenia=bIO; familial renal papillary carcinoma=blo; ehlers-danlos syndrome, musculocontractural type 2=bio; noncompaction of left ventricular myocardium, familial isolated, autosomal dominant 1=biQ; hermansky-pudlak syndrome 7=biP; keratosis palmoplantaris striata 1=bip; crimean-congo hemorrhagic fever=bIp; birdshot chorioretinitis=bIP; conjunctivitis=bIQ; moderate chronic obstructive pulmonary disease=biQ; erythroderma, congenital, with palmoplantar keratoderma, hypotrichosis, and hyper-ige=biq; chromosome 1p36 deletion syndrome=big; thyroid dyshormonogenesis 6=biR; ritter's disease=bir; pars planitis=bIR; beta-hydroxyisobutyryl coa deacylase deficiency=bIr; hormone deficiency=biS; male germ cell turner=bIs; skeletal tuberculosis=bIS; arrhythmogenic right ventricular dysplasia, familial, 10=bis; nut allergic reaction=bIT; cardiomyopathy, dilated, 1bb=bit; subclinical hypothyroidism=biT; myocardial hypoxia=bit; pityriasis rosea=bIU; pemphigus vulgaris, familial=biu; transient hypothyroidism=biU; myeloma, endothelial=bIu; epidermal growth factor receptor negative non-small cell lung cancer=bIv; thyroid dyshormonogenesis 5=biV; disorder of mucous membrane=biv; systemic vasculitis=bIV; hypotrichosis, localized, autosomal recessive 1=biw; acyanotic congenital heart disease=bIw; abacavir hypersensitivity, susceptibility to=bIW; dyshormonogenic goiter=biW; spindle cell hemangioma=bIx; monilethrix=bix klatskin's turner=biX; back pain mechanical=bIX; non-congenital cyst of kidne=bIy; corneal degeneration=bIY; hypogonadotropic hypogonadism 19 with or without anosmia=biY; skin fragility-woolly hair syndrome=biy; tenosynovitis=bIZ; malocclusion, angle class iii=biZ; arrhythmogenic right ventricular dysplasia, familial, 8=biz; neurobehavioral problems=bIz; parkinson's disease=bj; choroideremia=Bj; endocardial fibroelastosis=BJ; mural thrombus=bJ; ectodermal dysplasia (anhidrotic)=bjA; renal glycosuria=bJa; cysticercosis=bja; epidemic nephropathy=bJA; psoriasis susceptibility 1=bJb; hypohidrosis=bjB; potocki-lupski syndrome=bjb; actinic prurigo=bJB; guttate psoriasis=bJc; spinal muscular atrophy, childhood, proximal, autosomal dominant=bjc; ankle arthritis=bJC; anhidrosis=bjC; conjunctival scar=bJd; macrophagic myofasciitis=bJD; anodontia=bjD; charcot-marie-tooth disease, axonal, type 2o=bjd; mental retardation, autosomal dominant 13=bje; polyglandular failure=bJE; fissured tongue=bJe; craniofrontonasal syndrome=bjE; asphyxiating thoracic dystrophy 3=bjf; scalp dermatosis=bJf; hypohidrotic ectodermal dysplasia=bjF; lupus cutaneous=bJF; tenth agenesi=bjG; mainzer-saldino disease=bjg; leg dermatosis=bJg; undifferentiated inflammatory arthritis=bJG; short rib-polydactyly syndrome, verma-naumoff type=bjh; sclerosisng lymphocytic lobulitis=bJH; dmac=bJh; ectodermal dysplasia 3, anhidrotic=bjH; opticospinal multiple sclerosis=bJi; subchondral cyst=bJI; vacterl association=bji; ectodermal dysplasia 11a, hypohidrotic/hair/tooth type, autosomal dominant=bji; mental retardation, autosomal dominant 7=bjj; ectodermal dysplasia 11b, hypohidrotic/hair/tooth type, autosomal recessive=bjJ; ige-mediated allergic asthma=bJJ; tungsten-carbide disease=bJj; renal involvement in scleroderma=bJK; guestion mark ears, isolated=bjK; arthritis of hip=bJk; physical symptom=bjk; borderline leprosy=bJL; gluten sensitivity=bJl; color blindnes=bjI; auriculocondylar syndrome 3=bjL; small-vessel disease=bjM; fibrocalculous pancreatic diabetes=bJm; myopathy, distal, with anterior tibial onset=bjm; strongyloidiasis=bJM; latex hypersensitivity=bJn; welander distal myopathy=bjn; synovitiss=bJN; diabetic heart disease=bjN; uterovaginal prolapse=bjO; hepatosplenic schistosomiasis=bJo; ciliary dyskinesia, primary, 25=bjn; iritis=bJO; allergic fungal sinusitis=bJp; elephantiasis=bjP; fibrosis of bile duct=bjp; folliculitis=bJP; diffuse infiltrative lymphocytosis syndrome=bJQ; acute chest syndrome=bjQ; celiac disease in children=bJg; benign peritoneal mesothelioma=bjg; seguoiosis=bJr; waardenburg syndrome, type 4b=bjR; macrocytosis, familial=bjr; microscopic colitis=bJR; lymph node disease=bjs; allergy to fruit=bJs; waardenburg syndrome, type 4=bjS; echovirus infections=bJS; sarcoid arthropathy=bJT; acute disseminated encephalyomyelitis=bJt; paranoid traits=bjt; hirschsprung disease, susceptibility to, 4=bjT; major histocompatibility complex class ii deficiency=bJU; combined oxidative phosphorylation deficiency 12=bju; hepatic cancer metastatic=bjU; whipple disease=bJu; multiple sclerosis, susceptibility to=bJv; chondrodysplasia punctata 2, x-linked dominant=bjv; impetigo=bjV; subacute thyroiditis=bJV; insulin autoimmune syndrome=bJw; epiglottitis=bJW; arthrogryposis, distal, type 5d=bjw; hirschsprung disease, susceptibility to, 2=bjW; echinococcosis, hepatic=bJx abed syndrome=bjX; camptodactyly aeguired=bjx intravenous bisphosphonates=bJX; camptodactyly congenital=bjy; digestive system abnormalities=bjY; autoimmune vasculitis=bJY; pigeon-fanciers' disease=bJy; tenth agenisi, selective, x-linked, 1=bjz; disorder of the genitourinary system=bJz; congenital intestinal aganglionosis=bJZ; erysipelothrix infections=bJZ; cryptogenic organizing pneumonia=Bk; cystic fibrosis=bk; nervous system disease=bK; muscle damage=BK; bronchial dysplasia=bkA; maturity-onset diabetes of the young, type 1=bKA; herpes simplex type 1 infection=bKa; neuronal intestinal dysplasia=bka; wasting=bkb; familial ependymoma=bkB; lung sarcoma=bKb; detoni fanconi syndrome=bKB; chronic idiopathyic urticaria=bkc; cerebral metastases=bkC; inclusion body myopathy with early-onset paget disease with or without frontotemporal dementia 3=bKC; porphyria, acute intermittent, nonerythroid variant=bKc; amyotrophyic lateral sclerosis 20=bKD; dysplastic oral leukoplakia=bkD; malattia leventinese=bkd; porphobilinogen deaminase deficiency=bKd; dominant drusen=bke; asthmatic bronchitis=bkE; pulmonary lymphangiomyomatosis=bKe; inclusion body myopathy with early-onset paget disease with or without frontotemporal dementia 2=bKE; lipoma of colon=bKf; pituitary eosinophilic adenoma=bkf; thrombocytopenia-absent radius syndrome=bKF; alkaline phosphatase, plasma level of, guantitative trait locus 1=bkf; vagina leiomyoma=bKg; cutis laxa, autosomal recessive, type ib=bkg; pancreatic cancer stage=bkG; radioulnar synostosis with amegakaryocytic thrombocytopenia=bKG; pelvic prolapse=bKH; benign mesenchymoma=bKh; cutis laxa, recessive=bkh; multiple basal cell papillomata=bkH; larynx sguamous papilloma=bkI; epilepsy with generalized tonic-clonic seizure=bki; hand foot uterus syndrome=bKI; myofibroma=bKi; dermaoid cyst=bkJ; statins, attenuated cholesterol lowering by=bKj; preaxial deficiency, postaxial polydactyly and hypospadias=bKJ; periosteal disorder=bkj; heme oxygenase 1 deficiency=bKk; athabaskan brainstem dysgenesis=bKK; mixed cell type cancer=bkK; Venezuelan equine encephalyitis=bkk; bosley-salih-alorainy syndrome=bKL; growth and mental retardation, mandibulofacial dysostosis, microcephaly, and cleft palate=bkl; infection by leishmania infantum=bKl; adenosarcoma=bkL; pancreatitis, graft=bKm; esophageal atresia=bkm; microtia, hearing impairment, and cleft palate=bKM; acute interstitial pneumonia=bkM; pleurisy=bKn; axenfeld-rieger syndrome, type 1=bkn; invasive malignant thymoma=bkN; myxopapillary ependymnm=bKN; hypomagnesemia 4, renal=bko; facial paresis, hereditary congenital, 3=bKO; breast metaplastic carcinoma=bkO; oculoauricular syndrome=bKo; facial paresis, hereditary, congenital=bKP; spastic paraplegia 20, autosomal recessive=bkp; pineal parenchymal turner of intermediate differentiation=bkP; maturity-onset diabetes of the young, type 3=bKp; fast acetylator due to n-acetyl-transferase enzyme variant=bkg; mixed glioma=bkQ; constant sguint=bKQ; laron syndrome type 2=bKq; mesenchymal glioblastoma=bkr; ectodermal dysplasia, pure hair-nail type=bKR; diabetes mellitus, insulin-dependent, 20=bKr; mature teratoma=bkR; cervical adenosquamous carcinoma=bkS; lower extremity deformities, congenital=bKS; peripheral nerve sheath neoplasm=bks; hepatic adenomas, familial=bKs; syndactyly, type v=bKT; insulin resistance, susceptibility to=bKt; lymphoepithelioma-like carcinoma=bkT; trophyoblastic neoplasm=bkt; uterine carcinosarcoma=bkU; brachydactyly, type d=bKU; papillary transitional carcinoma=bku; low renal threshold for glucose=bKu; esophageal basaloid squamous cell carcinoma=bkV; juvenile gout=bKv; kidney angiomyolipoma=bkv; brachydactyly-syndactyly syndrome=bKV; synpolydactyly with foot anomalies=bKW; erythrocytosis, familial, 3=bkW; medullary cystic kidney disease 1=bKw; molluscum contagiosum=bkw; simple syndactyly of toes, first web space=bKX; maladaptive behavior associated with physical illness=bkX; prostate cancer, hereditary, 11=bKx; pneumonia, staphylococcal=bkx; amine acid transport disorder=bkY; hyperuricemiac nephropathy=bKy; brachymesophalangy 2 and 5=bKY; otorhinolaryngologic neoplasms=bky; primary polycythemia=bkZ; recurrent lung cancer=bkz; tyrosinemia type iii=bKZ; medullary cystic kidney=bKz; dermatomyositis=BL; vascular disease=bL; obstructive lung disease=bl; subfertility=Bl; prostate cancer, hereditary, 2=blA; retroperitoneal sarcoma=bla; fetal adenoma=bLA; hawkinsinuria=bLa; thrombophilia due to histidine-rich glycoprotein deficiency=bLB; combined oxidative phosphorylation deficiency 17=blB; digital clubbing, isolated congenital=bLb; charcot-marie-tooth disease, type 4e=blb; charcot-marie-tooth disease, type 1d=blc; thrombophilia due to elevated histidine-rich glycoprotein=bLC; cranioosteoarthropathy=bLc; plasminogen deficiency, type i=blC; unilateral undescended testis=bLd; dejerine-sottas disease=bld; alopecia universalis congenita=bLD; neutropenia, severe congenital, autosomal dominant 1=blD; myelinopathy=ble; basal cell carcinoma, multiple=bLe; ligneous conjunctivitis=blE; marie unna hereditary hypotrichosis 1=bLE; alopeci=bLF; prostate cancer, hereditary, 12=blf; anhaptoglobinemia=bLf; septicemia due to *Escherichia coli* {*E. coli*}=blE; enterococcal infection=big; air trapping=blG; foodborne diseases=bLg; bell's palsy=bLG; biphasic synovial sarcoma=blH; senile systemic amyloidosis=bLh; hypogonadotropic hypogonadism 15 with or without anosmia=bLH; hypothalamic syndrome=blh; staggering gait=bli; cortisone reductase deficiency=bLI; carotid disease=bLi; pancreatic islet cell turners=blI; scurvy=bLj; polymicrogyria with optic nerve hypoplasia=blj; deafness, autosomal recessive 88=blJ; cortisone reductase deficiency 2=bLJ; fanconi renotubular syndrome 3=blk; deficiency of transferase=bLk; buschke-ollendorff syndrome=blK; hypothalamic obesity=bLK; apparent mineralocorticoid excess syndrome=bLL; self-injurious behavior=bLl; cutis laxa, autosomal dominant 1=blL; glucagonoma=bll; acute urate nephropathy=bLm; hydroxysteroid (11-beta) dehydrogenase 2=bLM; kleefstra syndrome=blm; cutis laxa, autosomal dominant=blM; hemangiomatosis, familial pulmonary capillary=bln; fenestration=blN; hyporeninemiac hypoaldosteronism=bLN; hps3 gene=bLn; hermansky-pudlak syndrome 4=bLo; elastosis perforans serpiginosa=blO; amine acid deficiency=blo; hypertensive end stage renal disease=bLO; mental retardation, x-linked, syndromeic 10=bLP; vanishing white matter leukodystrophy with ovarian failure=blp; proximal aortic dissection=blP; hps5 gene=bLp; hps6 gene=bLg; mental retardation, x-linked 17=bLQ; cutis laxa, acquired type=blQ; vanishing white matter disease=blq; hereditary central nervous system demyelinating diseases=blr; deficiency of enoyl-coa hydratase=bLR; alloimmune thrombocytopenia=bLr; constrictive bronchiolitis=blR; beta-ketothiolase deficiency=bLS; glycogen storage disease iiib=bls; congenital supravalvular aortic stenosis=blS; breast lymphoma=bLs; diffuse alveolar damage=bLt; bile acid synthesis defect, congenital, 1=bLT; osteopoikilosis=blT; glycogen synthase deficiency=blt; pulmonary valve stenosis=blU; cataract, zonular=bLU; hyperkalemic periodic paralysis=blu; hajdu-cheney disease=bLu; compartment syndrome=bLv; congenital lamellar cataract=bLV; cone-rod dystrophy 7=blV; richieri costa pereira syndrome=blv; myopathy, congenital, with excess of muscle spindles=bLw; stargardt disease 3=blW; autism, susceptibility to, 19=blw; transposition=bLW; endemic diseases=bLx; parkinson disease 18=blx; primary cortisol resistance=bLX; ichthyosis, spastic quadriplegia, and mental retardation=blX; endocrine disease of the skin=bLY; phacomatosis pigmentokeratotica=bLy; cardiovirus infections=bly; chronic hand eczema=blY; plantar wart=bLz; protozoan diseases=bLZ; cat-scratch disease=blZ; asthma, occupational=blz; liver cancer=bm; glycogen storage disease=BM; leprosy=Bm; dystonia=bM; mental retardation, autosomal dominant 11=bmA; sighing respiration=bMa; diurnal enuresis=bMA; limb-girdle muscular dystrophy, type 1b=bma; prodromal states=bMB; spherocytosis, type 5=bmB; bowen-conradi syndrome=bmb; parasitic protozoa infectious disease=bMb; familial schizencephaly=bmc; diarrhea 5, with tufting enteropathy, congenital=bmC; neonatal meningitis=bMc; sleep bruxism=bMC; leukodystrophy, hypomyelinating, 4=bMd; colorectal cancer, hereditary nonpolyposis, type 8=bmD; amelogenesis imperfecta, type ic=bmd; peripheral neuropathic pain=bMD; lynch syndrome i (site-specific colonic cancer)=bmE; open bite=bme; major affective disorder=bME; infectious gastroenteritis=bMe; hemoglobin c trait=bmF; high altitude illness=bMf; alcoholic psychosis=bMF; dental enamel hypoplasia=bmf; sexual dysfunction, physiological=bMG; saccular aneurysm=bmg; sarcoid uveitis=bMg; vici syndrome=bmG; gestosis=bMH; segmental vitisligo=bmh; resectable hepatocellular carcinoma=bMh; perseveration=bMH; drug-induced depressive state=bMI; corneal dystrophy, fuchs' endothelial, 2=bmI; lymphocytic hypopituitarism=bmi; charcot-marie-tooth disease, type 2f=bMi; myotonic dystrophy type 2=bmJ; neuronopathy, distal hereditary motor, type iib=bMj; hallucinosis=bMJ; glycogen storage disease xiii=bmj; upper motor neuron sign=bMk; adducted thumbs syndrome=bmk; hyperdistention=bMK; congenital absence of liver=bmK; hypophosphatemiac rickets, autosomal recessive, 2=bml; system disorder of the nervous system=bML; neuronopathy, distal hereditary motor, type iic=bMl; ureterocele=bmL; bulla of lung=bmM; cole disease=bmm; macular degeneration, age-related, 7=bMM; charcot-marie-tooth disease, type 2i=bMm; spondyloarthropathy, susceptibility to, 1=bmn; confluent drusen=bMN; microvascular complications of diabetes, susceptibility to, 2=bmN; neuropathy, distal hereditary motor, type iia=bMn; spastic paraplegia 13, autosomal dominant=bMo; chronic anemia=bmO; bile duct disease=bmn; parkinson disease 13, autosomal dominant, susceptibility to=bMO; spastic paralysis=bMp; heterozygous hemoglobinopathy=bmP; cadmium poisoning=bmp; juvenile onset huntington's disease=bMP; spastic paraplegia 64, autosomal recessive=bmq; fourth disease=bMQ; diffuse lepromatous leprosy=bMq; anemia in malignant neoplasmtic disease=bmQ; inguinal lymphadenopathy=bmR; head injuries, penetrating=bmr; mental retardation, x-linked, syndromeic, turner type=bMR; inflammatory acne=bMr; nocardiosis=bMs; adams-oliver syndrome 4=bms; anemia of chronic renal failure=bmS; hyaluronidase deficiency=bMS; anemia of renal disease=bmT; hypoxia, brain=bmt; dyssegmental dysplasia=bMt; ciliary dyskinesia, primary, 5=bMT; anemia of prematurity=bmU; phosphohydroxylysinuria=bMU; periodic fever, menstrual cycle-dependent=bMu; rubinstein-taybi syndrome 2=bmu; depression anxiety disorder=bMv; hydroxylysinuria=bMV; ossifying fibromyxoid tumor=bmv; periventricular leukomalacia=bmV; affective symptoms=bMw; hydrolethalus syndrome 1=bMW; erythrocytosis, familial, 4=bmw; cerebellar angioblastoma=bmW; offensive aggression=bMx; multiple mitochondrial dysfunctions syndrome 3=bMX; diabetic macular edema=bmX; respiratory distress syndrome in premature infants=bmx aura=bMy; central neuroblastoma=bMY; myeloperoxidase deficiency=bmY; somatostatinoma=bmy; sleep arousal disorders=bMz; presentey anomaly=bmZ; malaria, cerebral, susceptibility to (finding)=bMZ; pancreatic somatostatinoma=bmz; pancreatitis=bn; hypomagnesemia 1, intestinal=BN; hereditary spastic paraplegia=bN; cardiomyopathy, familial restrictive, 1=Bn; avian influenza=bNA; radiculopathy=bnA; stasis dermatitis=bNa; corneal dystrophy, posterior amorphous=bna; juvenile psoriatic arthritis=bnb; xfe progeroid syndrome=bnB; vipoma=bNB; disorder characterized by fever=bNb; cerebrooculofacioskeletal syndrome 4=bnC; glioma susceptibility 1=bnc; keratopathy=bNc; hepatitis d, chronic=bNC; gastrointestinal toxicity=bnD; somatoform disorder=bND; landsteiner-wiener phenotype=bNd; congenital duodenal obstruction due to malrotation of intestine=bnd; endocrine-cerebroesteedysplasia=bNe; intestinal perforation=bNE; cerebrooculofacioskeletal syndrome 2=bnE; radicular pain=bne; henipavirus infections=bNF; trichothiodystrophy, photosensitive=bnF; periodic alternating nystagmus=bnf; immunodeficiency, common variable, 1=bNf; epidermal growth factor receptor positive non-small cell lung cancer=bng; chronic eczema=bNg; brittle hair=bnG; skin papilloma=bNG; hepatitis b virus, susceptibility to=bNH; epidermaolytic hyperkeratosis=bnH; colon (non-specific) lesion=bnh; neurocytoma=bNi; sendai virus infection=bNI; chromosome 8, trisomy 8p=bNi; cerebellar degeneration, subacute=bni; xeroderma pigmentosum b/cockayne syndrome=bnI; fanconi anemia, complementation group g=bnJ; chondroblastic osteosarcoma=bNj; hormone receptor positive tumor=bnj; entamoebiasis=bNJ; salmonella infections, animal=bNK; radiation sickness=bnK; retinitis pigmentosa 46=bNk; paraneoplasmtic cerebellar degeneration, anti-yo-associated=bnk; aplastic anemia, susceptibility to (finding)=bNL; paroxysmal extreme pain disorder=bNl; xeroderma pigmentosum, type g/cockayne syndrome=bnL; rebound nystagmus=bnl; alpha-1-iduronidase deficiency=bNm; uv-sensitive syndrome 1=bnM; uterine corpus cancer=bnm; dermaopathy=bNM; enterobacteriaceae infections=bNN; pneumoconiosis=bnn; microcephaly, epilepsy, and diabetes syndrome=bNn; bone marrow failure syndrome 2=bnN; microcephaly with simplified gyral pattern=bNo; uv-sensitive syndrome 2=bnO; ovary epithelial cancer=bno; Picornaviridae infections=bNO; craniosynostosis 4=bnP; empty sella syndrome=bnp; diabetes mellitus, insulin-dependent, 19=bNp; heymann nephritis=bNP; gastroesophageal junction adenocarcinoma=bnq; primary bacterial peritonitis=bNQ; synostotic posterior plagiocephaly=bnQ; aplasia of muscle=bNq; complex craniosynostosis=bnR; apocrine adenosis of breast=bnr; osteogenesis imperfecta, type v=bNr; typhlocolitis=bNR; fatal infectious mononucleosis=bNS; osteogenesis imperfecta, type vi=bNs; friend leukemia=bnS; breast apocrine carcinoma=bns; gastric tubular adenocarcinoma=bnt; mydBB deficiency=bNt; mild visual impairment=bnT; bronchopulmonary aspergillosis=bNT; specific viral infections=bNu; fundus albipunctatus=bnU; breast intraductal proliferative lesion=bnu; fungal keratitis=bNU; lethal congenital contracture syndrome 1=bnv; paresthesia, distal=bNv; spirochaetales infections=bNV; blue color blindness=bnV; lethal congenital contracture syndrome 2=bnw; myocarditis, chronic=bNw; ectomesenchymoma=bnW; glomerulonephritis proliferative chronic=bNW; tuberculous pleural effusion=bNx; prostate small cell carcinoma=bnX; secondary malignant neoplasm of the omentum=bnx; sle glomerulonephritis syndrome, who class iv=bNX; spastic paraplegia 18, autosomal recessive=bnY; disseminated due to other mycobacteria=bNy; choroid plexus papilloma=bny; atopic cataract=bNY; toxoplasmosis chorioretinitis=bNZ; erythromelalgia=bNz; amyotrophyic lateral sclerosis 19=bnz; antigen in scianna blood group system=bnZ; cardiomyopathy, familial hypertrophyic, 1=Bo; liposarcoma=bo; protrusion=BO; adrenal cortical hypofunction=bO; melanoma recurrent=bOa; ovary transitional cell carcinoma=boA; cranioectodermal dysplasia=bOA; cadin blood group antigen=boa; progressive diaphyseal dysplasia=bOB; periventricular nodular heterotopia 6=bob; breast adenoid cystic carcinoma=boB; drug-induced erythema multiforme=bOb; congenital heart bloc=boc; short-rib thoracic dysplasia 10 with or without polydactyly=bOC; autologous graft versus host disease=bOc; sclerosisng hemangioma=boC; vacterl association with hydrocephalyus=bOD; pseudoainhum=bod; immature teratoma of ovary=boD; myocarditis, active=bOd; cranioectodermal dysplasia 3=bOE; chlamydophila pneumoniae infections=bOe; testicular hydrocele=boE; focal infection=boe; premenstrual symptom=bOE; eosinophilic pustular folliculitis=bOf; argentinian hemorrhagic fever=bof; asphyxiating thoracic dystrophy 2=bOF; corpus callosum, agenisi of, with mental retardation, ocular coloboma, and micrognathia=bOG; aseptic peritonitis=bog; panarteritis=bOg; hernia sac=boG; wrist injuries=bOH; deafness, autosomal recessive 35=boH; murray valley encephalyitis=boh; *Mycobacterium leprae* infection=bOh; zoonotic form of cutaneous leishmaniasis=bOi; lattice corneal dystrophy type 1=boI; osteodysplasia=bOI; western equine encephalyitis=boi; glossitis=boj; disseminated coccidioidomycosis=bOj; overproduction of growth hormone=bOJ; male sexual dysfunction=boJ; bacteroides infections=boK; Colorado tick feve=bok; secondary generalized epilepsy=bOk; axial myopia=bOK; bilateral retinoblastoma=bol; disseminated bacillus calmette-guerin infection=bOl; mesoblastic nephroma, cellular=boL; catabolic state=bOL; deafness, autosomal recessive 36, with or without vestibular involvement=bom; cystic hypersecretory carcinoma=boM; smooth muscle cancer=bOM; corneal ulcer=bOm; deafness, autosomal recessive 36, without vestibular involvement=bon; trichuriasis=bOn; weyers acrofacial dysostosis=boN; ring chromosome 15 syndrome=bON; muscle cancer=bOO; ellis-van Creveld syndrome=bnO; alzheimer disease 12=boo; campylobacteriosis=bOo; suicidal behavior=bop; hidradenoma=boP; cystic echinococcosis=bOp; diabetes mellitus, insulin-dependent, 2=bOP; cauda equina neoplasm=boQ; endophthalmitis=bOq; rapidly involuting congenital hemangioma=bOQ; vulvar vestibulitis=boq; sarcomatosis=boR; non-involuting congenital hemangioma=bOR; in vitro fertilization=bor; chronic rhinitis=bOr; chilblain lupus=boS; *Mycobacterium* infections, nontuberculous=bOs; experimental organism islet cell adenoma neoplasm=bOS; lumbar spondylosis=bos; mycobacterial disease, mendelian susceptibility to=bOt; mucopolysaccharidosis v=boT; mesoblastic nephroma=bOT; prolapse of female genital organs=bot; meninges hemangiopericytoma=bOU; interferon gamma receptor deficiency=bOu; postpartum psychosis=bou; dermatitis herpetiformi=boU; pontocerebellar hypoplasia type 1=boV; polyhydramnios=bOV; atypical carcinoid tumor=bov; disseminated atypical mycobacterial infection=bOv; vulvar intraepithelial neoplasmia, usual type=bow; pontocerebellar hypoplasia, type 1b=boW; omphalocele=bOW; *Helicobacter pylori* infection, susceptibility to=bOw; male genital abnormalities=box; infection by leishmania mexicana=boX; infection in children=bOx diabetes mellitus, insulin-dependent, 8=bOX; microglial nodules=bOY; epidermaolysis bullosa, nonspecific, autosomal recessive=boY; desquamative gingivitis=boy; primary tuberculosis=bOy; semantic dementia=bOZ; epidermaolysis bullosa simple=boZ; leprosy in children=bOz; papillary urothelial carcinoma=boz; lung benign neoplasm=bp; kidney failure=bP; autosomal dominant focal segmental glomerulosclerosis=BP; cardiomyopathy, familial hypertrophyic, 11=Bp; dysfibrinogenemia, congenital=bpA; locked-in syndrome=bPa; exostoses, multiple, type ii=bpa; chronic periodontitis, generalized=bPA; metachondromatosis=bpb; venous insufficiency=bpB; atopic ige-mediated allergic disorder=bPB; chronic liver failure=bPb; necrotic melanoma=bPC; perivascular epithelioid cell tumor=bPc; renal failure, progressive, with hypertension=bpc; factor xiii deficiency=bpC; adrenal neuroblastoma=bPd; fragile x chromosome=bpd; factor xiii, b subunit, deficiency of=bpD; chronic malaria=bPD; refractory shock=bPE; hearing loss, sudden=bpE; posttransfusion viral hepatitis=bpe; agammaglobulinemia 2, autosomal recessive=bPe; poems syndrome=bPf; intracranial embolism and thrombosis=bpF; recurrent acute otitis media=bPF; dysplasia epiphysealis hemimelica=bpf; interphalangeal osteoarthritis=bPG; hypothyroidism, central, and testicular enlargement=bPg; enchondromatosis, multiple, oilier type=bpg; esophageal and gastric varices=bpG; acrocapitofemoral dysplasia=bPh; hereditary multiple exostose=bph; factor ii deficiency=bpH; carditis=bPH; upper extremity deep veins thrombosis=bpI; squamous cell papilloma=bPi; branchiootic syndrome=bpi; turner stage mycosis fungoides=bPI; hepatic artery thrombosis=bpJ; immunodeficiency 15=bPj; cayler cardiofacial syndrome=bpj; neuropsychiatric lupus=bPJ; pulmonary hypoplasia, primary=bpk; postthrombotic syndrome=bpK; early onset psoriasis type 1=bPK; atypical mycobacteriosis, familial, x-linked 1=bPk; invasive pneumococcal disease, recurrent isolated, 2=bPl; cardiomyopathy, dilated, 1j=bpl; cerebral venous sinus thrombosis=bpL; rachischisis=bPL; immunodeficiency without anhidrotic ectodermal dysplasia=bPm; neurological disability=bPM; thrombosis of mesenteric veins=bpM; deafness, autosomal dominant 10=bpm; heterozygous factor v leiden mutation=bpN; lymphatic system disease=bPN; retinitis pigmentosa 25=bpn; ectodermal dysplasia, anhidrotic, with immunodeficiency, osteopetrosis, and lymphedema=bPn; alcoholic hepatitis=bPO; melena due to gastrointestinal hemorrhage=bpO; nemo mutation with immunodeficiency=bPo; microvillus inclusion disease=bpo; inflammatory bowel disease 23=bPp; basilar artery thrombosis=bpP; bird fancier's lung=bPP; hereditary antithrombin deficiency=bpp; endotoxin hyporesponsiveness=bPq; thrombosis of subclavian veins=bpQ; hereditary factor viii deficiency disease with inhibitor=bpq; gingivitiss=bPQ; eye burns=bPr; inflammatory bowel disease 28, autosomal recessive=bPR; factor x deficiency=bpr; calcium oxalate urolithiasis=bpR; inflammatory bowel disease 25, autosomal recessive=bPS; yellow feve=bps; eye infections, bacterial=bPs; thrombosis of internal jugular veins=bpS; histidinemia=bpt; major injury=bPt; bone inflammation disease=bPT; mesenteric ischemia=bpT; craniosynostosis and dental anomalies=bPU; factor xi deficiency=bpu; ileocolitis=bPu; hereditary hyperhomocysteinemia=bpU; hereditary angioedema type iii=bpv; sterile keratitis=bPV; mesenteric vascular occlusion=bpV; erythema nodosum leprosyum=bPv; atherothrombosis=bpw; felty's syndrome=bPW; nonsyndromeic holoprosencephaly=bPw; coagulation protein disease=bpW; organ dysfunction syndrome=bPx; parainfluenzae virus infection=bPX; factor xii deficiency=bpx; factor vii deficiency=bpX; female breast pain=bPY; factor xiii, a subunit, deficiency of=bpy; lyme carditis=bPy; factor v deficiency=bpY; orofacial cleft 1=bpz; respiratory infections in children=bPz; prothrombin deficiency=bpZ; seasonal allergic conjunctivitis=bPZ; myocardial infarction=bq; atrial septal defect 5=Bq; pancreatic ductal carcinoma=BQ; ovarian disease=bQ; chronic arthropathy=bqA; phlebitis=bqa; sowda=bQa; q fever endocarditis=bQA; urinary schistosomiasis=bQb; acute cerebrovascular disease=bqB; vascular skin disease=bqb; resorption of apex of tenth root=bQB; crigler-najjar syndrome=bqC; irregular bleeding=bQc; leri-weil syndrome=bqc; fatigue—symptom=bQC; heavy metal poisoning, nervous system=bQd; peliosis hepatis=bqd; systemic granulomatous disease=bQD; von willebrand disease, type 2=bqD; vitamin k-dependent clotting factors, combined deficiency of, 1=bqE; peri-implantitis=bQe; 3-hydroxyacyl-coa dehydrogenase deficiency=bqe; acute upper respiratory infection=bQE; familial antiphospholipid syndrome=bqf; dianzani autoimmune lymphoproliferative syndrome=bQf; congenital bleeding disorder=bqF; tactile allodynia=bQF; scleritis=bQg; deep veins thrombosis recurrent=bqg; proliferative synovitis=bQG; priapis=bqG; candidiasis, familial, 6=bQh; thrombophilia, x-linked, due to factor ix defect=bqH; heparin induced thrombocytopenia (hit)=bqh; sarcoid myopathy=bQH; hereditary factor ix deficiency disease without inhibitor=bqI; iron loading anemia=bQI; candidiasis, familial, 5=bQi; acquired thrombophilia=bqi; hypogonadotropic hypogonadism 18 with or without anosmia=bQj; neonatal stroke=bqj; spastic paraplegia 35, autosomal recessive=bqJ; diarrhea=bQJ; fallopian tube disease=bQK; renal obstruction=bQk; fatty acid hydroxylase-associated neurodegeneration=bqK; left ventricular thrombus=bqk; stomatognathic diseases=bqL; autoimmune connective tissue disorder=bQl; dysentery=bQL; livedoid=bql; hypertrophy of parotid gland=bQm; vulvovaginitis=bQM; aortic thrombosis=bqm; infections, recurrent, with encephalyopathy, hepatic dysfunction, and cardiovascular malformations=bqM; familial combined hyperlipidemi=bqN; opiate dependence=bQN; atrial septal aneurysm=bqn; candle syndrome=bQn; mevalonic aciduria=bQO; hiv wasting syndrome=bQo; tyrosinemia, type i=bqO; thrombosis of inferior vena cava=bqo; poikiloderma, hereditary fibrosisng, with tendon contractures, myopathy, and pulmonary fibrosis=bqP; postoperative deep veins thrombosis=bqp; nakajo syndrome=bQp; mental retardation, x-linked 21=bQP; erythrokeratodermaia variabili=bqQ; edema disease=bQQ; central retinal veins occlusion—juvenile=bqq; dental occlusion, traumatic=bQq; siderius x-linked mental retardation syndrome=bqR; dental fistula=bQr; microvascular complications of diabetes, susceptibility to, 4=bQR; heterozygous prothrombin g20210a mutation=bqr; leukodystrophy, hypomyelinating, 5=bqS; ureaplasma infections=bQS; convulsion in childhood=bQs; thrombophlebitis=bqs; gingival recession=bQt; sneddon syndrome=bqt; jaw, edentulous=bQT; hepatic adenoma=bqT; pleuropneumonia=bQu; neuropathy, hereditary sensory and autonomic, type iia=bqU; hennch-schnlein nephritis=bQU; central retinal artery occlusion=bqu; corneal melt=bQV; neuropathy, hereditary sensory and autonomic, type iib=bqV; schnitzler syndrome=bQv; postthrombotic syndrome=bqv; fanconi anemia, complementation group e=bqW; sagittal sinus thrombosis=bqw; idiopathyic acute pancreatitis=bQW; presenile and senile dementia=bQw; enterocolitis, neutropeniac=bQx; amelogenesis imperfecta nephrocalcinosis=bqX; hematoma, subdural, acute=bqx oligohydramnios=bQX; neck injuries=bQy; raine syndrome=bqY; intracranial hemorrhage, traumatic=bqy; il21r immunodeficiency=bQY; brain hemorrhage, traumatic=bQz; smoke inhalation injury=bqz; elevated ige=bQZ; hypophosphatemia, familial=bqZ; gingival disease=bR; early disease onset=br; cardiomyopathy, dilated, 1r=Br; galloway-mowat syndrome=BR; arthropathy, erosisve=bRA; testicular disease=brA; inflammatory bowel disease 17=bRa; cardiomyopathy, dilated, 1c=bra; van maldergem syndrome 2=brB; pediatric crohn's disease=bRb; toe syndactyly, telecanthus, and anogenital and renal malformations=brb; nicolaides baraitser syndrome=bRB; persistent lymphocytosis=bRc; amelogenesis imperfecta, type iii=brc; synpolydactyly 3=brC; seasonal rhinitis=bRC; idiopathyic eosinophilia=bRD; synpolydactyly 2=brD; interstitial nephritis, karyomegalic=brd; lymphocytic alveolitis=bRd; laryngeal tuberculosis=bRe;

infantile eczema=bRE; vitreoretinal dystrophy=brE; megalocytic interstitial nephritis=bre; fanconi anemia, complementation group b=brf; marfan syndrome type 2=brF; chronic eosinophilic pneumonia=bRF; diabetes mellitus, insulin-dependent, 10=bRf; follicular bronchiolitis=bRg; rheumatoid arthritis, systemic juvenile=bRG; vacterl association with hydrocephaly, x-linked=brg; pterygiu=brG; severe combined immunodeficiency, atypical=bRh; compound leukemias=brh; malignant myeloma=bRH; macular degeneration, age-related, 3=brH; fanconi anemia, complementation group c=bri; intracavitary turners of the heart=bRI; cataract, variable zonular pulverulent=bRi; cutis laxa, autosomal dominant 2=brI; discogenic pain=bRJ; fanconi anemia, complementation group d2=brj; amyloidosis, primary localized cutaneous, 2=bRj; congenital contractural arachnodactyly=brJ; gallstone pancreatitis=bRK; intestinal diseases, parasitic=bRk; shprintzen golberg craniosynostosis=brK; fanconi anemia complementation group g=brk; fanconi anemia, complementation group i=brl; schinzel-giedion syndrome=brL; simple pneumoconiosis=bRL; chronic allergic conjunctivitis=bRl; ectopia lentis 1, isolated, autosomal dominant=brM; pulmonary systemic sclerosis=bRm; steroid withdrawal syndrome=bRM; chromosome 2q37 deletion syndrome=brm; acrodermatitis continua of hallopeau=bRn; combined oxidative phosphorylation deficiency 14=brn; geleophysic dysplasia 2=brN; bone demineralization, pathyologic=bRN; taste disorders=bro; tuberculosis, bovine=bRo; scleroderma, familial progressive=brO; igg myeloma=bRO; autoimmune lymphoproliferative syndrome, type ia=brp; spontaneous preterm birth=bRp; marfanoid hypermobility syndrome=brP; encephalitis=bRP; familial ectopia lentis=brQ; vernal keratoconjunctivitis=bRq; burn scar=brq; leprosyy=bRQ; preterm premature rupture of fetal membranes=brr; greig cephalopolysyndactyly syndrome=bRR; lens subluxation=brR; acute amebiasis=bRr; chronic disseminated candidiasis=bRs; gingival overgrowth=bRS; fructose-1,6-bisphosphatase deficiency=brS; large plague parapsoriasis=brs; embolic stroke=bRt; encephalomyelitis=bRT; adult-onset still's disease=brt; mitochondrial dna depletion syndrome 13 (encephalyomyopathyic type)=brT; allergic bronchopulmonary mycosis=bRu; subacute sclerosisng panencephalitis=bRU; histiocytoma=bru; disuse atrophy=brU; miliary tuberculosis=bRV; intestinal pseudo-obstruction=brv; mikulicz disease=bRv; distal hereditary motor neuropathy, type ii=brV; acute and chronic colitis=bRW; hantavirus pulmonary syndrome=bRw; endophthalmiatis=brw; pallidopyramidal syndrome=brW; deafness, autosomal recessive 42=bRX; hypersplenism=brx polio and post-polio syndrome=brX; eosinophilic gastroenteritis=bRx macular holes=bry; recurrent herpes simplex infection of eye=brY; chondrodysplasia with joint dislocations, gpapp type=bRY; autoimmune thrombocytopenic purpura=bRy; autoimmune lymphoproliferative syndrome, type ib=brz; phosphoglycerate kinase 1 deficiency=bRZ; hermaphroditism=brZ; atopy, susceptibility to (finding)=bRz; spinocerebellar ataxia 5=BS; myocardial reperfusion injury=Bs; paraneoplasmtic pemphigus=bs; pick's disease=bS; acquired anomaly of tongue=bsA; retinitis pigmentosa 10=bSa; pancreatic islets hyperplasia=bSA; gram negative bacteremia=bsa; chronic metabolic disorder=bSB; leber congenital amaurosis 11=bSb; acute urticaria=bsb; uhl anomaly=bsB; hypoinsulinaemia=bSC; deficiency of phosphoglycerate kinase=bSc; mandibular diseases=bsc; congenital anomaly of tongue=bsC; pre-gestational diabetes=bSD; maxillary diseases=bsd; multiple intestinal atresia=bsD; moderate visual impairment=bSd; gross obesity=bSE; retinitis pigmentosa 56=bSe; malaria, severe, susceptibility to=bse; clear cell acanthoma=bsE; myotilinopathy=bSf; congenital premature fusion=bsF; soft tissue mass=bSF; meningitis, cryptococcal=bsf; rapidly progressive glomerulonephritis with pulmonary hemorrhage=bsg; borjeson-forssman-lehmann syndrome=bsG; focal segmental glomerulosclerosis 5=bSg; spontaneous hypoglycemia=bSG; charcot-marie-tooth disease, dominant intermediate e=bSh; ballismus=bSH; malaria, resistance to=bsh; spinocerebellar ataxia 27=bsH; immunodeficiency 20=bsi; hyperplastic obesity=bSI; morm syndrome=bSi; paroxysmal dyskinesia=bsI; alloimmune neonatal neutropenia=bsj; short stature (child)=bSJ; opsismodysplasia=bSj; metacarpal 4 5 fusion=bsJ; hypoglycemia in children=bSK; neutral lipid storage disease with myopathy=bSk; pathyergy=bsk; hypogonadotropic hypogonadism 20 with or without anosmia=bsK; chronic rheumatic heart disease=bsl; obesity in animals=bSL; maturity-onset diabetes of the young, type 10=bSl; osteoporosis-pseudoglioma syndrome=bsL; diabetic gastropathy=bSM; renal hypodysplasia/aplasia 2=bsM; vitamin e deficiency=bSm; recurrent respiratory tract infections=bsm; insulin lipoatrophy=bsN; lymphadeniti=bsn; telomeric 22g13 monosomy syndrome=bSn; malnutrition related diabetes mellitus=bSN; mevalonic aciduri=bso; cognitive disorder=bSO; tumoral calcinosis=bsO; ventricular outflow obstruction=bSo; skinache syndrome=bsp; scabies=bSP; primary acquired melanosis=bsP; compensatory hyperinsulinemia=bSp; normal pressure hydrocephalus=bSQ; epidermal nevus syndrome=bsQ; insulin receptor, defect in=bSq; inherited disorder of porphyrin metabolism=bsq; phosphaturic mesenchymal turner, benign=bsR; benign mesotheliomaa=bSR; familial obesity=bSr; photosensitivity disease=bsr; body mass index quantitative trait locus 10=bss; malignant gliomaa=bSS; hypervitaminosis=bsS; polycystic kidney disease, type 1=bSs; pulmonary alveolar microlithiasis=bsT; early myoclonic encephalopathy=bST; hypodysfibrinogenemia, congenital=bst; simple obesity=bSt; lymphopeniaa=bSU; hypodysfibrinogenemia=bsu; android obesity=bSu; angiolipoma=bsU; premenstrual tension=bsV; gangliogliomaa=bSV; pancreatic acinar atrophy=bSv; pulmonary embolis=bsv; hypervitaminosis d=bsW; malignant pleural mesotheliomaa=bSW; hyperglycemic hyperosmolar nonketotic coma=bSw; charcot-marie-tooth disease, type 4h=bsw; alcohol-related liver disease=bSx; leydig cell hyperplasia=bSX; hyperphosphatemia=bsX; lacrimoauriculodentodigital syndrome=bsx aplasia of lacrimal and salivary glands=bsy; tympanic membrane perforation=bsY; insulin allergy=bSy; hyperinsulinemiac hypoglycemia, familial, 5=bSY; right ventricle hypoplasia=bsz; eruptive xanthomas=bSz; radicular cyst=bsZ; diabetes mellitus, insulin-resistant, with acanthosis nigricans=bSZ; primary biliary cirrhosis=bT; refractive error=Bt; *Helicobacter pylori* {*H. pylori*}=bt; rotavirus infections=BT; type 2 diabetes mellitus with acanthosis nigricans=bTa; vascular disease occlusive=bta; phimosis=bTA; chromosome 8p11 myeloproliferative syndrome=btA; hypothalamic amenorrhea=btB; hair-an syndrome=bTb; skin hemangioma=btb; glanzmann thrombasthenia, autosomal dominant=bTB; megakaryocyte tumor=btc; myocardial injury=bTC; congenital anomaly of bile ducts=bTc; colon cancer liver metastasis=btC; impaired motor coordination=btD; interstitial lung disease, nephrotic syndrome, and epidermaolysis bullosa, congenital=bTD; nephronophthisis 3=bTd; familial glomangioma=btd; muscular dystrophy, congenital, due to integrin alpha-7 deficiency=bTE; decubitus ulcer=bte; senior-loken syndrome 5=bTe; atopic eczema/dermatitis (non-specific)=btE; leukocyte disease=bTE; congenital clinodactyly=btF; irak4 deficiency=bTf; deafness, congenital, with inner ear agenisi, microtia, and microdontia=btf; asthma-related traits, susceptibility to, 5=bTg; familial apolipoprotein c-ii deficiency=btg; pfeiffer syndrome=btG; posttransfusion purpura=bTG; ichthyosis vulgaris=btH; persistent asthma=bTh; otodental dysplasia=bth; iatrogenic disease=bTH; neonatal alloimmune thrombocytopenia (nait)=bTI; Crouzon syndrome=btI; invasive pneumococcal disease, recurrent isolated, 1=bTi; pulmonary malformation=bti; cold intolerance=bTj; tenth agenisi=btJ; acanthoma=btj; abdominal aortic atherosclerosis=bTJ; bronchitis in children=bTk; resorption of mandible=btK; weber-cockayne syndrome=bTK; hypogonadotropic hypogonadism 6 with or without anosmia=btk; cutis gyrata syndrome of beare and stevenson=btL; kallmann syndrome 6=btI; inflammatory bowel disease 14=bTI; lymphoproliferative syndrome, ebv-associated, autosomal, 1=bTL; systemic lupus erythematosus, susceptibility to, 10=bTm; scaphocephaly, maxillary retrusion, and mental retardation=btM; synkinesis=btm; lymphoproliferative syndrome 1=bTM; acrocephalyosyndactylia=btn; bent bone dysplasia syndrome=btN; neuriti=bTN; newcastle disease=bTn; craniofacial dysostosis type 1=btO; orofacial cleft 6, susceptibility to=bTo; multiple synostoses syndrome 3=btn; inosine triphosphatase deficiency=bTO; calcaneonavicular coalition=btp; popliteal pterygium syndrome=bTp; infantile polyarteritis=bTP; skull malformation=btP; unicoronal craniosynostosis=btQ; spinocerebellar ataxia 15=bTQ; cd11c-positive/cd1c-positive dendritic cell deficiency, autosomal dominant=bTq; osteoglophonic dwarfism=btq; muscular ventricular septum defect=btR; trigonocephaly, nonsyndromeic=btr; congenital non-progressive ataxia=bTR; monocyte and dendritic cell deficiency, autosomal recessive=bTr; erythrodermaic lamellar ichthyosis=bTS; inflammatory bowel disease 19=bTs; scirrhous adenocarcinoma=btS; jackson-weiss syndrome=bts; hypogonadotropic hypogonadism 2 with or without anosmia=btt; thyroid dyshormonogenesis 4=bTT; coronary artery disease, susceptibility to=bTt; cervical keratinizing squamous cell carcinoma=bT; fleck corneal dystrophy=bTU; holoprosencephaly, ectrodactyly, and bilateral cleft lip/palate=btu; ascariasis=bTu; congenital failure of fusion=bTU; hypertelorism, severe, with midface prominence, myopia, mental retardation, and bone fragility=bTv; Crouzon syndrome with acanthosis nigricans=btV; renal a dysplasia=btv; alagille syndrome 1=bTV; pfeiffer type acrocephalyosyndactyly=btw; lacrimal apparatus disease=bTw; deafness, congenital heart defects, and posterior embryotoxon=bTW; catshl syndrome=btW; severe achondrolasia with developmental delay and acanthosis nigricans=btX; hepatic ductular hypoplasia=bTX; myopathy with lactic acidosis, hereditary=bTx; plagiocephaly, nonsynostotic=btx; thrombocythemia 3=bTY; muscular dystrophy-dystroglycanopathy (congenital with brain and eye anomalies), type a, 7=bTy; placental sulfatase deficiency=bty; familial acanthosis nigricans=btY; goodman camptodactyly=btz; stucco keratosis=btZ; thrombocythemia 1=bTZ; autoimmune disease, syndromeic multisystem=bTz; myopia=Bu; stomach cancer=bu; invagination=BU; moyamoya disease=bU; synostotic anterior plagiocephaly=bua; acute aortic dissection=bUa; premature ovarian failure 6=buA; spinocerebellar ataxia 13=bUA; ceroid lipofuscinosis, neuronal 1, infantile=buB; splenic atrophy=bUb; long qt syndrome 5=bUB; cheilitis=bub; jervell and lange-nielsen syndrome 2=bUC; bruck syndrome 1=buC; mediastinal malignant lymphoma=bUc; sotos syndrome=hue; cellular phase chronic idiopathyic myelofibrosis=bUd; osteogenesis imperfecta, type xi=buD; long qt syndrome 6=bUD; dermatosis papulosa nigra=bud; hemorrhagic destruction of the brain, subependymal calcification, and cataracts=bUe; congenital joint contractures=buE; atrial fibrillation, familial, 4=bUE; urinary tract papillary transitional cell benign neoplasm=bue; bladder transitional cell papilloma=buf; atrial fibrillation, familial, 3=bUF; kuskokwim syndrome=buF; cardiomyopathy, familial hypertrophyic, 17=bUf; angular cheilitis=bug; brugada syndrome 6=bUG; ehlers-danlos syndrome with progressive kyphoscoliosis, myopathy, and hearing loss=buG; huntington disease-like 2=bOg; sexual assault=buH; monoblastic leukemia=buh; temple-baraitser syndrome=bUH; arrhythmogenic right ventricular dysplasia, familial, 12=bUh; muscular dystrophy-dystroglycanopathy (congenital with brain and eye anomalies), type a, 5=buI; gonadotropin releasing factor deficiency=bUi; fumaric aciduria=bui; short qt syndrome 1=bUI; mucinous ovarian cystadenoma=buj; muscular dystrophy, limb-girdle, type 2i=buJ; renal dysgenesis=bUj; unknown=bUJ; familial renal cell carcinoma=buk; cardiac channelopathy=bUK; kabuki syndrome=bUk; muscular dystrophy, congenital, 1c=buK; muscular dystrophy-dystroglycanopathy (congenital without mental retardation), type b, 4=buL; cerebral palsy, spastic quadriplegiac, 2=bUI; sesame syndrome=bUL; dual diagnosis=bul; polyp of larynx=bum; muscular dystrophy, limb-girdle, type 2m=buM; edema of spinal cord=bUM; chromosome 17 deletion=bUm; chromosome 17q21.31 deletion syndrome=bUn; microinvasive carcinoma=bun; diabetes mellitus, transient neonatal, 3=bUN; cardiomyopathy, dilated, Ix=buN; diabetes mellitus, permanent neonatal, with neurologic features=bUO; charcot-marie-tooth disease, recessive intermediate b=bUo; fibroadenosis=buo; pneumothorax, primary spontaneous=buO; tuberculosis chronic pulmonary=bup; snowflake vitreoretinal degeneration=bUP; hip dysplasia, beukes type=buP; deafness, autosomal recessive 89=bUp; leber congenital amaurosis 16=bUQ; autosomal recessive parkinsonism=bUq; latent virus infection=buq; lung cyst=buQ; choroid plexus cancer=bUR; myopathy, x-linked, with postural muscle atrophy=bur; dosage-sensitive sex reversal=bUr; familial multiple trichodiscomas=buR; allergic bronchitis=bUs; multiple lung cysts=buS; scapuloperoneal myopathy, x-linked dominant=bus; thyrotoxic periodic paralysis, susceptibility to, 2=bUS; bartter syndrome, antenatal, type 2=bUT; genitopatellar syndrome=bUt; dermatitis, atopic, 1=buT; myopathy, reducing body, x-linked, early-onset, severe=but; dermatitis, atopic, 2=bUU; short qt syndrome 3=bUU; ohdo syndrome=bUu; myopathy, reducing body, x-linked, childhood-onset=buu; blepharophimosis-intellectual disability syndrome, sbbys typ=bUv; emery-dreifuss muscular dystrophy 6, x-linked=buv; steroid sulfatase deficiency disease=buV; atrial fibrillation, familial, 9=bUV; long qt syndrome 13=bUW; skin diseases, bacterial=buW; nemaline myopathy 6=bUw; charcot-marie-tooth disease, type 4j=buw; hyperaldosteronism, familial, type iii=bUX; amyotrophyic lateral sclerosis 11=bux; myokymia 1=bUx; hand eczema=buX; hyperaldosteronism, familial, type ii=bUY; occupational irritant contact dermatitis=buY; yunis varon syndrome=buy; atrial fibrillation, familial, 7=bUy; hereditary bundle branch system defect=bUz; polymicrogyria, bilateral occipital=buz; familial hyperaldosteronism type 3=bUZ; childhood atopic dermatitis=buZ; shigellosis=BV; deafness, autosomal dominant 20=Bv; thoracic aortic aneurysm=bV; peptic ulcer disease=bv; subacute dermatitis=bva; atelosteogenesis type 3=bvA; angiomatous meningioma=bVA; barbiturate withdrawal=bVa; cornea plana 2=bVB; flexural atopic dermatitis=bvb; laryngotracheitis=bVB; migraine, with or without aura, susceptibility to, 13=bVb; cornea plana=bVC; inherited disorder of keratinization=bvc; pulmonary hypertension, primary, 4=bVc; exhibitionism=bvC; disorder of keratinization=bvd; filaminopathy, autosomal dominant=bvD; birk-barel mental retardation dysmorphism syndrome=bVd; medulloblastoma recurrent=bVD; generalized epilepsy and paroxysmal dyskinesia=bVe; onset of psoriasis in childhood (1-10 years)=bve; fructosuria=bVE; myopathy, distal, 4=bvE; metal allergy=bvf; hypogonadotropic hypogonadism 21 with or without anosmia=bvF; hypertension, diastolic, resistance to=bVf; fructosuria, essential=bVF; spastic paraplegia 8, autosomal dominant=bVG; hepatic insufficiency=bvG; glanzmann's thrombastheni=bVg; pachyonychia congenita=bvg; retinal ischemia=bvH; short qt syndrome 2=bVh; immune-complex glomerulonephritis=bvh; 3c syndrome=bVH; myelocytic leukemia-like syndrome, familial, chronic=bvI; spinocerebellar ataxia, autosomal recessive 15=bVI; syncopal episode=bVi; oto-palateo-digital syndrome, type 2=bvi; frontometaphyseal dysplasia=bvj; chromosome 9, partial trisomy 9p=bVJ; gastric mucosal hypertrophy=bVj; xyy karyotype=bvJ; coloboma of iris=bVK; epileptic encephalyopathy, early infantile, 7=bVk; cardiac valvular dysplasia, x-linked=bvk; neutrophyilic dermatosis=bvK; mast cell malignancy=bvL; seizures, benign familial neonatal, 1=bVl; myoclonic absence epilepsy=bVL; heterotopia, periventricular, ehlers-danlos variant=bvl; cerebellar cortical dysplasia=bVM; chronic myeloid leukemia in lymphoid blast crisis=bvM; epilepsy, benign neonatal, 1=bVm; melnick-needles syndrome=bvm; granular ependymitis=bVN; terminal osseous dysplasia and pigmentary defects=bvn; benign neonatal seizures=bVn; breast sarcoma=bvN; emberger syndrome=bvO; epileptic encephalyopathy, early infantile, 14=bVo; fg syndrome 2=bvo; goldberg-shprintzen megacolon syndrome=bVO; congenital idiopathyic intestinal pseudoobstruction=bvp; epilepsy, nocturnal frontal lobe, 5=bVp; mental retardation, x-linked 98=bVP; lymphatic abnormalities=bvP; autosomal dominant microcephaly=bVQ; edema of lower extremity=bvQ; otopalateodigital spectrum disorder=bvq; retinal cone dystrophy 3b=bVq; scalp ear nipple syndrome=bVr; lymphedema, microcephaly and chorioretinopathy syndrome=bVR; cluster b personality disorder=bvr; posterior column ataxia with retinitis pigmentosa=bvR; leukemia, feline=bvS; familial mitral valve prolapse=bvs; sen syndrome=bVs; jaw-winking syndrome=bVS; fowler syndrome=bvT; mental retardation, autosomal dominant 9=bVT; epilepsy, progressive myoclonic 3=bVt; atelosteogenesis, type 1=bvt; pricklel-related progressive myoclonus epilepsy with ataxia=bVu; spastic paraplegia 30, autosomal recessive=bVU; posterior column ataxia=bvU; masp2 deficiency=bvu; neuropathy, hereditary sensory, type iic=bVV; rest pain=bvV; mental retardation, x-linked, syndromeic, jaridlc-related=bVv; atelosteogenesis, type iii=bvv; spondylocarpotarsal synostosis=bvw; ataxia, spastic, 2, autosomal recessive=bVW; kabuki syndrome 2=bVw; atrophyic gastriti=bvW; bare lymphocyte syndrome, type i=bvx; fibrosis of extraocular muscles, congenital, 1=bVX; vohwinkel syndrome, variant form=bVx; encephalyoclastic proliferative vasculopathy=bvX; larsen syndrome, dominant type=bvy; nonsyndromeic cleft lip with or without cleft palate=bvY; fibrosis of extraocular muscles, congenital, 3b=bVY; lathyrism=bVy; spondyloepimetaphyseal dysplasia with multiple dislocations=bVZ; radioulnar synostosi=bvZ; appendix cancer=bVz; spinal curvatures=bvz; wiskott-aldrich syndrome=BW; aortic aneurysm=bW; pancreatic cancer=bw; baraitser-winter syndrome 2=Bw; primary ovarian insufficiency, fragile x-associated=bwa; anemia, congenital dyserythropoietic, type iv=bWA; lymphedema distichiasis syndrome=bwA; spondyloepimetaphyseal dysplasia with joint laxity=bWa; lymphedema-distichiasis syndrome with renal disease and diabetes mellitus=bwB; macroorchidism=bwb; cortical dysplasia, complex, with other brain malformations 3=bWb; in(lu) phenotype=bWB; premature ovarian failure 1=bwc; disorder of small intestine=bWc; yellow nail syndrome=bwC; spermatogenic failure 11=bWC; pure hereditary spastic paraplegia=bWd; pseudohypoaldosteronis=bWD; hypothyroidism, congenital, nongoitrous, 2=bwD; learning disabled=bwd; developmental symptoms=bwe; pseudohypoaldosteronism, type iid=bWE; hypothyroidism, thyroidal, with spiky hair and cleft palate=bwE; cortical dysplasia, complex with other brain malformations 2=bWe; thyroid agenisi=bwF; hydrolethalus syndrome 2=bWf; avoidant personality disorder=bwf; nemaline myopathy 8=bWF; hereditary myopathy with early respiratory failure=bwg; foxg1 syndrome=bwG; joubert syndrome 12=bWg; nemaline myopathy 9=bWG; mental retardation, autosomal dominant 4=bWh; acrocallosal syndrome=bwH; glomerulopathy with fibronectin deposits=bwh; retinitis pigmentosa 42=bWH; peritoneal adhesion=bwi; kallikrein, decreased urinary activity of=bWI; hypogonadotropic hypogonadism 13 with or without anosmia=bWi; tetralogy of fallo=bwI; hypogonadotropic hypogonadism 8 with or without anosmia=bWj; hearing loss, unilateral=bwJ; vasodilation=bWJ; adhesion of lung=bwj; precocious puberty, central, 1=bWk; lymphedem=bwK; prostatic nodule=bWK; native valve endocarditis=bwk; neoplasm seeding=bWl; graft versus host disease in skin=bwl; epidermaodysplasia verruciformi=bwL; vascular hemostatic disease=bWL; slow transit constipation=bWm; amelogenesis imperfecta pigmented hypomaturation type=bWM; premature ovarian failure 3=bwM; submandibular gland disease=bwm; blepharophimosis syndrome type 1=bwN; familial mastocytosis=bWn; pseudoscarlatina=bWN; secretory meningioma=bwn; gammopathy=bWo; cowden-like syndrome=bWO; bpes with duane retraction syndrome=bwO; granular corneal dystrophy type ii=bwo; bpes, type ii=bwP; complete obstruction=bwp; cowden syndrome 4=bWP; histiocytic neoplasm (morphology)=bWp; retroperitoneal mass=bWg; folate malabsorption, hereditary=bwq; postnatal infection=bWQ; bpes, type i=bwQ; adult acute myeloid leukemia with inv(16) (p13=bWr; ovarian gynandroblastoma=bwR; neurodegeneration due to cerebral folate transport deficiency=bwr; growth deficiency and mental retardation with facial dysmorphism=bWR; q22)=bWs; brain diseases, metabolic, inborn=bws; chromosome 6, monosomy 6q=bWS; blepharophimosis, ptosis, and epicanthus inversus syndrome=bwS; breast malignant phyllodes tumor=bWt; sacculation=bwT; myelomaeningocele=bwt; acquired angioedema=bWT; xenophobia=bwu; mediastinal cancer=bWu; kininogen deficiency, total=bWU; compensated liver disease=bwU; benign bone neoplasm=bwv; indolent systemic mastocytosis=bWv; t-cell immunodeficiency, congenital alopecia and nail dystrophy=bwV; acute edema=bWV; mental retardation, autosomal recessive 41=bWW; alopecia universalis=bwW; cycloid psychosis=bww; aggressive systemic mastocytosis=bWw; congenital alopecia x-linked=bwX; noonan syndrome 3=bWX; iridogoniodysgenesis type1=bwx; skin/hair/eye pigmentation, variation in, 7=bWx; irritable bowel syndrome with diarrhea=bWy; cardiofaciocutaneous syndrome 2=bWY; iris hypoplasia and glaucoma=bwy; t-cell immunodeficiency, recurrent infections, and autoimmunity with or without cardiac malformations=bwY; maturity-onset diabetes of the young, type 7=bWz; endometriosis, susceptibility to, 1=bWZ; axenfeld-rieger anomaly with partially absent eye muscles, distinctive face, hydrocephaly, and skeletal abnormalities=bwz; spindle cell rhabdomyosarcoma=bwZ; nonsyndromeic deafness=Bx; neoplasms, second primary=BX; gastritis=bx; periodontal disease=bX; lung cancer susceptibility 3=bXa; autoimmune inflammation of skeletal muscle=bxa; congenital fibrosis of the extraocular muscles=bxA; autosomal dominant epidermaolysis bullosa simplex=bXA; scarring alopecia=bXB; monosomy 7 of bone marrow=bXb; influenza-like illness=bxB; immuno-dysregulation, polyendocrinopathy, and enteropathy, x-linked=bxb; mental retardation with language impairment and autistic features=bxc; pseudotumor=bXc; follicular keratosis=bXC; multiple endocrine neoplasmia type 2=bxC; leuknkeratosis, oral=bXD; perisylvian syndrome=bxd; hypothyroidism, goitrous=bxD; sessile polyp=bXd; anorectal adenocarcinoma=bXe; retinitis pigmentosa 30=bxE; cirrhosis, familial=bXE; verbal apraxia=bxe; testicular lymphoma=bXf; ehrlichiosis=bxF; pancreatic carcinoma stage i=bXF; emotional abuse=bxf; communication disorders, developmental=bxg; maxillary sinus squamous cell carcinoma=bxG; bile duct adenoma=bXG; paranasal sinus neoplasm=bXg; lateral medullary syndrome=bxH; interleukin 2 receptor, alpha, deficiency of=bxh; appendix adenocarcinoma=bXh; thyroid hurthle cell adenoma=bXH; ichthyosis and male hypogonadism=bxi; epidermaolysis bullosa simplex with mottled pigmentation=bXI; hyperkeratotic cutaneous capillary-venous malformations associated with cerebral capillary malformations=bXi; resistant ovary syndrome=bxI; severe hypothyroidism=bxJ; immune dysregulation, polyendocrinopathy, enteropathy, x-linked syndrome=bxj; ichthyosis hystrix, curth macklin type=bXJ; cavernous malformations of cns and retina=bXj; mullerian aplasia=bxK; familial cerebral cavernous malformation=bXk; transplant glomerulopathy=bxk; keratosis palmoplantaris striata 3=bXK; hyperreactio luteinalis=bxL; capillary-venous malformation=bXl; epidermaolytic hyperkeratosis, late-onset=bXL; granulomatous hepatitis=bxl; ichthyosis hystrix=bXM; ovarian mucinous cystadenocarcinoma=bxM; cutaneous vascular malformation=bXm; cystoid macular edema=bxm; lump on thigh=bXN; secondary progressive multiple sclerosis=bxn; cavernous hemangioma=bXn; tight skin contracture syndrome, lethal=bxN; mitochondrial complex i deficiency=bxo; chromosome 12, trisomy 12q=bXO; systemic onset juvenile chronic arthritis=bxO; ichthyosis, cyclic, with epidermaolytic hyperkeratosis=bXo; refractory follicular lymphoma=bXP; congenital reticular ichthyosisform erythroderma=bXp; glutamate formiminotransferase deficiency=bxP; leigh syndrome due to mitochondrial complex i deficiency=bxp; urine looks dark=bXQ; erythrokeratoderma, reticular=bXq; macrostomia=bxq; iron overload, autosomal dominant=bxQ; infection in the elderly=bXR; l-ferritin deficiency=bxR; anorectal anomaly=bxr; peniale warts=bXr; corneal dystrophy, epithelial basement membrane=bXs; peripheral ulcerative keratitis=bXS; congenital diverticulum of pharynx=bxs; growth retardation, developmental delay, coarse facies, and early death=bxS; marles greenberg persaud syndrome=bxt; hyperandrogenemia=bxT; epidermaolysis bullosa simplex with migratory circinate erythema=bXT; meesmann corneal dystrophy=bXt; pachyonychia congenita 3=bXU; mental retardation, x-linked 9=bxU; hereditary mucosal leuknkeratosis=bXu; bifid nose with or without anorectal and renal anomalies=bxu; trigonocephaly 2=bxv; fucosidosis=bxV; epidermaolysis bullosa simplex, dowling-meara type=bXv; pachyonychia congenita 4=bXV; dermatopathyia pigmentosa reticularis=bXw; palmoplantar keratoderma, nonepidermaolytic, focal or diffuse=bXW; frontotemporal lobar degeneration with tdp43 inclusions, grn-related=bxW; chromosome 9p deletion syndrome=bxw; proctoptosis=bxx; woolly hair, autosomal dominant=bXX; amyotrophyic lateral sclerosis 6, autosomal recessive=bxX; naegeli syndrome=bXx; facioscapulohumeral muscular dystrophy 1a=bxy; epidermaolysis bullosa simplex autosomal recessive 1=bXy; tremor, hereditary essential, 4=bxY; hypotrichosis 3=bXY; nystagmus 1, congenital, x-linked=bxz; epidermaolysis bullosa simplex herpetiformis=bXz; ectodermal dysplasia 7, hair/nail type=bXZ; amyotrophyic lateral sclerosis 6, with or without frontotemporal dementia=bxZ; in situ carcinoma=BY; stomach carcinoma=by; immune reconstitution inflammatory syndrome=By; autoimmune hepatitis=bY; chronic nonspherocytic hemolytic anemia=byA; pseudofolliculitis barbae=bYa; amyotrophyic lateral sclerosis, type 6=bya; infantile liver failure syndrome 1=bYA; chromophobe tumor=bYb; thalassemia trait=byB; vitamin b12 plasma level quantitative trait locus 1=byb; reynold's syndrome=bYB; Caliciviridae infections=byc; hem dysplasia=bYC; drug-induced hemolytic anemia=byC; mild depression=bYc; hair dystrophy=bYd; norwalk virus infection, resistance to=byd; congenital color blindness=byD; pelger-huet anomaly=bYD; hepatitis cryptogenic=bYe; 6-phosphogluconolactonase deficiency=byE; staphyloenterotoxemia=bye; sacral agenisi=bYE; leukocyte-adhesion deficiency syndrome=byf; sclerocornea=bYF; palmoplantar keratoderma, epidermaolytic, with knuckle pads=bYf; uridine monophosphate hydrolase deficiency=byF; fucosyltransferase 6 deficiency=byg; amaurosis congenita of leber, type 5=bYG; hereditary palmoplantar keratoderma=bYg; hereditary anemia=byG; hydroxykynureninuria=bYh; neural tube defects x-linked=byh; hdl deficiency, type 2=bYH; red blood cell disorder=byH; interventricular cardiac septal hypertrophy=byi; red-green color blindness=byI; corpus callosum, partial agenisi of, x-linked=bYi; chronic heart disease=bYI; gilbert syndrome=byJ; gait disorders, neurologic=bYj; magnesium deficiency=byj; lactase deficiency, congenital=bYJ; milk allergic reaction=bYK; congenital nonspherocytic hemolytic anemia=byK; hydrocephalyus, x-linked, with congenital idiopathyic intestinal pseudoobstruction=bYk; peripheral epithelioid sarcoma=byk; phagocyte bactericidal dysfunction=byL; central epithelioid sarcoma=byl; agueductal stenosis=bYl; myopathy, myofibrillar, zasp-related=bYL; cardiomyopathy, dilated, with left ventricular noncompaction=bYM; rhombencephalyosynapsis=bYm; cataract, autosomal recessive congenital 2=bym; neurofibrosarcoma=byM; lactate dehydrogenase deficiency type a=bYN; l-2-hydroxyglutaric aciduria=bYn; glycogen storage disease type ii, infantile=byN; familial exudative vitreoretinopathy=byn; nail disorder, nonsyndromeic congenital, 9=byo; fatty liver disease, nonalcoholic, susceptibility to, 1=bYO; pustulosis of palm and sole=byO; blepharitis=bYo; muscular dystrophy, congenital, due to partial lama2 deficiency=bYp; *Staphylococcus aureus* pneumonia=byP; secondary hypercholesterolemia=bYP; exudative vitreoretinopathy 1=byp; nail disorder, nonsyndromeic congenital, IO=byq; osteoporosis in children=bYQ; cholestatic hepatitis=byQ; laryngo onycho cutaneous syndrome=bYq; epilepsy, juvenile myoclonic, susceptibility to, 5=byR; cardiomyopathy, dilated, 1jj=bYr; nail disease=byr; lipoprotein disorder=bYR; retrosternal pain=bYS; epileptic encephalyopathy, early infantile, 19=byS; neutropenia, severe congenital, autosomal recessive 4=bys; lissencephaly 5=bYs; epilepsy, childhood absence, susceptibility to, 4=byT; neutropenia, severe congenital, x-linked=byt; tongue disease=bYT; nephrotic syndrome, type 5, with or without ocular abnormalities=bYt; pinguecula=bYU; cortical malformations, occipital=bYu; dursun syndrome=byu; essential tremo=byU; alcohol effect=byV; streptozotocin diabetes=byv; sebaceous gland neoplasm=bYV; immunodeficiency due to defect in mapbp-interacting protein=bYv; muscular dystrophy-dystroglycanopathy (congenital with brain and eye anomalies), type a, 6=bYw; glycogen storage disease iii=byw; melorheostosis, isolated=bYW; conduct disorder, childhood-onset type=byW; muscular dystrophy, congenital, type 1d=bYx; mixed sclerosisng bone dystrophy=bYX; glycogen storage disease viii=byx; thyroid crisis=byX; congenital leptin deficiency=bYY; epilepsy, childhood absence, susceptibility to, 5=byY; alazami syndrome=bYy; anemia, nonspherocytic hemolytic, due to g6pd deficiency=byy; secondary peritonitis=bYZ; hemolysis=byz; perrault syndrome 4=bYz; generalized epilepsy with febrile seizures plus, type 1=byZ; childhood leukemia=Bz; paget's disease of bone=bZ; familial glucocorticoid deficiency 1=bz; acute lung injury=BZ; spondylocostal dysostosis 3, autosomal recessive=bZa; generalized epilepsy with febrile seizures plus, type 3=bza; watery diarrhea=bzA; woolly hair, autosomal recessive=bZA; epilepsy, childhood absence, susceptibility to, 2=bzb; pituitary microadenoma=bZb; pernicious anemia=bzB; woolly hair, congenital=bZB; jervell-lange nielsen syndrome=bzC; febrile convulsions, familial, 8=bzc; woolly hair, autosomal recessive 2, with or without hypotrichosis=bZC; temporal epilepsy, familial=bZc; hypotrichosi=bZD; thrombocytopenia, platelet dysfunction, hemolysis, and imbalanced globin synthesis=bzD; lateral temporal epilepsy=bZd; cerebral palsy, spastic quadriplegiac, 1=bzd; diabetes in children=bze; aphasic=bZe; hyperlipoproteinemia type i=bZE; thrombocytopenia, x-linked, with or without dyserythropoietic anemia=bzE; receptive aphasia=bZf; thyrotoxicosis=bzf; charcot-marie-tooth disease, type 1c=bZF; dyserythropoietic anemia with thrombocytopenia=bzF; acquired neuromyotonia=bZg; acheiropodia=bZG; anemia, x-linked, without thrombocytopenia=bzG; globoid cell leukodystrophy, early onset=bzg; esophagus small cell carcinoma=bZh; leukemia in children=bzH; globoid cell leukodystrophy, late-onset=bzh; polydactyly, preaxial ii=bZH; nerve lesion=bzi; leydig cell hypoplasia=bZi; absence of tibia with polydactyly=bZI; dyserythropoietic anemia=bzI; absent finger=bZJ; luteinizing hormone, beta polypeptide=bZj; fetal malnutrition without mention of light or small for gestational age=bzj; anemia due to decreased red cell production=bzJ; mononeuropathy=bzk; methylmalonic aciduria and homocystinuria, cblf type=bZK; leydig cell agenisi=bZk; immunodeficiency 21=bzK; testotoxicosis=bZI; lung diseases, fungal=bzL; udpglucose-4-epimerase deficiency=bzl; lipase deficiency combined=bZL; leydig cell hypoplasia, type ii=bZm; petit mal status=bzM; muscular dystrophy, congenital, Imna-related=bZM; galactokinase deficiency=bzm; empty follicle syndrome=bZn; atrial septal defect 2=bzN; galactosemi=bzn; charcot-marie-tooth disease, type 2b1=bZN; ventricular septal defect 1=bzO; deficiency of beta-galactosidase=bzo; heart-hand syndrome, Slovenian type=bZO; deafness, autosomal recessive 67=bZo; deficiency of sulfatase=bzp; winkelman bethge pfeiffer syndrome=bZp; atrioventricular septal defect 4=bzP; malouf syndrome=bZP; cushingoid=bZQ; streptococcal toxic shock syndrome=bzq; testicular anomalies with or without congenital heart disease=bzQ; pituitary hormone deficiency, combined, 4=bZq; double inlet left ventricle=bzR; pyruvate dehydrogenase lipoic acid synthetase deficiency=bZr; autosomal recessive emery-dreifuss muscular dystrophy=bZR; colorectal cancer, susceptibility to, 1=bzr; testicular microlithiasis=bzs; hepatocellular carcinoma=bzS; static encephalyopathy=bZs; disorder of aging=bZS; bent bone dysplasia group=bZt; pancreatic hypoplasia, congenital, with diabetes mellitus and congenital heart disease=bzT; generalized obesity=bZT; guanidinoacetate methyltransferase deficiency=bzt; dropped head syndrome=bZU; pyloric stenosis, infantile hypertrophyic 1=bzu; severe combined immunodeficiency with microcephaly, growth retardation, and sensitivity to ionizing radiation=bZu; atrioventricular septal defect 5=bzU; dubowitz syndrome=bZv; leukodystrophy, demyelinating, adult-onset, autosomal dominant=bZV; atrial septal defect 9=bzV; isolated aortic stenosis=bzv; adult onset autosomal dominant leukodystrophy=bZW; hypertrophy of bladder=bzW; cataract 19=bZw; intraductal papillary-mucinous adenoma=bzw; uncomplicated alcohol withdrawal=bZX; mental retardation, autosomal recessive 27=bZx; barrett epithelium=bzX; sticky platelet syndrome=bzx; undifferentiated attention deficit disorder=bZY; lysosomal acid lipase deficiency=bZy; anemia acute=bzy; cardiomyopathy, dilated, 2b=bzY; mental retardation, autosomal dominant 18=bzZ; mental disorders diagnosed in childhood=bZZ; high density lipoprotein cholesterol level quantitative trait locus 12=bZz; multiple endocrine neoplasmia [men] syndrome, unspecified=bzz; hepatitis a=C; duchenne muscular dystrophy=c; cowden disease=ca; endogenous depression=cA; granulosa cell tumor=Ca; telangiectasis=CA; nail disorder, nonsyndromeic congenital, 4=cAA; osteopetrosis autosomal dominant type 1=caA; salcedo syndrome=caa; retinitis pigmentosa 2=cAa; acute alcohol withdrawal=cab; chromosome xp11.3 deletion syndrome=cAb; dyskeratosis congenita, autosomal recessive, 5=cAB; exudative vitreoretinopathy 4=caB; retinitis pigmentosa 9=cAc; viral leukemogenesis=cac; spastic paraplegia 12, autosomal dominant=cAC; van buchem disease type 2=caC; polymicrogyria with seizures=cAD; deafness, autosomal recessive 77=cad; retinitis pigmentosa, x-linked, and sinorespiratory infections, with or without deafness=cAd; bone mineral density quantitative trait locus 1=caD; platelet disorder, familial, with associated myeloid malignancy=cAE; ehlers-danlos syndrome type 5=cae; cone-rod dystrophy, x-linked, type 1=cAe; high bone mass=caE; groenouw's dystrophyies=caf; coronary artery disease, autosomal dominant 2=caF; stomatognathic system abnormalities=cAF; macular degeneration, x-linked atrophyic=cAf; cone-rod dystrophy 13=cAg; secondary glaucoma=cag; neural tube defect, folate-sensitive=caG; metaphyseal dysplasia with maxillary hypoplasia and brachydactyly=cAG; Ip(a) deficiency, congenital=cah; myopia 23, autosomal recessive=caH; cleidocranial dysplasia, forme fruste, with brachydactyly=cAH; leber congenital amaurosis 6=cAh; hypotrichosis, localized, autosomal recessive, 3=cai; recurrent abdominal pain=caI; lack of bone formation=cAI; meckel syndrome, type 5=cAi; testicular yolk sac tumor=cAJ; joubert syndrome 7=cAj; leigh syndrome, french Canadian type=caJ; woolly hair, autosomal recessive 1, with or without hypotrichosis=caj; malignant hyperthermia susceptibility type 1=cAK; ciliary dyskinesia, primary, 19=caK; ribose 5-phosphate isomerase deficiency=cAk; myoglobinuria, acute recurrent, autosomal recessive=cak; sapho syndrome=cal; king denborough syndrome=cAL; agammaglobulinemia 5, autosomal dominant=caL; autism, susceptibility to, x-linked 5=cAl; diamond-blackfan anemia 12=cAm; type i hyperlipidaemia=cam; parkinson disease 8, autosomal dominant=caM; neuromuscular disease, congenital, with uniform type 1 fiber=cAM; ectopic liver=can; fetal akinesia=cAN; genital herpe=cAn; idiopathyic disease=caN; familial lipoprotein deficiency=cao; ventricular tachycardia, catecholaminergic polymorphic, 2=cAO; brucellosi=cAo; charcot-marie-tooth disease, axonal, type 2p=caO; deafness, autosomal recessive 63=caP; diamond-blackfan anemia 9=cAp; arrhythmogenic right ventricular dysplasia, familial, 2=cAP; secondary hypertriglyceridemia=cap; anemia, diamond-blackfan, 3=cAq; microcephalyic osteodysplastic primordial dwarfism, type 1=caQ; caffeine dependencye=cAQ; jacobs syndrome=caq; leber congenital amaurosis 14=car; mental retardation, x-linked 19=cAr; effort syncope=cAR; fish diseases=caR; retinitis punctata albescens (disorder)=cas; infection with *Mycobacterium marinum*=caS; arrhythmogenic right ventricular dysplasia, familial, =cAs; bidirectional tachycardia=cAS; mitochondrial dna depletion syndrome 8a (encephalyomyopathyic type with renal tubulopathy)=caT; oedema auricular=caT; retinal dystrophy, early-onset severe, lrat-related=cat; thoracic aorta dilation=cAT; meibomian gland dysfunction=cAU; immunodeficiency, common variable, 8, with autoimmunity=cau; leprosy, early-onset, susceptibility to=caU; progressive external ophthalmoplegia with mitochondrial dna deletions, autosomal dominant, 5=cAu; parachordoma=cAV; wounds, nonpenetrating=caV; night blindness, congenital stationary, type 1f=cav; mitochondrial dna depletion syndrome 8b (mngie type)=cAv; malignant tumor of optic nerve=caw; primary retinal cyst=cAw; retinitis pigmentosa 47=cAW; tetraplegias cerebral palsy=caW; ciliary dyskinesia, primary, 24=cAx; omphalocele, autosomal=cax; byssinosis=caX; townes-brocks-branchiootorenal-like syndrome=cAX; glaucoma 3, primary congenital, d=caY; duane-radial ray syndrome=cAY; ciliary dyskinesia, primary, 11=cAy; donnai-barrow syndrome=cay; oculootoradial syndrome=cAZ; weill-marchesani syndrome 3=caZ; ciliary dyskinesia, primary, 12=cAz; worth syndrome=caz; angiodysplasia=CB; axonal neuropathy=cb; thalamic neoplasm=Cb; retinoblastoma=cB; tumoral calcinosis, normophosphatemiac, familial=cBa; heart failure with reduced ejection fraction=cba; atrial fibrillation, familial, 13=cBA; mental retardation, autosomal recessive 15=cbA; alpha-mannosidosis=cbB; cardiac conduction defect, nonspecific=cBB; tenth agenisi, selective, 6=ebb; aicardi-goutieres syndrome 5=cBb; epileptic encephalyopathy, early infantile, 11=cBC; chilblain lupus 2=cBc; cutis laxa with severe pulmonary, gastrointestinal, and urinary abnormalities=cbc; lysosomal beta-mannosidase deficiency=cbC; seizures, benign familial infantile, 3=cBD; beta-mannosidosis=cbD; sarcosinemia=cBd; pulmonary disease, chronic obstructive, severe early-onset=cbd; hyperuricemia, pulmonary hypertension, renal failure, and alkalosis=cBe; aspirin sensitivity=cbe; brunner syndrome=cbE; epilepsy, benign neonatal, 3=cBE; cleft palate, isolated, and mental retardation=cBf; unspecified circulatory system disorder=cbf; antisocial behavior following childhood maltreatment, susceptibility to=cbF; late onset epilepsy=cBF; chromosome 2q32-q33 deletion syndrome=cBg; adult antisocial behavior=cbG; febrile seizures associated with afebrile seizures=cBG; gestational diabete=cbg; atrial fibrillation, familial, 14=cBH; cleft palate, isolated=cBh; combined oxidative phosphorylation deficiency 19=cbh; rituals=cbH; epilepsy in children=cBI; atypical depressive disorder=cbI; chronic abdominal pain=cbi; corpus callosum, agenisi of, with facial anomalies and robin sequence=cBi; brugada syndrome 7=cBJ; charcot-marie-tooth disease, type 4b3=cBj; hypothyroidis=cbJ; schwannomatosis 2=cbj; neuropil threads=cbK; charcot-marie-tooth neuropathy, type 4b2, with early-onset glaucoma=cBk; hypokalemic periodic paralysis, type 2=cBK; charcot-marie-tooth disease, type 2a=cbk; cardio-faciocutaneous syndrome 3=cbL; myasthenic syndrome, congenital, acetazolamide-responsive=cBL; high density lipoprotein cholesterol level quantitative trait locus 6=cBl; adhesion of intestine=cbl; normokalemic periodic paralysis, potassium-sensitive=cBM; cardiofaciocutaneous syndrome 4=cbM; marden walker like syndrome=cBm; osteolysis, hereditary, of carpal bones with or without nephropathy=cbm; long qt syndrome 10=cBN; 46,xy sex reversal 6=cbN; cataract, pulverulent, juvenile-onset=cbn; polyposis syndrome, hereditary mixed, 1=cBn; long qt syndrome 3=cBO; cat allergy=cBo; dermatophilosis due to dermatophilus congolensis=cbO; appendiciti=cbo; epileptic encephalyopathy, lennox-gastaut type=cbP; episodic pain syndrome, familial, 2=cBp; sick sinus syndrome 1, autosomal recessive=cBP; prader-willi-like syndrome=cbp; central nervous system demyelination=cbq; cardiomyopathy, dilated, 1e=cBQ; neuropathy, hereditary sensory and autonomic, type vii=cBq; hepatoma, morris=cbQ; pulsus trigeminus=cbR; nerve compression syndrome=cbr; long qt syndrome type 3=cBR; episodic pain syndrome, familial, 3=cBr; mental retardation, x-linked 95=cbs; ventricular fibrillation, paroxysmal familial, 1=cBS; migraine, familial hemiplegiac, 3=cBs; urethral obstruction=cbS; febrile convulsions, familial, 3a=cBt; atrial fibrillation, familial, 10=cBT; precapillary pulmonary hypertension=cbT; immunodeficiency, x-linked, with magnesium defect, epstein-barr virus infection, and neoplasmia=cbt; heart block, nonprogressive=cBU; myoclonic astatic epilepsy=cBu; familial encephalyopathy with neuroserpin inclusion bodies=cbU; retinitis pigmentosa 62=cbu; immunodeficiency 12=cbv; benign occipital epilepsy of childhood—early onset variant=cBv; progressive supranuclear palsy atypical=cbV; cardiac conduction defect, nonprogressive=cBV; supranuclear paralysis=cbW; thymus mucoepidermaoid carcinoma=cbw; poor short-term memory=cBw; long qt syndrome 3, acquired, susceptibility to (finding)=cBW; hemispatial neglect=cbX; lenegre's disease=cBX; grand mal status epilepticus=cBx; thymus adenosquamous carcinoma=cbx symptomatic generalized epilepsy=cBy; gaze palsy=cbY; sudden unexpected nocturnal death syndrome=cBY; hypospadias 2, x-linked=cby; brugada syndrome 5=cBz; scrotal hypospadias=cbz; progressive subcortical gliosis=cbZ; familial sick sinus syndrome=cBZ; aminoacylase 1 deficiency=CC; myositis ossificans=Cc; scoliosis=cC; muscular atrophy=cc; cranio-lenticulosutural dysplasia=cCA; chromosome 18q syndrome=ccA; bradyarrythmia=cCa; familial progressive supranuclear palsy=cca; pneumocystosi=cCB; vacuolar myelopathy=ccB; sick sinus=cCb; ataxia, spastic, 3, autosomal recessive=ccb; infantile liver failure syndrome 2=ccc; hemorrhagic fever, american=ccC; neurally-mediated syncope=cCc; thyroid hormone metabolism, abnormal=cCC; epileptic encephalopathy, early infantile, 13=cCd; diabetic maculopathy=cCD; deafness, autosomal recessive 49=ccd; olmsted syndrome=ccD; cognitive impairment with or without cerebellar ataxia=cCe; epiphyseal dysplasia, multiple, 5=cce; shwartzman phenomenon=cCE; ichthyosis follicularis atrichia photophobia syndrome=ccE; burns, electric=cCF; palmoplantar keratoderma, mutilating, with periorificial keratotic plagues, x-linked=ccF; spondyloepimetaphyseal dysplasia, matrilin-3 related=ccf; indifference to pain, congenital, autosomal recessive=cCf; amyotrophyic lateral sclerosis 2I=ccg; erythermalgia, primary=cCg; hypogonadotropic hypogonadism 16 with or without anosmia=cCG; ifap syndrome with or without bresheck syndrome=ccG; generalized epilepsy with febrile seizures plus, 7=cCh; myopathy, distal 2=cch; ichthyosis follicularis with alopecia and photophobia (ifap) =ccH; brachial plexus lesion=cCH; infection due to vancomycin intermediate *Staphylococcus aureus*=cci; brain anomalies, retardation, ectodermal dysplasia, skeletal malformations, hirschsprung disease, ear/eye anomalies, cleft pa . . . =ccl; febrile seizures, familial, 3b=cCi; brachial plexus lesio=cCl; keloidalis nuchae=ccJ; retinitis pigmentosa 35=cCJ; bronchiectasis with or without elevated sweat chloride 2=cCj; infection due to vancomycin resistant *Staphylococcus aureus*=ccj; infections, bunyavirus=cck; bronchiectasis with or without elevated sweat chloride 3=cCk; cone-rod dystrophy 10=cCK; folliculiti=ccK; melanoma, cutaneous malignant, susceptibility to, 5=ccL; immunoglobulin g3 deficiency=cCl; chronic cerebrovascular accident=cCL; vaginal yeast=ccl; type vi ehlers-danlos syndrome=cCM; mental retardation, autosomal dominant 1=ccm; melanoma, cutaneous malignant, susceptibility to, 1=ccM; infantile encephalyopathy and lactic acidosis=cCm; immunoglobulin g4 deficiency=cCn; crush syndrome=ccn; histiocytosis=cCN; increased analgesia from kappa-opioid receptor agonist, female-specific=ccN; blood group, john milton hagen system=cCO; atypical pneumonia=cco; uv-induced skin damage, susceptibility to=ccO; cardioencephalyomyopathy, fatal infantile, due to cytochrome c oxidase deficiency=cCo; dengue hemorrhagic feve=cCP; myopia 6=cCp; secondary immune deficiency=ccp; protein-losing enteropathy=ccP; pontocerebellar hypoplasia, type 2d=cCQ; tuberculosis in children=ccq; body mass index quantitative trait locus 9=ccQ; senior-loken syndrome 7=cCq; 3-methylglutaconic aciduria with deafness, encephalyopathy, and leigh-like syndrome=cCR; hidradenitis=ccR; bronchopulmonary disease=ccr; mitochondrial complex ii deficiency=cCr; thiamine deficiency=cCS; succinate-coenzyme g reductase deficiency=cCs; laryngitis=ccS; septicemia due to *Streptococcus pneumoniae*=ccs; panacinar emphysema=cCT; arthritis of hand=cct; 3-methylcrotonyl coa carboxylase 2 deficiency=ccT; paragangliomas 2=cCt; cranial arteritis=ccu; paragangliomas 5=cCu; propionic acidemi=ccU; autosomal hereditary disorder=cCU; postoperative myocardial infarction=ccv; cardiomyopathy, dilated, 1gg=cCv; chronic disease of respiratory system=cCV; methylmalonyl-coa epimerase deficiency=ccV; obstructive emphysema=cCW; indifference to pain=ccW; otitis media in children=ccw; leigh syndrome due to mitochondrial complex ii deficiency=cCw; neonatal pneumonia=ccx; paragangliomas 3=cCx; factor v and factor viii, combined deficiency of, 2=ccX; nodular nonsuppurative panniculitis=cCX; fungal pneumonia=ccy; pancreatoblastoma=cCY; cowden syndrome 3=cCy; natural killer cell deficiency, familial isolated=ccY; microcephaly, primary autosomal recessive, 1=ccZ; cholinergic urticaria=cCZ; paragangliomas with sensorineural hearing loss=cCz; chromosome 18, trisomy 18g=ccz; abdominal aortic aneurysm=cd; biotinidase deficiency=CD; atrioventricular septal defect=Cd; combined oxidative phosphorylation deficiency 8=cD; mucocutaneous ulcer=cda; transitional meningioma=cDA; coronary artery disease, autosomal dominant, 1=cdA; corticosteroid-binding globulin deficiency=cDa; accelerated turner formation, susceptibility to=cdb; mental retardation, autosomal dominant 20=cdB; pulmonary alveolar proteinosis, congenital=cDB; inherited thyroxine-binding globulin deficiency=cDb; thyroxine-binding globulin deficiency=cDc; retractile mesenteritis=cdc; familial mediterranean fever, autosomal dominant=cdC; surfactant metabolism dysfunction, pulmonary, 2=cDf; euthyroid sick syndrome=cDd; connective tissue cancer=cdd; combined oxidative phosphorylation deficiency 18=cDD; abdomen, acute=cdD; spindle cell lipoma=cde; deafness, autosomal recessive 91=cDe; muscular dystrophy, limb-girdle, type 2d=cDE; polyserosistis=cdE; recurrent fevers=cdF; limb-girdle muscular dystrophy, type 2e=cDF; palmoplantar keratoderma, nagashima type=cDf; malignant fibrous histiocytoma of bone=cdf; limb-girdle muscular dystrophy type 2f=cDG; antithrombin iii deficiency, familial=cDg; adult medulloblastoma=cdg; acute suppurative arthritis=cdG; myopathy, areflexia, respiratory distress, and dysphagia, early-onset=cdH; anticoagulant disorders=cDh; cardiomyopathy, dilated, 11=cDH; unilateral retinoblastoma=cdh; carpenter syndrome 2=cdI; spindle cell liposarcoma=cdi; mucopolysaccharidosis, type iiia=cDl; heparin cofactor ii deficiency=cDi; lupus hepatitis=cDJ; pituitary macroadenoma=cdJ; mental retardation, x-linked, syndromeic 13=cdj; plasminogen activator inhibitor-1 deficiency=cDj; giant cell reparative granuloma=cDK; pancreatic gastrinoma=cdK; thrombosis of renal veins=cDk; autism, susceptibility to, x-linked 3=cdk; encephalyopathy, neonatal severe, due to mecp2 mutations=cdl; fibrinolytic defect=cDl; klippel feil syndrome recessive type=cdL; ter haar syndrome=cDL; hereditary protein s deficiency=cdM; borrone di recce crovato syndrome=cDM; rett syndrome, zappella variant=cdm; fibrous nodule=cDm; charcot-marie-tooth disease, type 4c=cDH; myocardial infarction (subendocardial)=cDn; induced ventricular tachycardia=cdn; eventration=cdN; symptomatic human immunodeficiency virus infection=cdO; osteogenesis imperfecta, type xii=cDo; mononeuropathy of the median nerve, mild=cDO; lubs syndrome=cdo; anti-plasmin deficiency, congenital=cDp; rett syndrome, preserved speech variant=cdp; pendular nystagmus=cdP; autism, susceptibility to, 17=cDP; severe expressive language delay=cDQ; alpha-2-antiplasmin deficiency=cDq; ppm-x syndrome=cdq; mosaicism, chromosomal=cdQ; lujan fryns syndrome=cdr; giardia infections=cdR; 22q deletion syndrome=cDR; familial hemorrhagic diathesis=cDr; ohdo syndrome, maat-kievit-brunner type=cds; cystic lymphangioma=cdS; holoprosencephaly 3=cDS; angioedema, hereditary, type i=cDs; complement component 4, partial deficiency of=cDt; microphthalmia, isolated, with coloboma 5=cDT; retinitis pigmentosa 38=cdT; inherited optic neuropathy=cdt; absence of tibia=cDU; dysostosi=cdU; legal blindness=cdu; hereditary angioedema type ii=cDu; osteogenesis imperfecta, type x=cDv; autism, susceptibility to, 9=cdV; deaf-blind disorders=cdv; epithelial ingrowth=cDV; ectopic gastric tissue=cDW; diffuse peritoneal leiomyomatosis=cdw; pancreatic insufficiency, combined exocrine=cDw; congenital naevus=cdW; noonan syndrome-like disorder with loose anagen hair=cDX; microcephaly, postnatal progressive, with seizures and brain atrophy=cdx mental retardation, autosomal dominant 23=cDx malignant fibroxanthom=cdX; emphysema or copd=cDy; mental retardation, autosomal recessive 18=cdy; noonan-like syndrome with loose anagen hair=cDY; melanotic neuroectodermal turner=cdY; nanophthalmos 2=cdZ; short stature, idiopathyic, x-linked=cDZ; charcot-marie-tooth disease, type 2b2=cdz; amyotrophyic lateral sclerosis 4, juvenile=cDz; severe combined immunodeficiency, autosomal recessive, t cell-negative, b cell-negative, nk cell-negative, due to adenosine d . . . =CE; lynch syndrome=Ce; mitochondrial respiratory chain deficiencies=cE; achalasia=ce; cataract, juvenile, with microcornea and glucosuria=cEA; stocco dos santos syndrome=cEa; microphthalmia, posterior, with retinitis pigmentosa, foveoschisis, and optic disc drusen=cea; variola major=ceA; autoimmune disease, susceptibility to, 6=cEb; renal glycosuri=cEB; optic disk drusen=ceb; bardet-biedl syndrome 13=ceB; erythrocyte lactate transporter defect=cEC; hyperopi=cec; sebaceous glands-tumors=ceC; copd exacerbation=cEc; amyotrophyic lateral sclerosis 16, juvenile=cEd; cecum carcinoma=ceD; ceroid lipofuscinosis, neuronal, 7=ced; hyperinsulinemiac hypoglycemia, familial, 7=cED; colorectal cancer, hereditary nonpolyposis, type 7=ceE; x-linked hypophosphatemiac ricket=cEE; congenital disorder of glycosylation type 2a=cee; disaccharidase deficiency=cEe; glycogen storage disease ic=cEF; warm autoimmune hemolytic anemia=cEf; allergic colitis=ceF; pleomorphic hyalinizing angiectatic turner=cef; mitochondrial dna depletion syndrome 11=ceg; acute myeloid leukemia, 11q23 abnormalities=ceG; binge drinking=cEg; uric acid concentration, serum, quantitative trait locus 4=cEG; infantile sialic acid storage disease=cEH; griscelli syndrome type 3=ceH; tendinitis=cEh; keutel syndrome=ceh; pellagra=cEi; singleton merten syndrome=cei; methylmalonic aciduria cbla type=cel; free sialic acid storage disease=cEl; adenosylcobalamin synthesis defect=ceJ; vitamin k deficiency coagulation disorder=cej; deafness, autosomal dominant 25=cEJ; branchiootic syndrome 3=cEj; disorder of vitamin b12=ceK; left ventricular noncompaction 7=cek; thiamine responsive megaloblastic anemia syndrome=cEK; deafness, autosomal dominant 23=cEk; branchiootorenal syndrome 2=cEl; refractory periodontitis=ceL; thiamine-responsive megaloblastic anemia=cEL; endocervical adenocarcinoma in situ=cel; methylmalonic aciduria and homocystinuria, cbld type=ceM; basal ganglia disease, biotin-responsive=cEM; atypical cartilaginous turner=cem; microphthalmia, isolated, with cataract 2=cEm; homocystinuria, cbld type, variant 1=ceN; dicarboxylicaminoaciduria=cEN; conjunctiva squamous cell carcinoma=cen; acid base disorder=cEn; myopathy with extrapyramidal signs=cen; paraquat lung=cEo; methylmalonic aciduria, cbld type, variant 2=ceO; schizephrenia 18=cEO; trichohepatoenteric syndrome 2=cEp; progressing stroke=cEP; miyoshi muscular dystrophy 2=ceP; congenital cleft larynx and opitz-frias syndrome=cep; bile acid malabsorption, primary=cEq; legionellosis=ceq; malignant lymphoma—centrocytic=ceQ; episodic ataxia, type 6=cEQ; *Mycobacterium tuberculosis*, susceptibility to infection by=cEr; microcystic stromal turner=ceR; cataract 15, multiple types=cer; renal hypouricemia=cER; rhabdomyosarcoma 1=cES; buruli ulcer, susceptibility to=cEs; tietz syndrome=ces; spondyloepimetaphyseal dysplasia, missouri type=ceS; cutaneous leishmaniasis, ethiopian=cEt; melanoma, cutaneous malignant, susceptibility to, 8=cet; metaphyseal anadysplasia=ceT; inflammatory bowel disease 5=cET; recurrent malignant peripheral nerve sheath turner=ceU; systemic primary carnitine deficiency disease=cEU; albinism ocular late onset sensorineural deafness=ceu; anemia, hypochromic microcytic, with iron overload=cEu; winchester syndrome=ceV; anemia, hypochromic microcytic, with iron overload 1=cEv; night blindness, congenital stationary, type 1d=cEV; albinism, ocular, with sensorineural deafness=cev; bartter syndrome, antenatal type 1=cEw; skin/hair/eye pigmentation, variation in, 6=cEW; crest syndrome=cew; kaler garrity stern syndrome=ceW; bronchial neoplasm=ceX; bardet-biedl syndrome 6=cex; skin/hair/eye pigmentation, variation in, 4=cEX; concealed vomiting=cEx; superior limbic keratoconjunctivitis=ceY; hydrometrocolpos=cey; dystonias, sporadic=cEy; hypomyelination, global cerebral=cEY; decreased drug resistance=ceZ; precocious puberty, central, 2=cez; neonatal-onset citrullinemia type 2=cEZ; low t3 syndrome=cEz; severe combined immunodeficiency due to adenosine deaminase deficiency=CF; hypoglycemia=cf; infantile cardiomyopathy=cF; weissenbacher-zweymjler syndrome=Cf; fanconi renotubular syndrome 2=cFA; astrocytoma of brain=cfa; aminoacidemia=cFa; molybdenum cofactor deficiency, complementation group a=cfA; molybdenum cofactor deficiency, complementation group b=cfB; amish lethal microcephaly=cFb; potassium deficiency=cFB; conjunctivochalasis=cfb; thiamine metabolism dysfunction syndrome 4 (bilateral striatal degeneration and progressive polyneuropathy type)=cFc; amelogenesis imperfecta, hypomaturation type, iia2=cfc; microlithiasis=cFC; narcolepsy 7=cfC; osteolysis hereditary multicentric=cfd; hypophosphatemiac rickets with hypercalciuria, hereditary=cFD; mitochondrial phosphate carrier deficiency=cfd; congenital disorder of glycosylation, type iib=cfD; medullary nephrocalcinosis=cFE; mitochondrial pyruvate carrier deficiency=cfE; progressive external ophthalmoplegia with mitochondrial dna deletions, autosomal dominant, 2=cFe; acute ischemiac colitis=cfe; valvular disease=cff; congenital disorder of glycosylation type 1f=cfF; congenital disorder of glycosylation, type iif=cFF; mitochondrial dna depletion syndrome 12 (cardiomyopathyic type)=cFg; atelosteogenesis type 2=cFg; hydrocephalyus, nonsyndromeic, autosomal recessive 2=cfG; idiopathyic multicentric osteolysis=cfg; congenital disorder of glycosylation, type iim=cFG; arthrogryposis, mental retardation, and seizures=cFH; congenital disorder of glycosylation type 1b=cfH; mycetoma=cfh; epiphyseal dysplasia, multiple, 4=cFh; achondrogenesis type 1b=cFi; interdigitating dendritic cell sarcoma=cFl; recurrent pterygium=cfl; wrinkle=cfi; parotitis=cfj; de la chapelle dysplasia=cFj; iminoglycinuria=cFJ; deficiency of mannose-6-phosphate isomerase=cfJ; glycinuria with or without oxalate urolithiasis=cFK; spermatocele=cFk; impaired left ventricular function=cfK; clear cell meningioma=cfk; coronary heart disease, susceptibility to, 6=cfl; tick-borne relapsing feve=cFL; mirror hands=cfL; deafness, autosomal recessive 61=cFl; aortic root dilation=cfm; cystic fibrosis, modifier of, 1=cFm; foveal hypoplasia 2=cFM; mercaptolactate-cysteine disulfiduria=cfM; navajo neurohepatopathy=cfN; mucus cast=cFn; disorder of tendon=cfn; foveal hypoplasia and anterior segment dysgenesis=cFN; spnndylncheirndysplasia, ehlers-danlos syndrome-like=cFO; gastrointestinal ulcer=cfn; intestinal obstructio=cFo; cochlear disease=cfO; inherited aminoaciduria=cFP; ichthyosis prematurity syndrome=cFp; chareot-marie-tooth disease, type 2j=cfP; cerebral arterial disease=cfp; charcot-marie-tooth disease, dominant intermediate d=cfQ; chromosome 12p deletion=cFq; cystinuria, type a=cFQ; internal carotid artery stenosis=cfq; peripheral demyelinating neuropathy, central dysmyelination, waardenburg syndrome, and hirschsprung disease=cfR; dysosteosclerosis=cFr; ID metaphyseal anadysplasia 2=cfR; left ventricular hypoplasia=cFR; familial renal glucosuria=cFs; respirovirus infections=cfs; hereditary areflexic dystasisa=cfS; atrial enlargement=cFS; primary intraocular non-hodgkin malignant lymphoma=cFT; hypouricemia, renal, 2=cFt; tonic pupil=cfT; anterior subcapsular cataract=cft; west nile encephalyitis=cfu; hypermanganesemia with dystonia polycythemia and cirrhosis=cFu; hereditary stomatocytosis=cfO; oculocutaneous albinism, type iv=cFU; acrodermatitis=cFv; rhabdoid meningioma=cfv; skin/hair/eye pigmentation, variation in, 5=cFV; glucocorticoid deficiency 2=cfV; spastic paraplegia 42, autosomal dominant=cFw; corneal dystrophy, fuchs endothelial, 4=cFW; qualitative platelet disorder=cfw; combined oxidative phosphorylation deficiency 9=cfW; corneal endothelial dystrophy type 2=cFX; combined oxidative phosphorylation deficiency 16=cfX; congenital cataracts, hearing loss, and neurodegeneration=cFx familial meningioma=cfx nephrolithiasis-osteoporosis, hypophosphatemiac, 1=cFy; corneal endothelial dystrophy 1, autosomal dominant=cFY; anorectal anomalies=cfy; combined oxidative phosphorylation deficiency 2=cfY; autosomal recessive hypophosphatemiac bone disease=cFz; meningocele=cfz; congenital hereditary endothelial dystrophy=cFZ; combined oxidative phosphorylation deficiency 5=cfZ; epilepsy, idiopathyic generalized=CG; barth syndrome=cg; heterotaxy, visceral, 4, autosomal=Cg; charcot-marie-tooth disease=cG; methylenetetrahydrofolate reductase deficiency=cgA; corneal edema=cGa; physical illness=cGA; immunodeficiency, common variable, 5=cga; spherocytosis, type 4=cGb; blushing=cGB; sebaceous adenoma=cgb; thrombosis of retinal veins=cgB; renal tubular acidosis, distal, with hemolytic anemia=cGc; cerebral primitive neuroectodermal turner=cge; generalized social phobia=cGC; fetus affected by placental transfer of anticonvulsant=cgC; hemifacial spasm=cgD; colorectal cancer, hereditary nonpolyposis, type 5=cgd; bullying=cGD; blood group—wright antigen=cGd; prostate cancer, hereditary, 13=cge; performance anxiety=cGE; spinal injuries=cgE; renal tubular acidosis, distal, with normal red cell morphology=cGe; congenital cardiac malformations=cgF; blood group—waldner type=cGf; hyperekplexia 3=cGF; ck syndrome=cgf; he, stomatocytic=cGg; brain edem=cGG; hereditary prostate carcinoma=cgg; congenital anomaly of aortic arch=cgG; encephalyomalacia=cgH; blood group—froese=cGh; retinitis pigmentosa 68=cGH; deafness, autosomal recessive 74=cgh; immune deficiency disease=cGI; lateral sinus thrombosis=cgI; pseudohyperkalemia Cardiff=cGi; lipom=cgi; renal tubular acidosis, proximal, with ocular abnormalities and mental retardation=cGj; myostatin-related muscle hypertrophy=cgj; discrete subaortic stenosis=cgJ; chronic idiopathyic thrombocytopeniac purpura=cGJ; bilateral glaucoma=cGk; orofacial cleft 5=cgk; myelomeningocele=cgK; lysinuric protein intolerance=cGK; recombinant chromosome 8 syndrome=cGl; familial hypodontia=cgl; charcot-marie-tooth disease, type 4b1=cgL; cystinuria, type b=cGL; charcot-marie-tooth disease, type 4b2=cgM; nephrolithiasis-osteoporosis, hypophosphatemiac, 2=cGM; brown-vialetto-van laere syndrome=cGm; ostium secundum atrial septal defect=cgm; unilateral cleft lip=cgn; biliary carcinoma=cgN; brown-vialetto-van laere syndrome 2=cGn; congenital muscle disorder=cgN; tenth and nail syndrome=cgo; combined oxidative phosphorylation deficiency 10=cgO; episodic kinesigenic dyskinesia 2=cGO; progressive bulbar palsy of childhood=cGo; craniosynostosis, type 2=cgp; progressive bulbar palsy=cGp; spastic ataxia 4, autosomal recessive=cgP; mental retardation, x-linked, syndromeic, christianson type=cGP; christianson syndrome=cGQ; parietal foramina with cleidocranial dysplasia=cgg; homocystinuria-megaloblastic anemia due to defect in cobalamin metabolism, cble complementation type=cgQ; thyroid dyshormonogenesis 1=cGg; gangrenous pneumonia=cGR; parietal foramina 1=cgr; abdominal obesity metabolic syndrome=cgR; neuropathy, distal hereditary motor, type viia=cGr; body mass index quantitative trait locus 11=cGs; medullary cystic kidney disease type 1=cgS; cleidocranial dysplasia=cgs; abscess of breast=cGS; atopic keratoconjunctivitis=cgT; activated pi3k-delta syndrome=cgt; panic symptoms=cGt; healtyhcare associated pneumonia=cGT; ileoanal reservoir=cgU; lymphoblastic leukemia, acute, with lymphomatous features=cgu; arthralgia of temporomandibular joint=cGu; ischemiac foot=cGU; fibrosis of pleura=cgv; cestode infections=cgV; diabetic foot infection=cGV; adverse reaction to drug=cGv; otitis externa=cGW; loneliness in adolescence=cGw; combined oxidative phosphorylation deficiency 15=cgw; bile duct cystadenocarcinoma=cgW; neonatal diarrhea=cgx; intestinal nematode infection=cgX; depression in children=cGx; mediastiniti=cGX; ritualistic behavior (symptom)=cGy; methylcobalamin deficiency, cblg type=cgy; myasthenia gravis, generalized=cgY; autism, susceptibility to, 16=cGY; rotor syndrome=cGZ; negativism in catatonia=cGz; methylmalonic aciduria due to methylmalonyl-coa mutase deficiency=cgZ; homocystinuria due to deficiency of n(5,10)-methylenetetrahydrofolate reductase activity=cgz; sleep initiation and maintenance disorders=CH; motor neuritis=cH; beta thalassemia intermedia=Ch; diabetes mellitus, experimental=ch; small intestinal sarcoma=chA; anophthalmos with limb anomalies=cHA; methylmalonic aciduria, mut(-) type=cha; hypertrophyic osteoarthropathy, primary, autosomal recessive, 2=cHa; niemann-pick disease, intermediate, protracted neurovisceral=cHB; myopathy, myosin storage=chB; methylmalonic aciduria, mut(0) type=chb; deafness, cochlear, with myopia and intellectual impairment=cHb; perimenopausal=cHc; peripheral neuropathy, myopathy, hoarseness, and hearing loss=chC; colorectal adenomatous polyposis, autosomal recessive=chc; deafness, x-linked 4=cHC; loeys-dietz syndrome 3=cHd; hyper-igd periodic fever syndrome (bids)=chd; hearing disability=chD; snyder robinson syndrome=cHD; inclusion body myopathy 3, autosomal dominant=chE; juvenile polyposis with hereditary hemorrhagic telangiectasisa=cHe; waardenburg syndrome, type 2d=cHE; african swine fever=che; polymorphous low grade adenocarcinoma=chf; neuromuscular manifestations=cHF; growth mental deficiency syndrome of myhre=cHf; epstein syndrome=chE; inclusion body myopathy, autosomal dominant=chG; colorectal cancer, susceptibility to, 3=cHg; cerebral dysgenesis=cHG; arthrogryposis, distal, type 1b=chg; pulmonary hypertension, primary, 2=cHh; parkinson disease 1, autosomal dominant=cHH; lethal congenital contracture syndrome 4=chh; distal arthrogryposis type 2b=chH; arthrogryposis multiplex congenita, distal type 1=chi; spinal meningioma=cHi; parkinson disease 4, autosomal dominant lewy body=cHI; cardiomyopathy, familial hypertrophyic, 4=chi; impaired social interaction=cHj; lameness, animal=cHJ; retrognathia=chJ; left ventricular noncompaction 10=chj; cocaine delirium=cHK; cardiomyopathy, familial hypertrophyic, 4, susceptibility to=chk; rhabdoid turner predisposition syndrome 2=cHk; cardiomyopathy, familial hypertrophyic, 14=chK; mental retardation, autosomal dominant 16=cHI; cardiomyopathy, dilated, lee=chL; psychomotor retardation, epilepsy, and craniofacial dysmorphism=cHL; primary hypertrophyic cardiomyopathy=chl; metastatic pheochromocytoma=chm; retinitis pigmentosa 33=cHM; sick sinus syndrome 3, susceptibility to=chM; rhabdoid turner predisposition syndrome=cHm; atrial septal defect 3=chN; hypotrichosis 11=cHN; progonoma=chn; rhabdoid turner predisposition syndrome 1=cHn; mental retardation, autosomal dominant 15=cHo; mediastinum teratoma=cHO; cardiomyopathy, dilated, 1s=chO; inflammatory carcinoma=cho; long qt syndrome 12=chP; lymphomas in children=chp; malignant rhabdoid turner, somatic=cHp; left ventricular noncompaction 5=chP; medullomyoblastoma=chq; osteopetrosis, autosomal recessive 8=cHQ; teratoid turner, atypical=cHq; ebstein's anomaly=chQ; ependymoblastoma=cHr; hecht syndrome=chR; mature b-cell neoplasm=chr; microcephaly, microphthalmia, ectrodactyly of lower limbs, and prognathism=cHR; neuroblastoma, susceptibility to=chs; mental retardation, anterior maxillary protrusion, and strabismus=cHS; brain ependymoma=cHs; carney complex variant=chS; epithelioid malignant peripheral nerve sheath turner=cHt; macrothrombocytopenia progressive deafness=chT; chromosome 1, monosomy 1p=cht; dermatitis, atopic, 4=cHT; acute nephritis=cHO; familial hyperlipidemi=cHu; central neurocytoma=chu; fechtner syndrome=chU; may-hegglin anomaly=chV; cornealia de lange syndrome 3=cHv; intermixed schwannian stroma-rich ganglioneuroblastoma=chv; mitochondrial cytopathy=cHV; facioscapulohumeral muscular dystrophy 1b=cHw; degenerative myelopathy=cHW; deafness, autosomal dominant 17=chW; neurological ventriculitis=chw; deafness, autosomal dominant nonsyndromeic sensorineural 17=chX; stiff limbs=cHX; adult spinal muscular atrophy=cHx; myopathy, centronuclear, 3=chx cochleosaccular degeneration of the inner ear and progressive cataracts=chY; microvascular complications of diabetes, susceptibility to, 6=cHY; bulbar weakness=cHy; aortic aneurysm, familial thoracic 4=chy; acute myelomaonoblastic leukemia=chz; b-cell immunodeficiency, distal limb anomalies, and urogenital malformations=cHz; chronic pelvic pain syndrome=cHZ; clq nephropathy=chZ; scid due to ada deficiency, delayed onset=CI; preleukemia=ci; left-right axis malformations=Ci; interstitial lung disease=cI; lactic acidosis, fatal infantile=cIa; cardiomyopathy, dilated, 1kk=ciA; spastic paraplegia 15, autosomal recessive=cIA; pathognomonic sign=cia; atrophy of corpus callosum=cIB; bladder neck obstructio=cib; noonan syndrome 4=cIb; duration of sleep=ciB; craniodiaphyseal dysplasia, autosomal dominant=cIc; mast syndrome=cIC; ogden syndrome=ciC; cardiomyopathy, familial hypertrophyic, 10=cic; osteoarthritis, spine=cId; acetylation, fast=ciD; cardiomyopathy, familial hypertrophyic, 8=cid; spastic paraplegia 7, autosomal recessive=cID; aortic aneurysm, familial thoracic 7=cie; acute erythroleukemia=cIE; schindler disease, type i=ciE; craniodiaphyseal dysplasia=cle; waardenburg syndrome, type 4c=cIf; deafness, autosomal recessive 3=cif; diarrhea 3, secretory sodium, congenital, syndromeic=cIF; kanzaki disease=ciF; neuroaxonal dystrophy=ciG; yemenite deaf-blind hypopigmentation syndrome=cIg; deafness, autosomal dominant 48=cig; langerhans cell histiocytosis of lung=cIG; n-acetyl glutamate synthetase deficiency=ciH; focal segmental glomerulosclerosis 6=cih; tympanosclerosis=cIH; waardenburg syndrome, type 2e=cIh; deafness, autosomal recessive 30=cii; chronic intestinal pseudo-obstruction=cIi; parkinson disease 3, autosomal dominant lewy body=cII; hypotonia, infantile, with psychomotor retardation and characteristic facies=ciI; griscelli syndrome type 1=cij; childhood pilocytic astrocytoma=cIj; neuronal intestinal dysplasia, type b=cIJ; spermatogenic failure 12=ciJ; vesicoureteral reflux 3=cIk; hypogonadotropic hypogonadism 17 with or without anosmia=ciK; anemia due to infection=ciK; elejalde disease=cik; hypotrichosis-lymphedema-telangiectasisa syndrome=cIl; peripheral osteosarcoma=ciL; diarrhea intractable=ciI; elliptocytosis 2=cIL; flaccid paralysis=ciM; deafness, autosomal recessive 37=cim; mental retardation, x-linked, with panhypopituitarism=clm; spherocytosis, type 3=cIM; congenital hypertrichosis lanuginosa=cln; deafness, autosomal dominant nonsyndromeic sensorineural 22=cin; epileptic encephalopathy, early infantile, 5=cIN; plasma glucose concentration=ciN; spectrin, beta, erythrocytic=cIO; mental retardation, x-linked, with isolated growth hormone deficiency=cIo; sigmoid neoplasm=ciO; deafness, sensorineural, with hypertrophyic cardiomyopathy=cio; congenital hypertrichosis=cIp; n-acetylaspartate deficiency=ciP; elliptocytosis 3=cIP; deafness, autosomal recessive 2=cip; spinocerebellar ataxia, autosomal recessive 14=cIQ; campomelic dysplasia with autosomal sex reversal=cIg; short stature, optic nerve atrophy, and pelger-huet anomaly=ciQ; deafness, autosomal dominant 11=ciq; 46,xx sex reversal 2=cIr; neuropathy, hereditary sensory and autonomic, type ic=cIR; nk/t-cell lymphoma, nasal and nasal-type=ciR; usher syndrome, type ib=cir; kyphomelic dysplasia=cIs; celiac disease, susceptibility to, 4=cis; coloboma, ocular, and ichthyosis, brain malformations, and endocrine abnormalities=cIS; lymph node tuberculosis=ciS; kahrizi syndrome=cIT; torsion abnormality=cIt; glaucoma due to combination of mechanisms=cit; granulomatous disease, chronic, autosomal recessive, cytochrome b-positive, type i=ciT; granulomatous disease, chronic, autosomal recessive, cytochrome b-positive, type ii=ciU; ciliary dyskinesia, primary, 28=cIu; bone marrow failure syndrome 1=cIU; steroid-induced glaucoma=ciu; iga myeloma=civ; rolandic epilepsy, mental retardation, and speech dyspraxia, x-linked=cIV; systemic aspergillosis=ciV; culture shock=civ; streptococcal impetigo=ciw; spastic paraplegia 4, autosomal dominant=cIw; 46,xy gonadal dysgenesis, complete, sry-related=cIW; granulomatous disease, chronic, autosomal recessive, cytochrome b-positive, type iii=ciW; autoimmune thyroiditi=ciX; myopathy, spheroid body=cix; microdysgenesis=clx; sclerotylosis=cIX; posterior lenticonus=cIY; muscular dystrophy, limb-girdle, type 1a=ciy; 46, xx true hermaphrodite=cIY; oculomaxillofacial dysostosis=cIy; spastic paraplegia 11, autosomal recessive=cIz; malaria, mild, susceptibility to=ciZ; monophasic synovial sarcoma=cIZ; cardiomyopathy, familial hypertrophyic, 16=ciz; leukodystrophy=cJ; right atrial isomerism=Cj; priapism, familial idiopathyic=CJ; myelodysplasia=cj; hidradenitis suppurativa, familial=cja; fibrous hamartoma=cjA; symptomatic west syndrome=cJA; esophageal varix=cJa; epileptic spasms=cJB; microhydranencephaly=cjb; radiation induced meningioma=cjB; somatostatin analog, resistance to=cJb; hemophagocytic lymphohistiocytosis, familial, 5=cJC; lissencephaly 4=cjc; tumorlet=cjC; ichthyosis with hypotrichosis, autosomal recessive=cJc; mitochondrial dna depletion syndrome 5 (encephalyomyopathyic with or without methylmalonic aciduria)=cJD; bone epithelioid hemangioma=cjD; microlissencephaly=cjd; amish infantile epilepsy syndrome=cJd; exudative vitreoretinopathy, familial, x-linked recessive=cje; bronchial adenocarcinoma=cjE;

native american myopathy=cJe; mitochondrial dna depletion syndrome 2 (myopathyic type)=cJE; neuropathy, hereditary motor and sensory, lorn type=cjf; Colorado tick fever=cjF; premature ovarian failure 8=cJf; mitochondrial dna depletion syndrome 9 (encephalyomyopathyic type with methylmalonic aciduria)=cJF; sotos syndrome 2=cjG; thyroid hurthle cell carcinoma=cjg; glutaric aciduria iii=cJG; microcephaly-capillary malformation syndrome=cJg; marshall-smith syndrome=cjH; mycobacterial and viral infections, susceptibility to, autosomal recessive=cJh; mitochondrial encephalyopathy, lactic acidosis and stroke-like episodes (melas syndrome)=cjh; comedocarcinoma, noninfiltrating=cJH; candidiasis, familial, 7=cJi; sarcoidosis, early-onset=cji; osteochondrodysplasia, rhizomelic, with callosal agenisi, thrombocytopenia, hydrocephalyus, and hypertension=cJI; mammographic breast density=cJI; orofacial cleft 10=cJJ; benign multiple sclerosis=cjJ; sensory polyneuropathy=cjj; hyper-ige recurrent infection syndrome, autosomal dominant=cJj; chronic gouty arthritis=cjK; systemic lupus erythematosus, susceptibility to, 11=cJk; orthostatic hypotensive disorder, streeten type=cjk; diabetes mellitus, insulin-dependent, 5=cJK; anemia, hypochromic microcytic, with iron overload 2=cJl; follicular mucinosis=cJL; photogenic epilepsy=cjl; pediatric ulcerative colitis=cjL; microcephaly, primary autosomal recessive, 7=cJm; lyssavirus infection=cjM; never in mitosis gene a-related kinase 1=cjm; arrest of spermatogenesis=cJM; subdural empyema=cjN; epilepsy, x-linked, with variable learning disabilities and behavior disorders=cJN; retinitis pigmentosa 67=cjn; myopathy, tubular aggregate=cJn; emery-dreifuss muscular dystrophy 4=cJO; nephronophthisis 9=cjo; stormorken syndrome=cJo; immunodeficiency, common variable, 10=cjO; renal-hepatic-pancreatic dysplasia 2=cjp; ectodermal dysplasia, anhidrotic, with t-cell immunodeficiency, autosomal dominant=cjP; spinocerebellar ataxia, autosomal recessive 8=cJP; pseudopseudohypoparathyroidis=cJp; pleural empyema=cjQ; renal pelvis transitional cell carcinoma=cjq; preeclampsia eclampsia 4=cJq; emery-dreifuss muscular dystrophy 5, autosomal dominant=cJQ; polyhydramnios, megalencephaly, and symptomatic epilepsy=cJr; deafness, autosomal recessive 76=cJR; multiple mitochondrial dysfunctions syndrome 1=cjR; sialidosis, type i=cjr; mental retardation, autosomal dominant 5=cJS; deafness, autosomal recessive 16=cJs; neuropathy, hereditary sensory and autonomic, type v=cjS; mody, type 6=cjs; parkinson disease 20, early-onset=cJT; deep pain=cjT; rud syndrome=cJt; diabetes mellitus, insulin-dependent, 7=cjt; diarrhea 4, malabsorptive, congenital=cju; retention hyperkeratosis=cJu; myofascial pain syndrome=cjU; mental retardation, x-linked 96=cJU; congenital disorder of glycosylation, type iw=cJv; congenital disorder of deglycosylation=cjV; neurofibromatosis-noonan syndrome=cjv; spinocerebellar ataxia, autosomal recessive 11=cJV; congenital heart defects, multiple types, 2=cJW; congenital disorder of glycosylation, type ix=cJw; neurofibromatosis, familial spinal=cjw; epilepsy, progressive myoclonic 2b=cjW; dyskeratosis congenita, autosomal recessive, 1=cjX; caf-au-lait macules with pulmonary stenosis=cjx; hemophagocytic lymphohistiocytosis, familial, 4=cJx; chronic cryptosporidiosis=cJX; neurofibromatosis type 5=cjy; dyskeratosis congenita, autosomal recessive=cjY; hypogonadotropic hypogonadism 10 with or without anosmia=cJY; horse diseases=cJy; dyskeratosis congenita, autosomal recessive, 2=cjZ; hypogonadotropic hypogonadism 11 with or without anosmia=cJZ; learning problems=cjz; epileptic encephalopathy, early infantile, 4=cJz; testicular cancer=ck; cardiomyopathy=cK; thalassemia=Ck; x-linked chronic granulomatous disease=CK; cataract, congenital, with microcornea or slight microphthalmia=cka; anal canal carcinoma=ckA; mental retardation, autosomal recessive 40=cKa; craniosynostosis 3=cKA; corneal dystrophy, fuchs endothelial, 3=cKB; ciliary dyskinesia, primary, 6=ckB; diabetes mellitus, insulin-dependent, 21=cKb; seckel syndrome 7=ckb; precursor lymphoblastic lymphoma/leukemia=cKC; glomerulonephritis sparse hair telangiectases=cKc; amaurosis congenita of leber, type 9=ckC; spastic paraplegia 6, autosomal dominant=ckc; transcobalamin ii=cKD; transaldolase deficiency=cKd; glucocorticoid deficiency 4=ckD; ichthyosis, congenital, autosomal recessive 6=ckd; eye manifestations=eke; reactive arthritis=cKe; transcobalamin ii deficiency=cKE; premature ovarian failure 5=ckE; maxillary sinus neoplasm=cKf; external auditory canal, bilateral atresia of, with congenital vertical talus=ckF; choreoathetosis, hypothyroidism, and neonatal respiratory distress=ckf; joubert syndrome 13=cKF; tectonic family, member 2=cKG; thiourea tasting=cKg; chorea, benign hereditary=ckg; granulomatous mastitis=ckG; hypertyrosinemia=cKh; joubert syndrome 18=cKH; progressive chorea=ckh; granulomatous uveitis=ckH; warburg micro syndrome 4=cKi; neurohypophysis granular cell turner=cki; anus disease=ckI; forebrain defects=cKI; hypothyroidism, congenital, nongoitrous, 5=ckj; schizephrenia=cKJ; cranial nerve disease=ckJ; epileptic encephalopathy, early infantile, 16=cKj; deafness, autosomal recessive 86=cKk; situs inversu=ckK; spinocerebellar ataxia, autosomal recessive, with axonal neuropathy=cKK; atrial septal defect 7 with or without atrioventricular conduction defects=ckk; ventricular septal defect 3=ckl; cataract 36=cKL; nog-related-symphalangism spectrum disorder=ckL; digitorenocerebral syndrome=cKl; sveinsson chorioretinal atrophy=cKM; symphalangism-brachydactyly syndrome=ckM; splenic hypoplasia=ckm; kenny caffey syndrome=cKm; brachydactyly, type b2=ckN; spastic paraplegia 49, autosomal recessive=cKN; hypoplastic left heart syndrome 2=ckn; kenny-caffey syndrome, type 1=cKn; stapes ankylosis with bread thumb and toes=ckO; mental retardation, autosomal recessive 14=cKO; isolated noncompaction of the ventricular myocardium=cko; hypoparathyroidism-retardation-dysmorphism syndrome=cKo; esophageal atresia with or without tracheoesophageal fistula=ckP; deafness, autosomal dominant 12=cKP; emanuel syndrome=cKp; multiple ventricular septal defects=ckp; cervical aortic arch=cKq; stapes fixation=ckQ; ostium secundum type atrial septal defect=ckq; deafness, autosomal recessive 21=cKQ; ovarian endodermal sinus turner=ckr; herpes zoste=cKR; carpal synostosis=ckR; facial deformity=cKr; venous malformations, multiple cutaneous and mucosal=cKS; atrial septal defect 4=cKs; autism, susceptibility to, x-linked 1=cks; myoclonus, familial cortical=ckS; intramuscular hemangioma=cKT; asthma and nasal polyps=cKt; qt interval, variation in=ckT; asperger syndrome, x-linked, susceptibility to, 1=ckt; placenta accreta=cKU; atypical autism=cku; abruzzo erickson syndrome=cKu; achalasia, familial esophageal=ckU; salivary gland basal cell adenocarcinoma=ckV; ischiopatellar dysplasia=cKv; microphthalmia, isolated, with coloboma 9=cKV; asperger syndrome, x-linked, susceptibility to, 2=ckv; lymph node infected=ckW; bleeding disorder, platelet-type, 13, susceptibility to=cKw; dyskeratosis congenita, autosomal dominant=cKW; autism, susceptibility to, x-linked 2=ckw; alzheimer disease, late-onset, susceptibility to=ckX; ghosal hematodiaphyseal dysplasia=cKx pulmonary fibrosis and/or bone marrow failure, telomere-related, 1=cKX; familial cold autoinflammatory syndrome 2=ckx; dyskeratosis congenita, autosomal dominant, 2=cKY; hypertension in children=ckY; cardiomyopathy, dilated. ln=cKy; corneal intraepithelial dyskeratosis and ectodermal dysplasia=cky; ventricular failure=ckZ; primary gout=ckz; melanoma, cutaneous malignant, susceptibility to, 9=cKZ; muscular dystrophy, limb-girdle, type 2g=cKz; rhabdomyosarcoma=cl; lymphocytosis=CL; charcot-marie-tooth disease, axonal, type 2n=cL; situs inversus=Cl; corneal deposit=cLA; atherosclerotic renal artery stenosis=cla; chronic drug abuse=clA; meningothelial meningioma=cLa; pancreatic cholera=clB; corneal granular dystrophy=cLB; char syndrome=cLb; cor pulmonale=clb; spastic paraplegia 57, autosomal recessive=cLc; reis-bucklers corneal dystrophy=cLC; leukemia, post-chemotherapy, susceptibility to=clC; congenital defect of skull and scalp=clc; neuropathy, hereditary motor and sensory, Okinawa type=cLd; adrenal hypoplasia, congenital, with precocious puberty=clD; thiel-behnke corneal dystrophy=cLD; valve anomalies=cld; aortic aneurysm, familial thoracic 3=cLE; mineralocorticoid deficiency, isolated=clE; alagille syndrome 2=cle; congenital atransferrinemia=cLe; colorectal cancer, hereditary nonpolyposis, type 6=cLF; congenital adrenal hypoplasia, x-linked=clF; serpentine fibula polycystic kidney syndrome=clf; acquired protein s deficiency=cLf; arenaviridae infections=cLg; primary spermatogenic failure=clG; fibromatosis, congenital generalized=clg; loeys-dietz syndrome, type 1b=cLG; howell jolly bodies=cLh; retinitis pigmentosa 37=clH; myofibromatosis, infantile, 2=clh; thyroid dyshormonogenesis 3=cLH; lacune=cli; african hemochromatosis=cLi; autoimmune thyroid disease, susceptibility to, 3=cLI; goldmann-favre syndrome=clI; binswanger's disease=clj; thyroid dysfunction of mother, postpartum condition or complication=cLJ; metamorphopsia=clJ; estrogen receptor positive turner=cLj; chronic thyroiditis=cLK; paraneoplasmtic opsoclonus-myoclonus ataxia=clk; dentin dysplasia, type 1=cLk; macular retinoschisis=clK; acute mucositis=cLl; nontoxic goiter=cLL; cryptosporidiosi=clL; corneal guttata=clk bosch-boonstra optic atrophy syndrome=clM; hypochondriasis=clm; thyroid angiosarcoma=cLM; ribbing disease=cLm; niemann-pick disease, type a=cln; radiation esophagitis=cLn; 46, xx disorders of sex development=clN; ichthyosis, congenital, autosomal recessive 1=cLN; carcinogenesis, radiation=cko; pseudohermaphroditism, female, with hypokalemia, due to glucocorticoid resistance=clO; autosomal recessive ichthyosis=cLO; niemann-pick disease, type cl=clo; brain ischemiaa=cLp; niemann-pick disease, type d=clp; microbial colonization=clP; keratinization of ocular surface=cLP; ectropion=cLQ; body composition, beneficial=clQ; renal-hepatic-pancreatic dysplasia=clg; epithelioid cell melanoma=cLq; xanthinuria=cLR; nelson syndrome=clR; loeys-dietz syndrome 4=cLr; renal hepatic pancreatic dysplasia dandy walker cyst=clr; peeling skin syndrome, acral type=cLS; pseudohypoaldosteronism, type i, autosomal dominant=clS; senior-loken syndrome 4=cls; furlong syndrome=cLs; pseudohypoaldosteronism, type i, autosomal recessive=clT; nephronophthisis 4=clt; aneurysm of aortic root=cLt; transglutaminase 6=cLT; normal pressure hydrocephalyu=clu; hypertension, early-onset, autosomal dominant, with severe exacerbation in pregnancy=clU; rienhoff syndrome=cLu; laryngeal dystonia=cLU; hemolytic uremic syndrome, atypical, susceptibility to, 6=cLV; minimal lesion=clv; arrhythmogenic right ventricular dysplasia, familial, 1=cLv; deficiency of dehydrogenase=clV; denture stomatitis=clW; asthma-related traits, susceptibility to, 2=clw; corneal dystrophy, lattice type iiia=cLw; thrombo-philia due to thrombomodulin defect=cLW; groenouw type i corneal dystrophy=cLx; laryngeal atresia, encephalycele, and limb deformities=cLX; mils=clx; premature ovarian failure 7=clX; spermatogenic failure 8=clY; corneal allograft rejection=cLY; stromal corneal dystrophy=cLy; bronchioliti=cly; after pains=clz; amyloid of cornea=cLz; expressed emotion=clZ; beaulieu-boycott-innes syndrome=cLZ; osler-rendu-weber syndrome 2=Cm; keratosis palmoplantaris papulosa=cm; recurrent infections (sinusitis and bacterial pneumonia and meningitis)=CM; depression=cM; prosthetic joint infection=cMA; brown oculocutaneous albinism=cmA; sacral agenisi with vertebral anomalies=cMa; retinitis pigmentosa 27=cma; sexually transmitted diseases, bacterial=cMB; joubert syndrome 10=cmB; neural retina leucine zipper=cmb; myxedema=cMb; osteomyelofibrosis=cMc; streptococcal sepsis=cMC; simpson-golabi-behmel syndrome, type 2=cmC; retinal degeneration, autosomal recessive, clumped pigment type=cmc; rheumatic fever in children=cMD; alpha-ketoglutarate dehydrogenase deficiency=cmD; idiopathyic megacolon=cmd; experimental pneumococcal meningitis=cMd; mixed type cataract=cmE; focal thyroiditis=cMe; schizephrenia 17=cme; candida sepsis=cME; pitt-hopkins-like syndrome 2=cmf; supragingival dental plague=cMF; hypothyroidism, congenital, nongoitrous, 6=cMf; glaucoma, normal tension, susceptibility to=cmF; optic atrophy 1 and deafness=cmG; listeria meningitis=cMG; thyroid hormone resistance, generalized, autosomal dominant=cMg; verruciform xanthoma of ski=cmg; hypogonadotropic hypogonadism 9 with or without anosmia=cmh; optic atrophy with or without deafness, ophthalmoplegia, myopathy, ataxia, and neuropathy=cmH; herpes simplex encephalyitis, susceptibility to, 2=cMH; thyroid hormone resistance, selective pituitary=cMh; thyroid hormone resistance, generalized, autosomal recessive=cMi; mental retardation, autosomal recessive 5=cmi; optic atrophy and cataract, autosomal dominant=cmI; macular degeneration, age-related, 10=cMI; chronic urinary tract infection=cMJ; spastic paraplegia 45, autosomal recessive=cmj; 3-methylglutaconic aciduria type iv=cmJ; tsh producing pituitary turner=cMj; acne conglobata=cMK; 3-methylglutaconic aciduria=cmK; herpes simplex encephalyitis, susceptibility to, 4=cMk; uridine 5-prime monophosphate hydrolase deficiency, hemolytic anemia due to=cmk; graft ischaemia=cML; mental retardation, x-linked, with cerebellar hypoplasia and distinctive facial appearance=cmL; dilated cardiomyopathy secondary to viral myocarditis=cMl; atrial septal defect 1=cml; glaucoma 1, open angle, o=cmm; osteomyelitis=cMM; jensen syndrome=cMm; blue cone monochromatism=cmM; ileiti=cMN; pain insensitivity, congenital=cmn; colorblindness, partial, protan series=cmN; necrotizing scleritis=cMn; secondary disease=cMo; robinow syndrome=cmo; legionnaire disease, susceptibility to=cMO; red color blindness=cmO; fundus dystrophy, pseudoinflammatory, of sorsby=cMp; tritanopia=cmP; meningitis in children=cMP; obesity, hyperphagia, and developmental delay=cmp; neuronal intestinal pseudoobstruction=cMQ; revesz debuse syndrome=cMq; opioid withdrawal=cmQ; oculomotor nerve injuries=cmq; craving for alcohol=cmR; specific language impairment 5=cMR; dyskeratosis congenita, autosomal dominant, 3=cMr; schizephrenia 3=cmr; narcotic addiction=cmS; exercise anaphylaxis=cms; *Mycobacterium tuberculosis*, protection against=cMs; infections, arenavirus=cMS; atrial septal defect 6=cMt; deafness, autosomal recessive 7=cMT; ischemias pain=cmT; striatonigral degeneration infantile=cmt; leprosy, susceptibility to, 5=cMu; night blindness, congenital stationary, type 1a=emu; deafness, autosomal dominant 36=cMU; amyotrophyic lateral sclerosis 12=cmU; glaucoma 1, open angle, e=cmV; antepartum malaria=cMv; ornithine aminotransferase=cmv; cerebrofaciothoracic dysplasia=cMV; optic atrophy 7=cMW; vasomotor rhinitis=cmW; hyperornithinemia=cmw; recurrent cystitis=cMw; gyrate atrophy=cmx; joubert syndrome 16=cMX; gram positive sepsis=cMx; toxemia=cmX three m syndrome 2=cmy; severe dehydration=cmY; congenital disorder of glycosylation, type iik=cMY; leprosy reversal reaction=cMy; leprosy, susceptibility to, 3=cMz; joubert syndrome 2=cMZ; arthrogryposis multiplex congenita neurogenic type=cmZ; autosomal recessive ocular albinism=cmz; partial adenosine deaminase deficiency=CN; charcot-marie-tooth disease, type ii=cN; pulmonary arterial hypertension, hereditary hemorrhagic telangiectasisa-related=Cn; palmoplantar keratosis=cn; succinyl-coa: 3-oxoacid coa transferase deficiency=cnA; segmental ileitis=cNA; meckel syndrome type 2=cNa; pain neck/shoulder=cna; ischemias myocardial dysfunction=cNB; meckel syndrome, type 11=cNb; c3hex, ability to smell=cnb; bleeding disorder due to p2ryl2 defect=cnB; negative rheumatoid factor polyarthritis=cnc; joubert syndrome 20=cNc; chronic q fever=cNC; deafness, autosomal dominant 41=cnC; myopia, high, with cataract and vitreo-retinal degeneration=cnD; *Coxiella burnetii* infection=cND; joubert syndrome 14=cNd; childhood type dermatomyositi=cnd; dysphagia, progressive=cnE; osteogenesis imperfecta, type xiv=cNe; disc disorder=cNE; stomatin-like protein-2, hyperphosphorylation of=cne; mental retardation, autosomal dominant 17=cnE; immune dysfunction with t-cell inactivation due to calcium entry defect 2=cnf; emery-dreifuss muscular dystrophy 7, autosomal dominant=cNf; bunion=cNF; immune dysfunction with t-cell inactivation due to calcium entry defect 1=cng; muscular dystrophy-dystroglycanopathy (congenital with brain and eye anomalies), type a, 10=cNg; urate nephropathy=cnG; abdominal abscess=cNG; meier-gorlin syndrome 2=cnh; induration of breast=cNH; endometrioid adenoma=cnH; joubert syndrome 6=cNh; meier-gorlin syndrome 3=cni; severe asthma=cnI; meningoencephalitis=cNI; nephronophthisis 11=cNi; Japanese encephalitis=cNJ; encephalyocardiomyopathy, mitochondrial, neonatal, due to atp synthase deficiency=cNj; hyperphenylalaninemia, non-pku mild=cnJ; amyloidosis ix=cnj; conjunctivitiss=cNK; deafness, autosomal recessive 6=cNk; persistent hyperphenylalaninemia=cnK; osteopetrosis, autosomal recessive 1=cnk; activity intolerance=cnL; hepatic encephalopathy=cNL; osteopetrosis, autosomal recessive 5=cnl; epsilon-trimethyllysine hydroxylase deficiency=cNl; retinitis pigmentosa 3=cnm; mental retardation, x-linked 30=cnM; cardiomyopathy, dilated, 1t=cNm; tenosynovitiss=cNM; fanconi anemia, complementation group n=cnN; farmer's lung=cNN; enterokinase deficiency=cNn; oroticaciduria 1=cnn; pigmented villonodular synovitiss=cNO; vomit recurrent=cno; pancreatic cancer, susceptibility to, 3=cnO; deafness, childhood-onset neurosensory, autosomal recessive 8=cNo; deafness, autosomal recessive 10=cNp; pancreatic cancer, susceptibility to, 1=cnP; progressive multifocal leukoencephalopathy=cNP; deafness, autosomal recessive 22=cnp; deafness, autosomal dominant 56=cNq; deafness, autosomal recessive 9=cnq; catch=cNQ; spondyloepimetaphyseal dysplasia, Pakistani type=cnQ; achilles tendon injury=cNr; deafness, autosomal recessive 18b=cnr; spondylodysplasia and premature pubarche=cnR; osteopetrosis, autosomal recessive 7=cNR; periostitis=cNs; brachyolmia=cnS; osteopetrosis, mild autosomal recessive form=cNS; deafness, autosomal recessive 84b=cns; carcinoma of supraglottis=cNt; disseminated intravascular coagulatio=cnt; shortened trunk=cnT; polyostotic osteolytic dysplasia, hereditary expansile=cNT; anovulatio=cnQ; familial paget's disease of bone=cNU; dysgnathia complex=cnu; psoriatic arthritis, susceptibility to=cNu; limb-girdle muscular dystrophy type 2h=cnV; microphthalmia, syndromeic 5=cnv; anaplasmosis=cNv; hyperostosis corticalis deformans juvenilis=cNV; pyrophosphate arthritis=cNW; human immunodeficiency virus encephalitis=cNw; microphthalmia, syndromeic 3=cnw; mulibrey nanism=cnW; myelomonocytic leukemia=cNx; immunoglobulin a deficiency 2=cNX; allergic encephalyitis=cnX; pituitary hormone deficiency, combined, 6=cnx borderline lepromatous leprosy=cNy; diabetic polyneuropathy=cnY; schizephrenia 15=cny; immunodeficiency, common variable, 2=cNY; large cell medulloblastoma=cnZ; otocephaly=cnz; hypertrophy of tonsils=cNZ; liver scarring=cNz; congestive heart failure=cO; idiopathyic pulmonary arterial hypertension=Co; lung carcinoma=co; pricking of skin=CO; otofaciocervical syndrome 2=coa; transient hypogammaglobulinemia of infancy=cOa; retinitis pigmentosa 31=cOA; galactorrhea associated with childbirth=coA; chromosome 7, trisomy 7p=cob; dystonia, focal, task-specific=cOB; hyperphenylalaninemia with primapterinuria=coB; immunodeficiency, common variable, 4=cOb; multiple sclerosis, susceptibility to, 5=cOc; coloboma of optic nerve=coc; organic acidemias=coC; psychogenic dystonia=cOC; craniofacial deafness hand syndrome=cod; infantile cerebral palsy, unspecified=cOD; usher syndrome, type ig=coD; adenitis=cOd; klein-waardenberg's syndrome=coe; skin diseases, viral=cOe; torticollis, familial=cOE; deafness, autosomal recessive 23=coE; maturity-onset diabetes of the young, type 9=cof; sprue=cOf; usher syndrome, type if=coF; adrenocortical carcinoma, hereditary=cOF; epilepsy, female-restricted, with mental retardation=coG; basal cell carcinoma, susceptibility to, 7=cOG; sulfocysteinuria=cog; breast squamous cell carcinoma=cOg; trigeminal nerve injuries=cOH; leukemia, acute lymphoblastic, susceptibility to, 3=coh; iga nephropathy, susceptibility to, 1=cOh; polysubstance dependencye=coH; phosphoenolpyruvate carboxykinase 2 deficiency=coI; urosepsis=coi; roseolovirus infections=cOI; immunoglobulin g4 related sclerosing disease=cOi; malignant struma ovari=coJ; liver abscess, pyogenic=coj; polyclonal hypergammaglobulinemia=cOj; porokeratosis of mibelli=cOJ; actinic cheilitis=cOK; ornithosis=cok; inflammatory bowel disease 16=cOk; pilar and trichilemmal cysts=coK; langerhans cell sarcoma=col; chronic hyperplastic candidiasis=cOL; immunodeficiency 16=cOl; megaesophagus=coL; microcephalyic osteodysplastic primordial dwarfism, type ii=coM; sweat gland adenocarcinoma=cOM; aniridia cerebellar ataxia mental deficiency=com; cardiomyopathy, dilated, 1z=cOm; keratitis, hereditary=con; cancer, embryonal=cON; cardiomyopathy, familial hypertrophyic, 13=cOn; seckel syndrome 2=coN; cardiomyopathy, dilated, 2a=cOo; osteodysplastic primordial dwarfism=coO; ectopia pupillae=coo; noninvasive carcinoma ex pleomorphic adenoma=cOO; malignant stromal turner=cOP; proprotein convertase 13 deficiency=coP; o'donnell pappas syndrome=cop; cardiomyopathy, dilated, 1ff=cOp; body mass index quantitative trait locus 12=coQ; foot diseases=cOQ; cardiomyopathy, familial hypertrophyic, 7=cOq; foveal hypoplasia 1=coq; sacral defect and anterior sacral meningocele=coR; solitary keratoacanthoma=cOR; aniridia, type 2=cor; cardiac hypertrophy=cOr; desmoplastic cerebral astrocytoma of infancy=cOS; knee pain=coS; optic nerve aplasia, bilateral=cos; nemaline myopathy 5=cOs; cardiomyopathy, dilated, 1d=cOt; mucinous cystic turner of borderline malignancy=cOT; foveal hypoplasia, isolated=ent; spondylometaphyseal dysplasia with cone-rod dystrophy=coT; cyst benign=cOU; manifest-latent nystagmus=cou; cardiomyopathy, familial hypertrophyic, 2=cOu; cerebral cavernous malformations 3=coU; fetal microcephaly=cov; cardiomyopathy, familial restrictive, 3=cOv; systemic lupus erythematosus, susceptibility to, 2=coV; choroid plexus carcinoma, childhood=cOV; congenital ptosis=cow; adult diffuse astrocytoma=cOW; primary pigmented nodular adrenocortical disease=coW; muscular dystrophy, limb-girdle, type 1f=cOw; chondrosarcoma of bone=cOX; ehlers-danlos syndrome caused by tenascin-x deficiency=cOx; placenta cancer=cox; acrodysostosis 2 with or without hormone resistance=coX; ischaemic cerebral infarction=coY; tenth agenisi, selective, 3=coy; recurrent dislocation of joint=cOy; lymph node cancer=cOY; nonpuerperal galactorrhea=coz; hypermobility syndrome=cOz; erythroplakia of mouth=cOZ; retinitis pigmentosa 43=coZ; familial primary pulmonary hypertension=Cp; saccharopinuria=cP; osteoporosis=cp; macrocytosis=CP; night blindness, congenital stationary, autosomal dominant 2=cpa; adnexal lesion=cPa; split-hand/foot malformation 4=cPA; charcot-marie-tooth disease, x-linked dominant, 6=cpA; limb-mammary syndrome=cPB; flat warts=cPb; hyperplasia of tonsils=cpB; retinitis pigmentosa 40=cpb; pyruvate dehydrogenase phosphatase deficiency=cpC; ischemias=cPc; cone dystrophy 4=cpc; orofacial cleft 8=cPC; achromatopsia 5=cpd; parotid gland cancer=cPd; sweat gland neoplasm=cPD; coenzyme q10 deficiency, primary, 2=cpD; skin/hair/eye pigmentation, variation in, 10=cPE; joubert syndrome 22=cpe; pneumoniaa=cPe; coenzyme q10 deficiency, primary, 3=cpE; transient cerebral ischemiaa=cPf; retinitis pigmentosa 57=cpf; pancreatic agenisi, congenital=cpF; undifferentiated somatoform disorder=cPF; chronic cholangitis=cpG; attention deficit-hyperactivity disorder, susceptibility to, 7=cPG; retinal cone dystrophy 3a=cpg; ovary sarcoma=cPg; glottis carcinoma=cPh; hereditary x-linked recessive spastic paraplegia=cpH; triosephosphate isomerase deficiency=cPH; achromatopsi=eph; striatal degeneration, autosomal dominant=cpi; papillary cystadenocarcinoma=cPi; spinocerebellar ataxia 23=cpi; triose phosphate isomerase deficiency=cPI; pigmented nodular adrenocortical disease, primary, 3=cpj; localized osteosarcoma=cPj; thiamine metabolism dysfunction syndrome 5 (episodic encephalopathy type)=cPJ; late cortical cerebellar atrophy=cpj; horizontal nystagmus=cpK; multifocal osteogenic sarcoma=cPk; hypothyroidism in pregnancy=cpk; cardiomyopathy, familial hypertrophyic, 3=cPK; harding ataxia=cpL; sarcomatoid renal cell carcinoma=cPl; cardiomyopathy, dilated, 1y=cPL; bone diseases, endocrine=cpl; prostate carcinoma in situ=cpM; bone giant cell sarcoma=cPm; basal ganglia calcification, idiopathyic, 5=cpm; nemaline myopathy 4=cPM; zebra body myopathy=cPN; gliofibroma=cPn; diabetic ulcer=cpn; usher syndrome, type 2a=cpN; adult fibrosarcoma=cpo; nasal cavity adenocarcinoma=cPo; oral dyskinesia=cpO; nemaline myopathy 1=cPO; endometrial squamous cell carcinoma=cPp; advanced sleep phase syndrome, familial, 1=cpP; ileocolic intussusception=cPP; respiratory system abnormalities=cpp; thiopurine s methyltransferase deficiency=cPQ; clear cell chondrosarcoma=cPq; regular astigmatism-corneal=cpq; acute q fever=cpQ; ovarian mucinous neoplasm=cPr; gastrointestinal irritation=cPR; addicted to cocaine=cpR; eosinophilic granulomatous polyp=cpr; proneural glioblastoma=cps; vesiculobullous skin disease=cPS; recurrent hypersomnia=cpS; non-invasive bladder papillary urothelial neoplasm=cPs; thyroid nodule cold=cPT; peroxisome biogenesis disorder 3a (zellweger)=cpT; myxopapillary ependymoma=cpt; malignant triton turner=cPt; fibrosarcomatous osteosarcoma=cPu; toxic diffuse goiter=cPU; basal ganglia calcification, idiopathyic, 4=cpu; peroxisome biogenesis disorder 3b=cpU; pulmonary capillary hemangiomatosis=cpv; spinocerebellar ataxia, autosomal recessive 7=cPV; peroxisome biogenesis disorder 11b=cpV; atypical follicular adenoma=cPv; deafness, autosomal recessive 79=cPW; pdgfrb-associated chronic eosinophilic leukemia=cpw; lip cancer=cPw; peroxisome biogenesis disorder 2b=cpW; bladder carcinoma in situ=cPx; peroxisome biogenesis disorder 11a (zellweger) =cpX; herpes simplex encephalyitis, susceptibility to, 3=cPX; pyruvate metabolism, inborn errors=cpx; pyruvate dehydrogenase e1-beta deficiency=cpy; peroxisome biogenesis disorder 13a (zellweger)=cpY; candidiasis, familial, 8=cPY; multiple myelomaa=cPy; maturity-onset diabetes of the young, type 4=cpz; ectrodactyly, ectodermal dysplasia, and cleft lip/palate syndrome 3=cPz; peroxisome biogenesis disorder 8b=cpZ; psoriasis susceptibility 13=cPZ; disorder of purine metabolism=CQ; ataxia telangiectasisa=cq; hyperlysinemia, type i=cQ; cutaneous lymphoma=Cq; progressive familial heart block, type 1b=cQA; phosphoglycerate dehydrogenase deficiency=cqA; muscular dystrophy, limb-girdle, type 2s=cQa; peroxisome biogenesis disorder 8a (zellweger)=cqa; peroxisome biogenesis disorder 12a (zellweger)=cqb; trichorhinophalangeal syndrome, type iii=cQB; neu laxova syndrome=cqB; mental retardation, autosomal recessive 13=cQb; trichorhinophalangeal syndrome type i=cQC; ventricular tachycardia, catecholaminergic polymorphic, 5, with or without muscle weakness=cQc; glycogen storage disease, type ixd=cqC; peroxisome biogenesis disorder 7a (zellweger)=cqc; phosphorylase kinase, alpha 2 (liver)=cqD; peroxisome biogenesis disorder 7b=cqd; prurigo nodularis=cQD; trehalase deficiency=cQd; peroxisome biogenesis disorder 5b=cqe; glycogen storage disease, type ixa2=cqE; gastrointestinal sensation=cQE; vasculopathy, retinal, with cerebral leukodystrophy=cQe; peroxisome biogenesis disorder 5a (zellweger)=cqf; chilblain lupus 1=cQf; glycogen storage disease ixb=cqF; urinary incontinence, urge=cQF; coma, post-head injury=cQg; taste salty=cQG; glycogen storage disease ixc=cqG; peroxisome biogenesis disorder 10a (zellweger)=cqg; tertiary hypothyroidism=cQh; fibrosis of extraocular muscles, congenital, 2=cqH; headache disorders, primary=cQH; cerebrohepatorenal syndrome, variant types=cqh; metatropic dwarfism=cQI; peroxisome biogenesis disorder 2a (zellweger)=cqi; hirschsprung disease ganglioneuroblastoma=cqI; familial alcoholism=cQi; brachyolmia type 3=cQJ; neuroblastoma, susceptibility to, 2=cqJ; thyrotropin-releasing hormone resistance, generalized=cQj; peroxisome biogenesis disorder 4a (zellweger)=cqj; thyrotropin-releasing hormone receptor=cQk; hypoventilation syndrome=cqK; parastremmatic dwarfism=cQK; peroxisome biogenesis disorder 4b=cqk; chronic respiratory failure=cqL; refsum disease, adult, 2=cql; spinal muscular atrophy, scapuloperoneal=cQL; subacute cutaneous lupus=cQl; sleep-related respiratory failure=cqM; hereditary motor and sensory neuropathy, type iic=cQM; lupus erythematosus overlap syndrome=cQm; amyotrophyic lateral sclerosis 18=cqm; brachyolmia type 2=cQN; annular erythema=cQn; refsum disease, adult, 1=cqN; dimauro disease=cqn; digital arthropathy-brachydactyly, familial=cQO; hyperphosphatasisa with mental retardation=cqo; charcot-marie-tooth disease, axonal, type 2r=cQo; bronchiti=cqO; 22q11 partial monosomy syndrome=cqP; mulibrey nanis=cQp; hyperphosphatasisa with mental retardation syndrome 3=cqp; spinal muscular atrophy, distal, congenital nonprogressive=cQP; placental abruption=cqQ; mabry syndrome=cqq; sodium serum level guantitative trait locus 1=cQQ; deafness, autosomal recessive 28=cQq; achondrogenesis type 1a=cQr; testicular infection=cqR; hyperphosphatasisa with mental retardation syndrome 4=cqr; charcot-marie-tooth disease, type 2c=cQR; oculomelic amyoplasia=cqS; liver failure, infantile, transient=cQs; focal cortical dysplasia of taylor=cQS; keshan disease=cqs; gordon syndrome=cqT; giant cell astrocytoma=cQT; deafness, aminoglycoside-induced=cQt; antral ulcer=cqt; pontocerebellar hypoplasia type 2=cQU; meckel syndrome type 3=cqu; episodic pain syndrome, familial, 1=cQu; multiple congenital anomalies-hypotonia-seizures syndrome 2=cqU; paroxysmal nocturnal hemoglobinuria 1=cqV; pontocerebellar hypoplasia type 2a=cQV; cerebrovascular trauma=cqv; allergy to chemicals=cQv; pontocerebellar hypoplasia type 4=cQW; zunich neuroectodermal syndrome=cqW; nongonococcal urethritis=cqw; late onset cerebellar ataxia=cQw; focal segmental glomerulosclerosis 2=cQx; microcephaly 11, primary, autosomal recessive=cqx; multiple congenital anomalies-hypotonia-seizures syndrome 1=cqX; combined oxidative phosphorylation deficiency 3=cQX; dentin, secondary=cqy; hyperphosphatasisa with mental retardation syndrome 2=cqY; hyperthyroidism, nonautoimmune=cQY; csnb1c=cQy; hyperthyroidism, familial gestational=cQZ; marasmus=cqZ; heart sarcoma=cqz; dermais turner=cQz; vascular malformations=Cr; human immunodeficiency virus encephalyitis=CR; congenital heart disease=cr; hyperlysinemia=cR; multiple cysts=crA; thyroid carcinoma with thyrotoxicosis=cRa; multiple congenital anomalies-hypotonia-seizures syndrome 3=cra; amyloid of vitreous=cRA; adenosine triphosphate, elevated, of erythrocytes=crB; paroxysmal nocturnal hemoglobinuria 2=crb; age-related amyloidosis=cRB; thyroid adenoma, hyperfunctioning=cRb; familial polyneuropathy=cRC; congenital lipomatous overgrowth, vascular malformations, and epidermal nevi=crc; arrhythmogenic right ventricular dysplasia, familial, 9=crC; congenital hyperthyroidism=cRc; fleck retina, familial benign=crD; neonatal hyperthyroidism=cRd; megalencephaly cutis marmorata telangiectatica congenita=crd; gastrointestinal dysfunction=cRD; hereditary cardiac amyloidosis=cRE; subclinical hyperthyroidism=cRe; dystonia-parkinsonism, adult-onset=crE; cowden syndrome 5=cre; hepatic amyloidosis=cRF; nbia2b=crF; infected ascites=crf; orbital congestion=cRf; diffuse goiter=cRg; karak syndrome=crG; external auditory canal ceruminous adenoma=crg; eye lesion=cRG; stage iv endometrial cancer=crh; amyloid myopathy=cRH; toxic goiter=cRh; swallowing problem=crH; obstructive chronic bronchitis with (acute) exacerbation=cri; monoparesis-arm=cRI; plummer's disease=cRi; platelet-activating factor acetylhydrolase deficiency=crI; disabling disease=cRJ; intestinal atresia=crJ; breast mucinous carcinoma=crj; neonatal thyrotoxicosis=cRj; ceruminoma=crk; early satiety=cRK; chronic cerebral ischemia=cRk; centriacinar emphysema=crK; hematoma, epidural, spinal=crL; absent peristalsis=cRl; presbyopia=cRL; agammaglobulinemia 7, autosomal recessive=crl; thrombophilia, familial, due to decreased release of tissue plasminogen activator=crM; congenital pelviureteric junction obstruction=cRm; lissencephaly 3=cRM; ataxia-oculomotor apraxia 3=crm; embolism and thrombosis=crN; macrothrombocytopenia, autosomal dominant, tubbl-related=cRN; heaves=crn; exudative vitreoretinopathy 5=cRn; mental retardation, x-linked 58=cRo; cortical dysplasia, complex, with other brain malformations 5=cRO; postoperative adhesion=crO; lethal congenital contractural syndrome 3=cro; cystic breast disease=crp; polymicrogyria, symmetric or asymmetric=cRP; deafness, autosomal recessive 98=cRp; cardiac tamponade=crP; sudden infant death with dysgenesis of the testes syndrome=cRq; cholesterol embolism=crQ; polymicrogyria, asymmetric=cRQ; synostosis, carpal, with dysplastic elbow joints and brachydactyly=crq; strongylida infections=crR; spinocerebellar ataxia 11=cRr; astrocytic hamartoma=crr; fibrosis of extraocular muscles, congenital, 3a, with or without extraocular involvement=cRR; ring dermoid of cornea=crs; epileptic encephalyopathy, early infantile, 12=crS; cortical dysplasia, complex with other brain malformations 1=cRS; mitochondrial complex iii deficiency, nuclear type 2=cRs; migrating partial seizures in infancy=crT; nephronophthisis 12=cRt; dystonia musculorum deformans 4=cRT; single atrium=crt; short-rib thoracic dysplasia 4 with or without polydactyly=cRu; leukodystrophy, hypomyelinating, 6=cRU; cataract, posterior polar, 4=cru; auriculocondylar syndrome 2=crU; edema vascular=crv; leukonychia totalis=crV; gou=cRv; cortical dysplasia, complex with other brain malformations 4=cRV; vascular aneurysm=crw; retinitis pigmentosa 51=cRw; combined oxidative phosphorylation deficiency 4=cRW; autoinflammation, antibody deficiency, and immune dysregulation, plcg2-associated=crW; retinitis pigmentosa 14=cRX; vascular fragility=crx; familial cold autoinflammatory syndrome 3=crX; bardet-biedl syndrome 8=cRx benign neurilemmoma=cry; mental retardation, autosomal recessive 39=cRy; leber congenital amaurosis 15=cRY; urticaria due to cold=crY; central topographic island=cRZ; dystransthyretinemiac euthyroidal hyperthyroxinemia=cRz; dextrocardia=erz; alzheimer disease 19=crZ; brain abscess=Cs; combined immunodeficiency disease=CS; colon carcinoma=cs; sguamous cell carcinoma of pharynx=cS; shipyard ey=csa; blepharophimosis-ptosis-intellectual disability syndrome=cSA; mental retardation, autosomal recessive 7=cSa; hepatic venoocclusive disease with immunodeficiency=csA; epidermaolysis bullosa simplex, ogna type=csb; saethre-chotzen syndrome with eyelid anomalies=cSb; charcot-marie-tooth disease and deafness=csB; schnyder corneal dystrophy=cSB; amyotrophic lateral sclerosis 15, with or without frontotemporal dementia=cSC; pes cavus=csC; robinow sorauf syndrome=cSc; epidermaolysis bullosa simplex with pyloric atresia=csc; johanson-blizzard syndrome=cSD; chromosome 17, trisomy 17p=csD; muscular dystrophy, limb-girdle, type 2g=csd; baller-gerold syndrome=cSd; infection by anisakis larva=cse; facial ectodermal dysplasia=cSe; parkinson disease 5, autosomal dominant=cSE; disorder of hand=csE; diabetic embryopathy=cSf; infection by anisakidae=csf; neurodegeneration with optic atrophy, childhood-onset=cSF; multiple cranial neuropathy=csF; colorectal cancer, hereditary nonpolyposis, type 4=csG; tyrosine kinase 2 deficiency=cSg; anisakiasis=csg; body mass index guantitative trait locus 4=cSG; hyperbilirubinemia, transient familial neonatal=cSH; epileptic encephalyopathy, early infantile, 10=csH; encephalyomyopathy=cSh; osteopetrosis, autosomal recessive 6=csh; generalized osteopenia=csi; small intestine cancer=cSI; dna repair-deficiency disorders=csI; basosguamous carcinoma=cSi; alpha-2-plasmin inhibitor deficiency=csj; pancreatic triacylglycerol lipase deficiency=csJ; poisoning by fluorouracil=cSj; opiate withdrawal symptoms=cSJ; bone marrow oedema=csk; medullary cystic kidney disease 2=cSK; encephalyomyeliti=csK; rectal cancer stage=cSk; terminal cancer=csL; oculocutaneous albinism type Ib=cSl; axillary veins thrombosis=csl; glomerulocystic kidney disease with hyperuricemia and isosthenuria=cSL; ichthyosis, congenital, autosomal recessive 10=csM; hemophagocytic lymphohistiocytosis, familial, 3=cSM; streptococcal infection of skin=csm; oculocutaneous albinism type 3=cSm; spastic paraplegia 39, autosomal recessive=csN; herpes simplex encephalyitis, susceptibility to, 1=cSN; membranous conjunctivitis=csn; albinism, oculocutaneous, type i, temperature-sensitive=cSn; stage ii melanoma=cSo; pneumoniae plague=cso; immunodeficiency with hyper-igm, type 5=cSO; chorioretinal dystrophy, spinocerebellar ataxia, and hypogonadotropic hypogonadism=csO; pyridoxamine 5-prime-phosphate oxidase deficiency=csP; lipodystrophy, familial partial, type 4=csp; beta-ureidopropionase deficiency=cSP; tyrosinase-negative albinism=cSp; deafness, autosomal recessive 70=csQ; adenosquamous pancreas carcinoma=cSQ; autoimmune endocrine disease=cSq; cardiomyopathy, dilated. lp=csq; secondary malignant neoplasm of spleen=cSr; combined oxidative phosphorylation deficiency 13=csR; mental retardation, x-linked, syndromeic 14=cSR; cardiomyopathy, familial hypertrophyic, 18=csr; short stature, onychodysplasia, facial dysmorphism, and hypotrichosis=csS; iris disease=cSs; bruck syndrome 2=css; mitochondrial complex iii deficiency, nuclear type 5=cSS; aberrant right subclavian artery=csT; spastic paraplegia 2, x-linked=cst; congenital absence of vagina=cSt; mitochondrial complex iii deficiency, nuclear type 4=cST; single umbilical artery=csU; urocanase deficiency=cSU; pelizaeus-merzbacher disease, atypical=csu; rufous oculocutaneous albinism=cSu; occult macular dystrophy=csv; skin/hair/eye pigmentation, variation in, 11=cSv; aberrant subclavian artery=cSV; intermittent ataxia=cSV; arthryposis multiplex congenita, distal, x-linked=cSw; familial porphyria cutanea tarda=cSW; premature ovarian failure 2b=csW; hypergranular promyelocytic leukemia=csw; dowling-degos disease 2=csX; homozygous porphyria cutanea tarda=cSX; loosening of prosthesis=csx mental retardation, x-linked, syndromeic, nascimento type=cSx; dowling-degos disease 4=csY; kaufman oculocerebrofacial syndrome=cSy; charcot-marie-tooth disease, type 2e=csy; disease attributes=cSY; charcot-marie-tooth disease, demyelinating, type 1e=csz; chromosome 15q, trisomy=cSz; hyperactive child=cSZ; colorectal cancer, susceptibility to, 10=csZ; congenital vascular anomaly=Ct; familial adenomatous polyposis=ct; pediatric disease or disorder=CT; chronic lymphocytic leukemia=cT; mandibular hypoplasia, deafness, progeroid features, and lipodystrophy syndrome=eta; hepatoerythropoietic porphyria=cTa; central nervous system tuberculosis=cTA; adrenal cortex disease=ctA; colorectal cancer, susceptibility to, 12=ctb; cutaneous porphyri=cTb; pancreatic endocrine carcinoma=ctB; neovascular glaucoma=cTB; deafness, autosomal recessive 18=cTc; subvalvular aortic stenosis=ctC; facial dysmorphism, immunodeficiency, livedo, and short stature=ctc; central retinal vein occlusion=cTC; xanthogranulomatous cholecystitis=cTD; usher syndrome, type ic=cTd; muscular dystrophy-dystroglycanopathy (limb-girdle), type c, 3=ctD; progressive external ophthalmoplegia with mitochondrial dna deletions, autosomal dominant, 4=ctd; retinitis pigmentosa 39=cTe; left ventricular diastolic dysfunction=cTE; progressive external ophthalmoplegia with mitochondrial dna deletions, autosomal recessive=cte; muscular dystrophy-dystroglycanopathy (congenital with mental retardation), type b, 3=ctE; erythrocytosis, familial, 2=cTF; muscular dystrophy-dystroglycanopathy (congenital with brain and eye anomalies), type a, 3=ctF; mental retardation, x-linked 99=cTf; progressive external ophthalmoplegia with mitochondrial dna deletions, autosomal dominant, 1=ctf; muscular dystrophy-dystroglycanopathy (congenital with brain and eye anomalies), type a, 8=ctG; mitochondrial dna depletion syndrome 4b (mngie type)=ctg; uv-sensitive syndrome 3=cTg; inferior myocardial infarction=cTG; arthrogryposis, renal dysfunction, and cholestasis 2=cTH; mitochondrial dna depletion syndrome 4a (alpers type)=cth; hydrocephalyu=ctH; amyotrophyic lateral sclerosis 8=cTh; vitamin k-dependent clotting factors, combined deficiency of, type 2=cTI; muscular dystrophy-dystroglycanopathy (congenital with brain and eye anomalies), type a, 12=ctI; spinal muscular atrophy, proximal, adult, autosomal dominant=cTi; ataxia neuropathy spectrum=cti; keratosis linearis with ichthyosis congenita and sclerosisng keratoderma=ctJ; spinal muscular atrophy, late-onset, finkel type=cTj; myopathy, x-linked, with excessive autophagy=cTJ; epilepsyia partialis continua=ctj; microphthalmia, syndromeic 11=cTk; parkinson disease 17=cTK; muscular dystrophy-dystroglycanopathy (limb-girdle), type c, 1=ctK; spinocerebellar ataxia with epilepsy=ctk; infertility/subfertility=ctl; muscular dystrophy-dystroglycanopathy (congenital with mental retardation), type b, 1=ctL; spastic paraplegia 53, autosomal recessive=cTL; cardiomyopathy, familial hypertrophyic, 15=cTl; cardiomyopathy, dilated, lw=cTm; xeroderma pigmentosum, variant type=ctm; muscular dystrophy-dystroglycanopathy (limb-girdle), type c, 2=ctM; syndactyly of toes=cTM; amyotrophyic lateral sclerosis 14, with or without frontotemporal dementia=cTn; mandibulofacial dysostosis, treacher collins type, autosomal recessive=ctn; gamma-cystathinnase deficiency=cTN; muscular dystrophy-dystroglycanopathy (congenital with mental retardation), type b, 2=ctN; treacher collins syndrome 2=cto; muscular dystrophy-dystroglycanopathy (congenital with brain and eye anomalies), type a, 2=ctO; atherosclerosis, susceptibility to=cTo; keratoconus 1=cTO; craniofacial anomalies and anterior segment dysgenesis syndrome=cTP; anophthalmia with pulmonary hypoplasia=ctp; agricultural workers' diseases=ctP; periodontal atrophy=cTp; microphthalmia, isolated 2=cTQ; sarcoid type granuloma=cTq; microvascular complications of diabetes, susceptibility to, 5=ctQ; leukodystrophy, hypomyelinating, with hypodontia and hypogonadotropic hypogonadism=ctq; enzyme activity finding=ctR; microphthalmia, isolated, with coloboma 3=cTR; leukodystrophy, hypomyelinating, 8, with or without oligodontia and/or hypogonadotropic hypogonadism=ctr; critical lower limb ischemia=cTr; retrograde menstruation=cTs; hypocortisolism secondary to another disorder=cts; pesticide poisoning=ctS; microphthalmia, cataracts, and iris abnormalities=cTS; von willebrand disease, type iic=cTT; antley-bixler syndrome with genital anomalies and disordered steroidogenesis=ctT; total retinal detachment=cTt; melanoderma=ctt; periodontitis, aggressive, 2=ctU; platelet aggregation, spontaneous=cTU; clinically significant macular edema=cTu; excessive drinking=ctu; acute bacterial endocarditis=cTv; obesity hypoventilation syndrome=ctv; pituitary hormone deficiency, combined, 1=ctV; von willebrand disease, type iid=cTV; congenital von willebrand's disease=cTW; conn adenoma=ctw; progressive hearing loss stapes fixation=ctW; abnormal yolk sac=cTw; micronodular adrenal hyperplasia=ctx; cervical abnormality=ctX; rotator cuff syndrome=cTx; montreal platelet syndrome=cTX; deafness, autosomal dominant 15=ctY; idiopathyic hypopituitarism=cty; acquired von willebrand's disease=cTY; tuberculosis=cTy; partial stenosis=cTZ; rubeosis iridis=cTz; apparent life-threatening event=ctz; polyembryoma=ctZ; endometrial carcinoma=cU; secondary acquired sideroblastic anemia=CU; pulmonary involvement=Cu; punctate palmoplantar keratoderma=cu; thrombocytopenia, x-linked, intermittent=cUa; mediastinum seminoma=cua; euthymic mood=cuA; schopf-schulz-passarge syndrome=cUA; odonto-onycho-dermal dysplasia=cUB; bardet-biedl syndrome 15=cUb; phenylketonuri=cub; retrograde amnesia=cuB; hypogonadotropic hypogonadism 14 with or without anosmia=cUc; wilms turner and radial bilateral aplasia=cuc; split-hand/foot malformation 6=cUC; *Mycoplasma pneumoniae* infections=cuC; sympathyomimetic disorder=cud; brazilian purpuric fever=cuD; osteogenesis imperfecta, type xv=cUD; nephronophthisis 13=cUd; noise-induced temporary threshold shift=cuE; bone mineral density guantitative trait locus 16=cUE; cranioectodermal dysplasia 4=cUe; dilated cardiomyopathy secondary to metabolic disorder=cue; hypertensive encephalyopathy=cuf; diverticuliti=cUF; central nervous system vasculitis=cuE; short-rib thoracic dysplasia 5 with or without polydactyly=cUf; tetra-amelia autosomal recessive=cUG; short-rib thoracic dysplasia 11 with or without polydactyly=cUg; carotid intimal medial thickness 1=cug; epicondylitis=cuG; cranioectodermal dysplasia 2=cUh; childhood myelodysplastic syndrome=cuh; sex reversal, female, with dysgenesis of kidneys, adrenals, and lungs=cUH; hereditary protein c deficiency=cuH; osteogenesis imperfecta, type ix=cui; homozygous protein c deficiency=cuI; short-rib thoracic dysplasia 7 with or without polydactyly=cUi; fuhrmann syndrome=cUI; brain stem cancer=cuj; glaucoma 1, open angle, g=cUj; heterozygous protein c deficiency=cuJ; al awadi syndrome=cUJ; dyskeratosis congenita, autosomal recessive, 3=cUK; maple syrup urine disease, mild variant=cuk; neurodegeneration with brain iron accumulation 5=cUk; homozygous protein s deficiency=cuK; homozygous variegate porphyria=cul; umbilical bleeding=cuL; short-rib thoracic dysplasia 8 with or without polydactyly=cUl; capsule opacification=cUL; preeclamptic toxemia=cuM; nephrotic syndrome, type 4=cUM; microcephaly 2, primary, autosomal recessive, with or without cortical malformations=cUm; variegate porphyri=cum; bartonellosis=cun; meacham syndrome=cUN; aleutian mink disease=cuN; kuzniecky syndrome=cUn; spinocerebellar ataxia 12=cuo; epilepsy, progressive myoclonic 5=cuO; amelogenesis imperfecta, hypomaturation type, iia3=cUn; meacham winn culler syndrome=cUO; cerebellar ataxia, mental retardation, and dyseguilibrium syndrome 2=cUp; myopia 22, autosomal dominant=cuP; tremor, limb=cup; bilateral wilms turner=cUP; progressive familial heart block, type ii=cuq; deafness, autosomal dominant 6=cUq; cardiomyopathy, familial hypertrophyic, 6=cuQ; defect of diaphragm=cUQ; multiple endocrine neoplasmia type=cur; glycogen storage disease of heart, lethal congenital=cuR; childhood kidney neoplasm=cUR; cataract 41=cUr; fasciculoventricular accessory pathyway=cuS; wolfram-like syndrome, autosomal dominant=cUs; renpenning syndrome 1=cus; skull base meningioma=cUS; cataract, nuclear total=cUt; von willebrand disease type 2a=cut; diabetes in old age=cuT; malignant epithelial mesothelioma=cUT; spinocerebellar ataxia, autosomal recessive 12=cUU; wiskott-aldrich syndrome 2=cUu; carbohydrate metabolic disorder=cuU; drug-induced immune thrombocytopenia=cuu; prolactinom=cuv; atrial myxoma, familial=cuV; scarred macula=cUV; pseudohypoaldosteronism, type iic=cUv; acre dysostosis 1 with or without hormone resistance=cuW; retinitis pigmentosa 36=cuw; pseudohypoaldosteronism, type iib=cUw; abiotrophy=cUW; angioedema induced by ace inhibitors, susceptibility to=cUX; pseudohypoaldosteronism, type iia=cUx large cell calcifying Sertoli cell turner=cuX brittle cornea syndrome 2=cux; anginedem=cUY; nuclear sclerosis=cuy; odontoonychodermal dysplasia=cUy; immunodeficiency, common variable, 9=cuY; nephronophthisis-like nephropathy I=cUZ; spinocerebellar ataxia 14=cuZ; tenth agenisi, selective, 4=cUz; chromosome 2, trisomy 2p=cuz; neuroblastoma=cV; necrotizing fasciitis=cv; angiodysplasia of colon=Cv; combined t cell and b cell immunodeficiency=CV; upper gi cancer=cVa; hypoglycemiac coma=cvA; infantile convulsions and paroxysmal choreoathetosis, familial=cva; nephrolithiasis, uric acid, susceptibility to=cVA; coloboma, uveal, with cleft lip and palate and mental retardation=cVb; hypogonadotropic hypogonadism 4 with or without anosmia=cvB; familial paroxysmal kinesigenic dyskinesia=cvb; nephronophthisis 14=cVB; retinitis pigmentosa 58=cVC; kallmann syndrome 4=cvC; myopathy, lactic acidosis, and sideroblastic anemia 2=cVc; severe combined immunodeficiency, autosomal recessive, t cell-negative, b cell-negative, nk cell-positive=cvc; hypogonadotropic hypogonadism 3 with or without anosmia=cvD; spinocerebellar ataxia, autosomal recessive 5=cVD; massive hepatic necrosis=cvd; t cell immunodeficiency primary=cVd; aortic aneurysm, familial thoracic 8=eve; kallmann syndrome, type 3, recessive=cvE; myopia 21, autosomal dominant=cVE; plasma cell myeloma/plasmacytoma=cVe; macular dystrophy, retinal, 2=cvF; skeletal defects, genital hypoplasia, and mental retardation=cVf; mental retardation, x-linked, znf711-related=cVF; dystonia 16=cvf; seborrhea-like dermatitis with psoriasisform elements=cVG; chromosome 1q43-q44 deletion syndrome=cVg; retinitis pigmentosa 41=cvG; microtia-anotia=cvg; mental retardation, autosomal dominant 22=cVh; stargardt disease 4=cvH; fetal resorption=cvh; mental retardation, x-linked 45=cVH; primrose syndrome=cVi; cone-rod dystrophy 12=cvI; macroprolactinoma=evi; acromelic frontonasal dysostosis=cVI; refractory angina=cvJ; immunodeficiency-centromeric instability-facial anomalies syndrome 2=cVj; idiopathyic hyperprolactinemia=cvj; pituitary mass=cVK; invasive pituitary adenoma=cvk; wieacker syndrome=cVk; multiple fibroadenomas of the breast=cvl; morphine dependency=cVl; thrombophilia due to protein s deficiency, autosomal dominant=cvL; thrombophilia due to protein s deficiency, autosomal recessive=cvM; mental retardation, x-linked 91=cVm; huntington disease-like 1=cvm; mental retardation, x-linked, syndromeic, raymond type=cVn; protein z deficiency=cvN; spongiform encephalyopathy with neuropsychiatric features=cvn; corneal dystrophy, fuchs endothelial, 6=cVo; retinitis pigmentosa 11=cVO; amyloidosis, cerebral, with spongiform encephalyopathy=cvo; corneal dystrophy, posterior polymorphous, 3=cVp; retinitis pigmentosa 18=cvP; cns degeneration=cvp; congenital ptosi=cVq; partial tetrasomy=cvq; retinitis pigmentosa 60=cvQ; eager acrofacial dysostosi=cVr; chromosome 15g, tetrasomy=cvr; retinitis pigmentosa 13=cvR; retinitis pigmentosa 7=cVS; diaphragmatic hernia 3=cVs; human transmissible spongiform encephalyopathyies, inherited=cvs; patterned dystrophy of retinal pigment epithelium=cvT; chronic wasting disease=cvt; diaphragmatic eventration=cVt; spastic paraplegia 33, autosomal dominant=cVu; peripheral retinal degeneration=cvU; scrapie=cvu; cystoid macular edem=cvV; kuru=cvv; dextrocardi=cVv; ciliary dyskinesia, primary, 22=cVw; arts syndrome=cvW; thrombophilia, hereditary, due to protein c deficiency, autosomal recessive=cvw; polydactyly, postaxial, type a6=cVx; thrombophilia, hereditary, due to protein c deficiency, autosomal dominant=cvx optic atrophy polyneuropathy deafness=cvX; deafness, x-linked 1=cvY; tenth agenisi, selective, 5=cVy; congenital thrombotic disease, due to protein c deficiency=cvy; renal thrombosis=cvz; phosphoribosylpyrophosphate synthetase superactivity=cvZ; microcephaly 10, primary, autosomal recessive=cVz; trypanosomiasis=CW; delayed sleep phase syndrome, susceptibility to=cw; cervical sguamous cell carcinoma=cW; dural arteriovenous fistula=Cw; dystonia 18=cwa; carcinoma-associated retinopathy=cwA; convulsions, benign familial infantile, 2=cwb; holoprosencephaly 7=cwB; acrofacial dysostosis, eager type=cwc; basal cell carcinoma, susceptibility to, 1=cwC; congenital absence of jaw=cwd; dentigerous cyst=cwD; mental retardation, autosomal recessive 1=ewe; jaw cysts=cwE; 9g22.3 microdeletion=cwF; autosomal dominant hereditary pancreatitis=cwf; open spina bifida=cwG; pancreatic symptom=cwg; lenz majewski hyperostotic dwarfism=cwH; gastroenteriti=cwh; macrocephaly autism syndrome=cwI; charcot-marie-tooth disease, demyelinating, type 4f=ewi; vacterl hydrocephaly=cwJ; metachromatic leukodystrophy due to saposin b deficiency=cwj; gaucher disease, atypical, due to saposin c deficiency=cwk; vater association with macrocephaly and ventriculomegaly=cwK; krabbe disease, atypical, due to saposin a deficiency=cwl; pten hamartoma turner syndrome with granular cell turner=cwL; phosphoserine aminotransferase deficiency=cwm; proteus-like syndrome (disorder)=cwM; cronkhite-canada syndrome=cwN; linitis plastica=cwn; arteriovenous graft=cwO; cardiomyopathy, dilated, 1u=cwo; alzheimer disease, familial, type 3=cwp; endometritis=cwP; alzheimer disease, familial, 3, with spastic paraparesis and apraxia=cwg; ampulla of vater adenocarcinoma=cwQ; alzheimer disease, familial, 3, with spastic paraparesis and unusual plagues=cwr; multilocular clear cell renal cell carcinoma=cwR; acne inverse, familial, 3=cws; cervical endometrioid adenocarcinoma=cwS; frontal lobe syndrome=cwt; coliti=cwT; diabetes mellitus, permanent neonatal, with cerebellar agenisi=cwU; disorientation=cwu; asthma-related traits, susceptibility to, 1=cwV; kluver-bucy syndrome=cwv; cardiomyopathy, dilated, 1v=cww; medulloblastoma of cerebellum=cwW; acne inverse, familial, 2=cwx; acute inflammatory demyelinating polyneuropathy=cwX; asthma, nasal polyps, and aspirin intolerance=cwY; ovarian dysgenesis 3=cwy; asthma, aspirin-induced, susceptibility to=cwZ; deficiency of phosphoserine phosphatase=cwz; thromboxane synthetase deficiency=Cx; body mass=cx; bronchus carcinoma=cX; pleural tuberculosis=CX; body temperature changes=cxa; choanal atresia and lymphedema=cxA; capillariasis=cxb; hereditary hemorrhagic telangiectasis=cxB; infection—suppurative=cxC; eccrine carcinoma=cxc; metastatic turners of the ewing's family=cxD; jansen type metaphyseal chondrodysplasia=cxd; failure of tenth eruption, primary=cxe; nephrotic syndrome, type 6=cxE; deafness, autosomal recessive 84a=cxF; eiken skeletal dysplasia=cxf; failure of tenth eruption=cxg; lipodystrophy, congenital generalized, type 4=cxG; 6-pyruvoyl-tetra hydro pterin synthase deficiency=cxH; chondrodysplasia blomstrand typ=cxh; hypophosphatasisa, adult=cxi; verheij syndrome=cxI; myopathy with lactic acidosis and sideroblastic anemia=cxJ; primary hypoparathyroidism=cxj; primary hyperthyroidism=cxk; allergy to fish=cxK; poliomayelitis, paralytic=cxL; senile osteoporosis=cxl; adynamic bone disease=cxm; rosselli-gulienetti syndrome=cxM; orofacial cleft 7=cxN; osteitis fibrosa=cxn; chondrodysplasia blomstrand type=cxo; ectodermal dysplasia-syndactyly syndrome 1=cxO; sclerocornea, autosomal recessive=cxP; brachydactyly, type e2=cxp; cutis laxa, autosomal recessive, type iib=cxQ; bone carcinoma=cxq; angiomyoma=cxr; cutis laxa, autosomal recessive, type iiib=cxR; sclerosisng hepatic carcinoma=cxs; posturing=cxS; hypertensive heart and renal disease=cxT; male turner syndrome=cxt; hyperandrogenis=cxU; stomach atrophy=cxu; martsolf syndrome=cxV; noonan like syndrome=cxv; warburg micro syndrome 3=cxW; heart displacement=cxw; cleft leaflet of mitral valve=cxx; warburg micro syndrome=cxX; secondary malignant neoplasm of lymph nodes of neck=cxY; hereditary oculoleptomeningeal amyloid angiopathy=cxy; cone-rod dystrophy 18=cxZ; communicating hydrocephalyus=cxz; mental condensation=Cy; metastatic melanoma=cY; asthma=cy; congenital hemolytic anemia=CY; histiocytoid hemangioma=cyA; smith-mccort dysplasia 2=cya; cone-rod dystrophy 11=cyB; mental retardation, x-linked 72=cyb; warburg micro syndrome 2=cyc; macular degeneration, age-related, 6=cyC; microphthalmia, isolated 3=cyD; martin-probst deafness-mental retardation syndrome=cyd; kaposi sarcoma, susceptibility to=cye; microcephaly with mental retardation and digital anomalies=cyE; neutrophyil immunodeficiency syndrome=cyf; tarp syndrome=cyF; grade iii meningioma=cyg; cardiomyopathy, dilated, ldd=cyG; cornealia de lange syndrome 4=cyh; alopecia, neurologic defects, and endocrinopathy syndrome=cyH; carcinoma of sigmoid colon=cyI; nijmegen breakage syndrome-like disorder=cyi; fanconi anemia, complementation group o=cyj; spermatogenic failure, nonobstructive, y-linked=cyJ; retinitis pigmentosa 66=cyK; breast-ovarian cancer, familial, susceptibility to, 3=cyk; retinal dystrophy, iris coloboma, and comedogenic acne syndrome=cyL; breast-ovarian cancer, familial, susceptibility to, 4=cyl; keratomalacia=cyM; mirror movements 2=cym; noonan syndrome 5=cyn; adams-oliver syndrome 3=cyN; leopard syndrome, 2=eye; visceral myopathy=cyO; benign struma ovarii=cyp; melanoma-associated retinopathy=cyP; leber congenital amaurosis 13=cyQ; alpha/beta t-cell lymphopenia with gamma/delta t-cell expansion, severe cytomaegalovirus infection, and autoimmunity=cyq; combined cellular and humoral immune defects with granulomas=cyr; leber congenital amaurosis 3=cyR; encephalyopathy, acute, infection-induced, susceptibility to, 3=cys; deafness, autosomal recessive, 24=cyS; tick-borne diseases=cyt; spastic paraplegia 31, autosomal dominant=cyT; neuronopathy, distal hereditary motor, type vb=cyU; hyperchloremia=cyu; myasthenic syndrome, congenital, with facial dysmorphism, associated with acetylcholine receptor deficiency=cyv; spastic paraplegia 72, autosomal recessive=cyV; microphthalmia, syndromeic 12=cyw; pancreas exocrine=cyW; norman roberts lissencephaly syndrome=cyX; pontocerebellar hypoplasia type=cyx; bilateral superior obligue palsy=cyY; capillary malformation-arteriovenous malformation=cyy; capillary malformation without arteriovenous malformation=cyz; hyperuricemiac nephropathy, familial juvenile 2=cyZ; myeloblastic leukemia=cZ; diamond-blackfan anemia=CZ; hereditary hemorrhagic telangiectasisa=Cz; autistic disorder=cz; brachydactyly with hypertension=cza; retina-diseases=czA; high-renin essential hypertension=czb; ebola hemorrhagic feve=czB; macrocephaly, alopecia, cutis laxa, and scoliosis=czC; cutaneous lichen amyloidosis=czc; popliteal pterygium syndrome, lethal type=czD; mucosal neuromas=czd; cocoon syndrome=czE; papillary carcinoma of the breast=cze; noonan syndrome 8=czF; thyroid nodule solitary=czf; thyroid hyalinizing trabecular adenoma=czg; bothnia retinal dystrophy=czG; newfoundland rod-cone dystrophy=czH; congenital disorder of glycosylation, type in=czh; bare lymphocyte syndrome, type ii, complementation group c=czi; combined oxidative phosphorylation deficiency 11=czI; bacterial sinusitis=czJ; bare lymphocyte syndrome, type ii, complementation group e=czj; mitchell-riley syndrome=czk; aicardi-goutieres syndrome 4=czK; aicardi-goutieres syndrome 2=czL; bare lymphocyte syndrome, type ii, complementation group b=czl; bare lymphocyte syndrome, type ii, complementation group d=czm; aicardi-goutieres syndrome 3=czM; leukoencephalyopathy, cystic, without megalencephaly=czN; retinitis pigmentosa 44=czn; autoimmune thrombocytopeniac purpur=czO; postmortem changes=czo; macrocephaly, macrosomia, facial dysmorphism syndrome=czP; bradyopsia=czp; hereditary renal cancer associated 1=czQ; rh-null, regulator type=czq; stomatocytosis i=czr; plagu=czR; ataxia, sensory, autosomal dominant=czS; keratosis palmoplantaris with esophageal cancer=czs; moyamoya disease 2=czT; rh-null disease, amorph type=czt; vesicoureteral reflux 2=czO; hemolytic disease of fetus or newborn due to rhd isoimmunization=czu; sarcoma, avian=czv; gaze palsy, familial horizontal, with progressive scoliosis=czV; horizontal gaze palsy=czW; acrodermatitis atrophyicans chronica=czw; kohlschutter tonz syndrome=czX; night blindness, congenital stationary, autosomal dominant 1=czx retinitis pigmentosa 4=czy; retinitis pigmentosa 7, digenic=czY; scotopic sensitivity=czz; robinow syndrome, autosomal recessive=czZ; sguamous cell carcinoma=d; hypercalcemia=D; inflammatory skin and bowel disease, neonatal=DA; encounter for body mass index {bmi}=dA; congenital hypoplastic anemia=Da; psoriasis=da; renal cell carcinoma=dB; trichomoniasis=Db; adjuvant disease=DB; gamma aminobutyric acid transaminase deficiency=db; niemann-pick disease, type b=dC; diabetic foot ulcer=DC; depressive disorder=dc; lymphopenia=Dc; cocaine-related disorders=dd; gestational trophoblastic neoplasm=Dd; hypercholesterolemia=dD; esophageal candidiasis=DD; dyskinesia, drug-induced=de; endocrine gland cancer=DE; adenosine deaminase deficiency=De; hypercholesterolemia, familial=dE; reflex, abnormal=df; peyronie's disease=Of; pulmonary function=DF; familial hypoalphalipoproteinemia=dF; psychomotor disorders=dg; familial hdl deficiency=dG; measles=Dg; inclusion body myositis=DG; arthritis, juvenile=dH; ischemia=dh; congenital hypoplasia=OH; tuberculous peritonitis=Dh; recurrence=dI; polyarteritis nodosa=Di; hypertension=di; bronchiolitis, viral=Dl; mood disorder=dj; membranoproliferative glomerulonephritis, x-linked=dJ; xeroderma pigmentosum=Dj; respiratory syncytial virus bronchiolitis=DJ; hypertriglyceridemia=dK; status epilepticus=dk; asthma chronic=DK; reticular dysgenesis=Dk; nasal allergy=DL; infantile epileptic encephalyopathy=dl; alzheimer disease 18=Dl; steatohepatitis=dL; respiratory syncytial virus infectious disease=DM; familial alzheimer disease=Dm; reflex epilepsy=dm; microalbuminuria=dM; endothelial dysfunction=dN; cone-rod dystrophy 9=DN; gastroesophageal reflux disease=dn; cardiac dilatation=Dn; skin melanoma=DO; narcolepsy=do; lymphanqiosis carcinomatosa=Do; carotid atherosclerosis=dO; allerqic disposition=dP; breast fibroadenoma=DP; candidiasis=Dp; lamellar ichthyosis, type 2=dp; harlequin type ichthyosis=dq; microspherophakia=DQ; relapsing-remitting multiple sclerosis=Dq; respiratory syncytial virus (rsv)=dQ; papillary carcinoma=Dr; nevus elasticus=dr; channelopathyies=dR; agueous humor disorders=DR; weill-marchesani syndrome=DS; coronary atherosclerosis=dS; recovery of function=ds; reticulate acropigmentation of kitamur=Ds; malignant neoplasm of female breast=dT; genetic disease=dt; cancer recurrence=Dt; airway disease=DT; turner vasculature=dU; atherosclerosis=du; chronic ulcer=Du; ataxia with vitamin e deficiency=DU; arteriosclerosis=dv; complement factor h deficiency=DV; edwards syndrome=Dv; ganglion cysts=dV; von willebrand disease type 2b=DW; congenital ichthyosisform erythroderma=dw; external hyperostosis=Dw; diseases in twins=dW; drusen=dX; arteriosclerotic cardiovascular disease=dx; mammary carcinoma, human=Dx; thrombotic thrombocytopeniac purpura, acquired=DX; acute disease=DY; pseudoxanthoma elasticum=dy; inflammatory joint disease=Dy; coinfection=dY; osteophyte=Dz; cednik syndrome=dz; congenital deficiency=DZ; synovial cyst=dZ; tongue sguamous cell carcinoma=e; bladder transitional cell carcinoma=E; gastric ulcer=eA; lumbar disc prolapse=EA; single organ dysfunction=Ea; photoreceptor degeneration=ea; meningococcemia=Eb; corneal neovascularization=EB; amnestic disorder=eB; neutrophyilia=eb; malignant state=Ec; familial disease=ec; membranous glomerulonephritis=eC; geleophysic dysplasia 1=EC; henoch-schoenlein purpura=eD; vascular inflammations=ed; acromicric dysplasia=ED; familial thrombotic thrombocytopeniac purpura=Ed; dermatitis=eE; arterionephrosclerosis=Ee; hand deformities, congenital=EE; memory loss=ee; pneumocystosis=eF; microangiopathyic hemolytic anemia=Ef; high density lipoprotein deficiency=ef; geleophysic dysplasia=EF; endometriosis=eG; anthrax disease=Eg; middle east respiratory syndrome=eg; ectopia lentis 2, isolated, autosomal recessive=EG; familial hyperlipidemia=eH; immunoglobulin g2 deficiency=eh; ectopia lentis isolated=EH; thrombotic thrombocytopeniac purpura=Eh; myotonic dystrophy type 1=eI; primary antiphospholipid syndrome=ei; thrombocytopenia=Ei; ectopia lentis with ectopia of pupil=EI; ectopia lentis, isolated, autosomal recessive=EJ; disseminated intravascular coagulation=Ej; creutzfeldt-jakob disease=eJ; extramedullary hematopoiesis=ej; neurogenic hypertension=ek; simple ectopia lentis=EK; pulmonary alveolar proteinosis=eK; membranoproliferative glomerulonephritis=Ek; cutaneous mastocytosis=eL; placental malformation=el; nfl microdeletion syndrome=EL; purpura=El; autoimmune thrombocytopeniac purpura=Em; neurofibromatosis=EM; aplastic anemia=eM; disease of metabolism=em; influenza=en; hepatitis d=EN; ehlers-danlos syndrome, type vii, autosomal recessive=En; blood coagulation disease=eN; body fat distribution=Eo; carotid artery disease=eO; prion disease=eo; aicardi-goutieres syndrome=EO; intracranial arteriosclerosis=eP; lipid storage disease=ep; weill-marchesani-like syndrome=Ep; aicardi-goutieres syndrome 6=EP; congenital disorder of glycosylation=eq; aicardi goutieres syndrome=EQ; eclampsia=eQ; index myopia=Eq; familial hypercholesterolemia=eR; lymphocytic choriomeningitis=ER; knobloch syndrome=Er; glaucoma=er; microcornea, myopiac chorioretinal atrophy, and telecanthus=Es; reticulate acropigmentation of kitamura=ES; hypolipoproteinemia=eS; peripheral primitive neuroectodermal turner=es; mental retardation, autosomal recessive 36=ET; kidney disease=et; tangier disease=eT; sexual dysfunctions, psychological=Et; spinocerebellar ataxia, autosomal recessive 9=EU; severe combined immunodeficiency=eu; carcinoma, lewis lung=Eu; norum disease=eU; hypoglossal nerve injuries=Ev; coenzyme q10 deficiency, primary, 1=EV; aortic atherosclerosis=ev; *Plasmodium falciparum* malaria=eV; psychotic symptom=Ew; coenzyme q10 deficiency=EW; cerebral malaria=eW; plague=ew; metabolic syndrome x=eX; adrenoleukodystrophy=ex ehlers-danlos syndrome=Ex ataxias=EX; post-traumatic stress disorder=Ey; cholesterol ester storage disease=eY; hyperglycemia=ey; nephrotic syndrome, type 9=EY; niemann-pick disease=eZ; primary open angle glaucoma=ez; laryngeal sguamous cell carcinoma=Ez; pseudohypoparathyroidism, type ia=EZ; head and neck sguamous cell carcinoma=F; stress (psychology)=f; hypercalciuria, absorptive, 2=Fa; sebaceous adenocarcinoma=fA; smith-lemli-opitz syndrome=fa; chondroma=FA; pseudohypoparathyroidism=Fb; ehrlich turner carcinoma=fB; endolymphatic hydrop=FB; thoracic cancer=fb; severe chronic obstructive pulmonary disease=Fc; mitral valve stenosis=fc; leber hereditary optic neuropathy=fC; spherocytosis, type 1=FC; chronic kidney failure=fD; hand skill, relative=FD; menkes disease=fd; olfaction disorders=Ed; dyskinesia, familial, with facial myokymia=Fe; attention deficit hyperactivity disorder=FE; female breast carcinoma=fE; nephroblastoma=fe; cystic kidne=Ff; intestinal volvulus=fF; kidney cancer=ff; perineurioma=FF; sezary's disease=fG; biliary atresia=EG; electrocardiogram (ekg, ecg)=Eg; chronic myeloproliferative disease=fg; brain ischemia=fh; alpers syndrome=FH; alpha-thalassemia=Fh; hodgkin's lymphoma=fH; colon adenocarcinoma=fi; herpes simplex=fI; endolymphatic hydrops=FI; urinary bladder, overactive=Fi; miosis=Fj; hodgkin's granuloma=fJ; bale concentric sclerosis=FJ; bloom syndrome=fj; myeloid sarcoma=FK; wilson disease=fK; glycogen storage disease i=fk; pancreatitis, acute necrotizing=Fk; pulmonary large cell neuroendocrine carcinoma=FL; cerebral amyloid angiopathy=fL; facial nerve injuries=Fl; iga glomerulonephritis=fl; partial trisomy=Fm; gastrointestinal stromal turner=fM; emery-dreifuss muscular dystrophy=FM; antiphospholipid syndrome=fm; chronic granulomatous disease=fn; fatty liver disease=fN; myeloma kidney=Fn; carcinoma, anaplastic=FN; multiple myeloma=fO; cystitis=Fo; polymicrogyria, bilateral frontoparietal=FO; syringomyelia=fn; embryonal carcinoma=fp; inflammatory bowel disease=fP; ehlers-danlos syndrome, type iv, autosomal dominant=FP; sudden infant death syndrome=Fp; polymicrogyria, bilateral perisylvian, autosomal recessive=FQ; simpson-golabi-behmel syndrome=fQ; atopic dermatitis=fq; symptoms of stress=Fq; prostate adenocarcinoma=Fr; congenital anomaly of brain=FR; osteosarcoma=fr; paroxysmal nocturnal hemoglobinuria=fR; chylomicron retention disease=fS; cobblestone complex=FS; fibrosarcoma=fs; oligodendroglioma=Fs; bone osteosarcoma=ft; lissencephaly=FT; low grade glioma=fT; xerocytosis, hereditary=Ft; intracranial thrombosis=fu; lung small cell carcinoma=fU; secondary hyperparathyroidis=FU; hypernatremia=Fu; gastroschisis=Fv; scoliosis, idiopathyic, susceptibility to, 1=FV; pancreas adenocarcinoma=fv; surfactant metabolism dysfunction, pulmonary, 3=fV; adolescent idiopathyic scoliosis=FW; conn's syndrome=Fw; respiratory tract diseases=fW; cerebral infarction=fw; gastriti=FX; surfactant dysfunction=fX; bladder carcinoma=fx; meniere's disease=Fx; familial combined hyperlipidemia=Fy; interstitial fibrosis=fY; non-small cell lung carcinoma=fy; behavior disorder=FY; autosomal dominant lateral temporal lobe epilepsy=FZ; chronic interstitial lung disease=fZ; hyperaldosteronism=Fz; coronary stenosis=fz; brain cancer=g; acute lymphocytic leukemia=G; alcohol abuse or dependencye=GA; placenta disease=gA; rds—infants=ga; usher syndrome, type 2c=Ga; laryngeal benign neoplasm=GB; pulmonary interstitial glycogenosis=gb; cholestasis=gB; febrile convulsions, familial, 4=Gb; wernicke-korsakoff syndrome=GC; persistent pulmonary hypertension=gc; usher syndrome, type iic, gpr98/pdzd7, digenic=Gc; sclerosisng cholangitis=gC; decompression sickness=Gd; pneumonia=gd; intrahepatic cholestasis=gD; larynx cancer=GO; atrophy of testis=GE; hepatitis c=gE; benzodiazepines causing adverse effects in therapeutic use=Ge; neonatal respiratory failure=ge; poisoning by benzodiazepine-based tranguilizer=Gf; hyperinsulinism=gF; conduct disorder=GE; adult respiratory distress syndrome=gf; usher syndrome type 2=Gg; macrocytic anemia=GG; pulmonary fibrosis=gg; cholangiocarcinoma=gG; persistent fetal circulation syndrome=gh; ornithine carbamoyltransferase deficiency=gH; afebrile seizure=Gh; alcoholic neuropathy=GH; arthritis, experimental=gI; desguamative interstitial pneumonia=gi; alcohol abuse=GI; audiogenic seizure=Gi; essential tremor=GJ; renal insufficiency=gJ; substance addiction=Gj; allergic contact dermatitis=gj; xanthoma tendinosum=Gk; liver cirrhosis, experimental=gK; alzheimers disease with late onset=gk; alcohol dependencye=GK; enzyme inhibition=Gl; lupus erythematosus=gl; nicotine dependencye=GL; infection=gL; b-cell lymphoma=gm; pharynx cancer=GM; prenatal exposure delayed effects=Gm; drug hypersensitivity=gM; *Helicobacter* infections=gN; alcohol withdrawal syndrome=Gn; sjogren's syndrome=gn; cocaine dependency=GN; streptococcal lymphadenitis of swine=GO; afibrinogenemia congenital=go; renal insufficiency, chronic=gO; alcohol-related disorders=Go; drug-related side effects and adverse reactions=gP; sjogren-larsson syndrome=GP; gallbladder disease 1=gp; cocarcinogenesis=Gp; oropharynx cancer=GQ; cholestasis, progressive familial intrahepatic 2=gq; alcohol-induced disorders=Gq; nonmedullary thyroid carcinoma, with or without cell oxyphilia=gQ; heavy drinking=Gr; parkinson disease, late-onset=GR; cholestasis, benign recurrent intrahepatic, 2=gr; multicystic renal dysplasia, bilateral=gR; birth defects=Gs; multiple system atrophy=GS; inflammatory bowel disease 13=gS; endotoxemia=gs; alcohol use disorder=Gt; succinic semialdehyde dehydrogenase deficiency=GT; liver neoplasms, experimental=gt; neoplasmtic processes=gT; intrahepatic cholestasis of pregnancy=gu; disease of metabolis=GU; sensory discomfort=Gu; postoperative complications=gU; alcohol affecting fetus or newborn via placenta or breast milk=Gv; choroidal neovascularization=GV; cirrhosis=gv; femur head necrosis=gV; associated symptom=Gw; hot spots=gw; hiv-associated lipodystrophy syndrome=GW; colchicine resistance=gW; cholemia=gx; colorectal cancer metastatic=gX; drunk driving=Gx; adiponectin, serum level of, quantitative trait locus 3=GX; hazardous drinking=Gy; adiponectin, serum level of, quantitative trait locus 1=GY; chronic ulcerative colitis=gY; chronic hepatic failure=gy; depressive symptom=gZ; pancreatitis, calcific=Gz; adiponectin, serum level of, quantitative trait locus 2=GZ; intestinal disease=gz; acute myeloid leukemia=h; parkinson disease 2, autosomal recessive juvenile=H; macular fibrosis=HA; kidney replaced by transplant=ha; obesity, visceral=Ha; prostatic hypertrophy=hA; androgen independent prostate cancer=hb; withdrawal sign or symptom=hB; hypoadiponectinemia=Hb; asphyxia neonatorum=HB; ovarian cancer stage=hC; primary hyperparathyroidism=HC; steroid-resistant nephrotic syndrome=hc; headache disorders=Hc; insulin resistance in diabetes=Hd; diabetic ketoacidosis=HD; acute myeloid leukemia arising from previous myelodysplastic syndrome=hD; glucocorticoid receptor deficiency=hd; psychosis=he; carotid artery plague=He; ens depression=hE; teratocarcinoma=HE; diabetes mellitus risk=Hf; acute retinal necrosis syndrome=HF; drug withdrawal syndrome=hF; cytogenetically normal acute myeloid leukemia=hf; retroviridae infections=hg; pediatric aids=hG; pilocytic astrocytoma=HG; microalbuminuric diabetic nephropathy=Hg; choroid plexus carcinoma=HH; clear-cell metastatic renal cell carcinoma=hh; lipodystrophy=Hh; sexual dysfunction=hH; varicose veins=HI; Philadelphia chromosome positive chronic myelogenous leukemia=hi; glucose metabolism disease=Hi; testicular carcinoma=hI; proliferative vitreoretinopathy=HJ; sarcoma, metastatic=hJ; cardiac event=hj; arteriosclerosis obliterans=Hj; ileitis=HK; erythroblastosis=Hk; postoperative nausea=hK; postoperative nausea and vomiting=hk; breast cancer, lobular=hl; hypoxia-ischemia, brain=HL; adiponectin deficiency=Hl; sphenoid wing meningioma=hL; pouchitis=hm; hypothyroidism=hM; hypermethioninemia due to adenosine kinase deficiency=Hm; optic nerve injuries=HM; neutropenia=hN; tauopathy=HN; absence of pain sensation=hn; visceral steatosis, congenital=Hn; urinary system benign neoplasm=hO; hearing loss, bilateral=HO; menopause present=ho; tenth eruption=Ho; recurrent seizures=Hp; skin toxicity=hp; osteosclerosis=HP; gastrointestinal system cancer=hP; vogt-koyanagi-harada disease=HQ; adrenal gland cancer=Hq; heart septal defect=hQ; early pregnancy=hq; heart disease=hR; vitreoretinopathy, neovascular inflammatory=Hr; carney complex=HR; pancolitis=hr; epilepsy syndrome=hS; nerve degeneration=HS; heart-cancer=hs; renal fibrosis=Hs; hiv-infection/aids=ht; gastrointestinal tract vascular insufficiency=Ht; epilepsy, post-traumatic=HT; brain disease=hT; dysglycemia=Hu; myopia 2=HU; glomerulonephritis=hU; abnormal renal function=hu; thyroid carcinoma=hV; bipolar ii disorder=Hv; tardive dyskinesia=HV; drug usage=hv; hippocampal sclerosis=hw; disease of mental healtyh=hW; chronic progressive chorea=HW; syndrome of infant of diabetic mother=Hw; hematologic cancer=hX; stricture of artery=Hx monocytic leukemia=hx; abnormal involuntary movement=HX; schizephrenia and related disorders=hy; idiopathyic generalized epilepsy=hY; medullary turners=Hy; renal interstitial fibrosis=HY; swelling of limb=Hz; steroid-sensitive nephrotic syndrome=hz; encephalyitis=hZ; phobic disorder=HZ; urinary bladder cancer=i; type 2 diabetes mellitus=I; lesch-nyhan syndrome=Ia; osteonecrosis=ia; endometrial cancer=iA; aids-related complex=IA; lipoma=ib; myasthenia gravis=iB; lingual-facial-buccal dyskinesia=Ib; hyperexplexia=IB; skin benign neoplasm=ic; fabry disease=iC; epileptic encephalopathy=IC; hypercholesterolemia, autosomal recessive=Ic; acute myocardial infarction=id; chondrodysplasia=ID; childhood absence epilepsy=Id; malignant peripheral nerve sheath turner=iD; x-linked ichthyosis=iE; lymphoblastic leukemia=ie; congenital long qt syndrome=Ie; anti-neutrophyil cytoplasmic antibody-associated vasculitis=IE; acguired porencephaly=IF; pituitary cancer=iF; prolymphocytic leukemia=if; sciatica=If; malignant mesothelioma=iG; congenital scoliosis=IG; low tension glaucoma=Ig; celiac disease=ig; age-related cognitive decline=IH; anxiety disorder=ih; bladder neck obstruction=Ih; peritoneal carcinoma=iH; hyperthyroidism=ii; alport syndrome, x-linked=Ii; asymptomatic bacteriuria=II; cannabis dependencye=iI; chronic inflammatory disorder=IJ; malignant fibroxanthoma=iJ; lymphadenitis=ij; hypokalemic periodic paralysis, type 1=Ij; esophageal cancer=ik; spastic=IK; night blindness, congenital stationary, type 2a=Ik; leiomyosarcoma=iK; ehlers-danlos syndrome type 2=Il; esophageal carcinoma=il; hepatitis b=iL; homozygous alpha thalassemia=IL; drug habituation=IM; kniest dysplasia=Im; vasculitis=im; kernicterus=iM; generalized epilepsy with febrile seizures plus, type 2=In; uterine cancer=in; opiate dependencye=iN; lymphocytic infiltration=IN; contracture of joint=IO; hyperpigmentation, familial progressive=Io; gastroparesis=io; papillary serous adenocarcinoma=iO; arterial aneurysm=IP; head and neck cancer=ip; tn syndrome=Ip; benign mesothelioma=iP; hemiplegiac migraine, familial type 1=Iq; spleen cancer=iQ; osteogenesis imperfecta, type 1a=IQ; thyroid gland disease=iq; spinocerebellar ataxia 6=Ir; deficiency of trypsin=IR; agranulocytosis=ir; transitional cell carcinoma=iR; gallbladder cancer=is; selective iga deficiency disease=IS; spondyloepiphyseal dysplasia tarda, x-linked=Is; liver sarcoma=iS; bilirubin metabolic disorder=it; varicocele=IT; porencephaly=It; cervical cancer=iT; mucopolysaccharidosis iii=IU; pulmonary tuberculosis=iU; pelvic organ prolapse=Iu; graves' disease=iu; acute leukemia=iv; stiff-person syndrome=IV; muscle eye brain disease=Iv; familial mediaterranean fever=iV; skin sarcoidosis=IW; leukopenia=iw; thyrotoxic periodic paralysis=Iw; balkan nephropathy=iW; hypochondrogenesis=Ix; behcet's disease=ix; central nervous system lymphoma=iX; excessive tearing=IX; tuberous sclerosis=iy; osteopeniac nonfracture syndrome=Iy; chordoma=iY; interstitial cystitis=IY; addison's disease=iz; temporal lobe epilepsy=iZ; hypokalemic periodic paralysis=IZ; urinary incontinence, stress=Iz; systemic scleroderma=j; leukemia=J; pleomorphic liposarcoma=jA; lipoid proteinosis=Ja; breast adenocarcinoma=ja; resting heart rate=JA; invasive lobular carcinoma=jb; type i ehlers-danlos syndrome=Jb; hepatoblastoma=jB; social fear=JB; uveal melanoma=jC; hemangioma=JC; diffuse scleroderma=Jc; gallbladder carcinoma=jc; chronic interstitial cystitis=Jd; acguired immunodeficiency syndrome=jD; capillary hemangioma=JD; meningioma=jd; toxic encephalopathy=je; liver carcinoma=jE; 5q-syndrome=JE; scleredema adultorum=Je; respiratory hypersensitivity=JF; parathyroid adenoma=jF; ovary adenocarcinoma=jf; cutis laxa=Jf; granuloma annulare=Jg; vestibulocochlear nerve injuries=JG; chronic myeloid leukemia=jG; pyruvate carboxylase deficiency disease=jg; scleroderma=Jh; ulcerative colitis=jH; psoriasis vulgaris=JH; esophagus sguamous cell carcinoma=jh; lung adenocarcinoma=ji; chromosome 5, trisomy 5g=JI; leiomyomatosis=Ji; lymphosarcoma=jI; psychological distress=JJ; prolactinoma=Jj; adrenocortical carcinoma=jj; anorexia nervosa=jJ; adrenal cortex cancer=jk; oral submucous fibrosis=Jk; megakaryocytic leukemia=jK; parasitic diseases=JK; acute monocytic leukemia=jL; uterine corpus sarcoma=jl; dermatitis herpetiformis=Jl; asthma night-time symptoms=JL; coronary restenosis=jm; peak expiratory flow rate=JM; malignant hyperthermia=Jm; nasopharynx carcinoma=jM; eosinophilia-myalgia syndrome=Jn; phototoxic dermatitis=jn; cannabis abuse=jN; allergic sensitization=JN; renal carcinoma=jo; pregnancy related=JO; immunoglobulin alpha deficiency=Jo; neonatal abstinence syndrome=jO;

mucoepidermaoid carcinoma=jp; heavy chain disease=Jp; herein dependencye=jP; signs and symptoms, respiratory=JP; adult t-cell leukemia=jQ; acth-independent macronodular adrenal hyperplasia=Jq; benign ependymoma=jq; acute asthma=JQ; medulloblastoma=jR; visceral pain=Jr; juvenile myoclonic epilepsy=jr; asthma adult onset=JR; myocardial failure=JS; gamma chain deficiency=jS; bronchiolo-alveolar adenocarcinoma=js; substance use=Js; lymphoma=jT; inattention=Jt; extraosseous ewings sarcoma-primitive neuroepithelial tumor=jt; rheumatic mitral stenosis=JT; non-cardiogenic pulmonary edema=JU; alcoholic pancreatitis=ju; colitis=jU; motion sickness=Ju; vasoconstriction=Jv; acute promyelocytic leukemia=jV; mild persistent asthma=JV; schizoaffective disorder=jv; cholestasis, progressive familial intrahepatic 3=jW; neoplasm of uncertain behavior of mediastinum=Jw; premature ovarian failure=jw; nocturnal cough=JW; functional gastrointestinal disorder=Jx; bacterial meningitis=JX; scott syndrome=jX; synovial sarcoma=jx; gastric adenocarcinoma=JY; cholestasis, intrahepatic, of pregnancy 3=jY; adult acute lymphocytic leukemia=jy; constipation=Jy; hydrophthalmos=JZ; acute t cell leukemia=jz; cocaine abuse=Jz; hepatitis b, chronic=jZ; astrocytoma=k; digeorge syndrome=K; mucopolysaccharidosis=kA; trachoma=Ka; cholesterol gallstones=ka; mental handicap=KA; chondrosarcoma=kB; advanced cirrhosis=kb; acanthosis nigricans=Kb; fraxa=KB; diarrheal disorder=kc; dental caries=kC; rhinitis=Kc; congenital disorders=KC; borderline mental retardation (i.g. 70-85)=KD; microphthalmia=kD; portal fibrosis=kd; status asthmaticus=Kd; tetanus=kE; inguinal hernia=Ke; speech delay=KE; stage, chronic lymphocytic leukemia=ke; cholestasis chronic=kf; polycystic ovary syndrome=kF; moderate mental retardation (i.g. 35-49) =KF; lipodystrophy, congenital generalized, type 2=Kf; limb-girdle muscular dystrophy=kG; precocious pubarche=Kg; developmentaldelayed=KG; obstructive jaundice=kg; lipoatrophyic diabetes=Kh; language delay=KH; coloboma=kH; cholangitis=kh; multiple symmetrical lipomatosis=Ki; mental deficiency=KI; cholecystitis=ki; aniridia=kI; embryo loss=Kj; foot tapping=KJ; pancreatic ductal adenocarcinoma=kJ; calcification of joints and arteries=kj; fragile x syndrome=KK; gerstmann-straussler-scheinker syndrome=kK; brooke-spiegler syndrome=kk; cardiac function, impaired=Kk; telangiectatic osteogenic sarcoma=kL; microphthalmia, isolated, with coloboma 7=kl; hypertensive left ventricular hypertrophy=Kl; machado-joseph disease=KL; actinic keratosis=kM; dyschromatosis universalis hereditaria 3=km; acromegaly=Km; occipital lobe neoplasm=KM; atrophyic gastritis=kN; immune suppression=kn; whim syndrome=Kn; kennedy's disease=KN; blood group, langereis system=kn; fatal familial insomnia=kD; adenylosuccinate lyase deficiency=Ko; spinocerebellar ataxia 28=KO; creutzfeldt-jakob disease, sporadic=kp; costello syndrome=kP; spastic ataxia 5, autosomal recessive=KP; acute type b viral hepatitis=Kp; dyschromatosis universalis hereditaria=kD; chiari malformation type i=kg; oculomotor apraxia=KQ; argininosuccinic aciduria=Kq; hereditary ataxia=KR; anemia, sideroblastic spinocerebellar ataxia=kR; eczema herpeticu=Kr; variant creutzfeldt-jakob disease=kr; memories=Ks; creutzfeldt-jakob disease, familial=ks; intelligence quantitative trait locus 1=KS; cerebellar ataxia=kS; refractory anemia (clinical)=kT; parasitemia=kt; unable to balance=KT; chronic infectious disease=Kt; acute infectious disease=Ku; caries=ku; pathologic nystagmus=KU; sideroblastic anemia=kU; autosomal dominant cerebellar ataxia=kV; chronic plague-like oral candidiasis=kv; cogan syndrome=KV; mutyh-associated polyposis=Kv; dream disorder=kw; spindle cell sarcoma=Kw; ptosis=KW; mitochondrial metabolism disease=kW; acute respiratory infections=kx; spinocerebellar ataxia, autosomal recessive 1=KX; spinocerebellar ataxia 1=Kx; thrombocytosis=kX; fraxe=Ky; central nervous system disease=ky; triple negative breast neoplasms=kY; nephrosis, congenital=KY; spinobulbar atrophy=Kz; renal tubular disorder=kZ; spinal muscular atrophy=kz; alpha-fetoprotein deficiency=KZ; bernard-soulier syndrome=L; chronic obstructive pulmonary disease=l; alpha-fetoprotein, hereditary persistence of=La; apocrine gland secretion, variation in=la; umbilical hernia=LA; cartilage-hair hypoplasia=lA; promyelocytic leukemia=lb; sex chromosome aberrations=Lb; omphalocel=LB; duodenitis=lB; lichen planus=lC; restenosis=lc; liver regeneration=Lc; hypoparathyroidism familial isolated=LC; androgenetic alopecia=LD; genetic syndrome=Ld; juvenile dermatomyositis=ld; toxic hepatitis=lD; congenital, hereditary, and neonatal diseases and abnormalities=LE; multiple turners=Le; *Pseudomonas aeruginosa* infection=le; salmonella infections=lE; bromhidrosis=lf; delayed renal graft function=lF; storage disease=LE; uv-sensitive syndrome=Lf; severe diarrhea=lG; abdominal sepsis=lg; nonseminomatous germ cell turner=Lg; lysosomal storage disease=LG; turner thrombus=Lh; bone marrow toxicity=lH; aspartylglucosaminuri=LH; bacterial keratitis=lh; neurilemmoma=LI; pneumonia due to *Klebsiella pneumoniae*=li; viral infectious disease=lI; autoimmune liver disease=Li; benign neoplasm of liver=Lj; corneal disease=lj; corneal dystrophy, fuchs endothelial, 8=LJ; tethered spinal cord syndrome=lJ; myositis=lk; constrictive pericarditis=lK; fuchs' endothelial dystrophy=LK; agnosia=Lk; hyperoxia=LL; intestinal cancer=Ll; sweat gland disease=ll; focal epilepsy=lL; extrahepatic cholestasis=lM; peritoneal fibrosis=LM; oculocerebrorenal syndrome=Lm; spondyloarthropathy=lm; keratitis=ln; cutaneous porphyria=Ln; lung injury=LN; bile duct cancer=lN; clear cell adenocarcinoma=LO; endodermal sinus turner=Lo; kawasaki disease=lo; aortic calcification=LO; focal nodular hyperplasia=lP; papilloma=lp; aa amyloidosis=LP; gonadal disease=Lp; bone peripheral neuroepithelioma=lQ; cnckayne syndrome=Lq; thromboangiitis obliterans=LQ; childhood type dermatomyositis=lq; pulmonary hypertension, primary, 1=lR; skin atrophy=lr; germ cell and embryonal cancer=Lr; idiopathyic pulmonary fibrosis=LR; limb ischemia=LS; finnish lethal neonatal metabolic syndrome=ls; pulmonary arterial hypertension=lS; denys-drash syndrome=Ls; metaphyseal chondrodysplasia=lt; testicular germ cell cancer=Lt; klippel-trenaunay syndrome=LT; secretory diarrhea=lT; dysgerminoma=Lu; right ventricular failure=lU; cataract and cardiomyopathy=LU; increased drug resistance=lu; testicular malignant germ cell cancer=Lv; cataract 38=LV; t-cell leukemia=lv; substance-related disorder=lV; ganglioglioma=Lw; arteriovenous malformation=lw; latent tuberculosis=LW; pulmonary hypertension=lW; spinal cancer=lx; malignant teratoma=Lx; active tuberculosis=LX; primary pulmonary hypertension=lX; platelet storage pool deficiency=lY; pancreatic acinar cell adenocarcinoma=Ly; pallister-hall syndrome=LY; dubin-johnson syndrome=ly; autoimmune thyroiditis=Lz; hermansky-pudlak syndrome=lZ; buruli ulcer disease=LZ; alcoholic liver cirrhosis=lz; myeloid leukemia=M; systemic lupus erythematosus=m; neuronopathy, distal hereditary motor, type v=Ma; gestational diabetes=mA; acguired long qt syndrome=MA; reperfusion injury=ma; bone destruction=mb; iga nephropathy, progression to renal failure in, susceptibility to=MB; lipodystrophy, partial, acguired=Mb; neonatal diabetes mellitus=mB; hyperinsulinemiac hypoglycemia=mC; hypertriglyceridemic waist=MC; lipodystrophy, congenital generalized, type 1=Mc; ischemiac cardiomyopathy=mc; primary angle-closure glaucoma=md; insulinoma=mD; renal anemia=MD; spastic paraplegia 17=Md; brain edema=mE; lesion of brain=ME; arterial calcification of infancy=me; silver-russell syndrome=Me; thrombotic stroke=MF; rhizomelic chondrodysplasia punctata, type 3=Mf; beckwith-wiedemann syndrome=mF; arterial calcification, generalized, of infancy, 2=mf; multisystem disorder=mg; sarcoma, experimental=Mg; cantu syndrome=mG; bleeding ulcer=MG; low-renin essential hypertension=MH; metabolic disturbance=mh; rhizomelic chondrodysplasia punctata=Mh; cardiomyopathy, dilated. Io=mH; renin induced hypertension=MI; mendelian disorders=mi; hormone refractory prostate cancer=Mi; primary idiopathyic dilated cardiomyopathy=mI; atrial fibrillation, familial, 12=mJ; retinal toxicity=mj; staphylococcal toxic shock syndrome=Mj; multi vessel coronary artery disease=MJ; skin disease=mk; myocardial infarction, susceptibility to, 1 (finding)=mK; bullous impetigo=Mk; mesial temporal sclerosis=MK; pancreatic intraepithelial neoplasmia (panin) =Ml; renin-dependent hypertension=ML; fibrillation=mL; retinal disease=ml; early repolarization associated with ventricular fibrillation=mM; calcinosis=mm; hypertensive heart failure=MM; Virchow's node=Mm; chronic hypotension=MN; prinzmetal's variant angina=mN; angioid streaks=mn; toxic shock syndrome=Mn; sciatic neuropathy=MO; barrett's adenocarcinoma=Mo; myelomaeningocel=mo; long qt syndrome=mO; barrett's esophagus=Mp; prediabetes syndrome=MP; hypertrichosis=mP; hyperinsulinemiac hypoglycemia, familial, 6=mp; coronary artery vasospasm=mQ; diabetes mellitus, transient neonatal, 1=mq; glucocorticoid-remediable aldosteronism=MQ; borderline ovarian tumorur=Mq; intrahepatic cholangiocarcinoma=Mr; primary hyperoxaluria=MR; dilated cardiomyopathy=mR; hypoglycemia, leucine-induced=mr; peutz-jeghers syndrome=MS; diabetes mellitus, transient neonatal, 2=ms; congenital myasthenic syndrome ib=Ms; imerslund-grasbeck syndrome=mS; intrinsic factor deficiency=mT; fanconi-bickel syndrome=mt; myasthenic syndrome, congenital, with pre- and postsynaptic defects=Mt; inflammatory breast carcinoma=MT; goodpasture syndrome=MU; color vision defects=mU; congenital bilateral aplasia of vas deferens=Mu; hyperinsulinemiac hypoglycemia, familial, 1=mu; liddle syndrome=MV; aids defining illness=Mv; hypoadrenocorticism, familial=mV; hyperinsulinemiac hypoglycemia, familial, 2=mv; kartagener syndrome=MW; lupus vulgaris=mW; usher syndrome, type 1c=mw; tetralogy of fallot=Mw; cardiac defects=mx; radiation injuries, experimental=MX; crigler najjar syndrome, type 2=Mx; adrenomyeloneuropathy=mX; aortic rupture=My; peroxisomal disease=mY; developmental delay, epilepsy, and neonatal diabetes=my; prehypertension=MY; demyelinating disease=mZ; neointima=Mz; glucose intolerance=mz; acute stroke=MZ; bone marrow cancer=N; myelodysplastic syndrome=n; sensorineural hearing loss=na; rheumatic disease of heart valve=Na; hepatitis e=NA; folic acid deficiency=nA; spinal cord disease=nb; female breast hyperplasia=Nb; photoparoxysmal response 1=nB; chloracne=NB; endocrine system disease=nc; renal cell carcinoma, nonpapillary=nC; malignant biphasic mesothelioma=NC; secondary hypertension=Nc; nevus, epidermal=ND; carpal tunnel syndrome=nd; adrenal rest turner=Nd; blood group, junior system=nD; autoimmune lymphoproliferative syndrome=ne; autosomal recessive retinitis pigmentosa=nE; pancreatic cancer, adult=NE; cystadenoma=Ne; photosensitization=nF; bone resorption=NF; zellweger syndrome=nf; placental insufficiency=Nf; eosinophilic disorder=NG; intracranial embolism=Ng; methylmalonic aciduria and homocystinuria, cblj type=ng; endocarditis, bacterial=nG; disorder characterized by eosinophilia=NH; vitamin b 12 deficiency=nh; aging, premature=Nh; serum uric acid=nH; weakness=nI; inherited metabolic disorder=ni; penias agenisi=NI; renal dysplasia=Ni; sleep disorder=NJ; graves ophthalmopathy=nj; atresia=Nj; multiple malignancy=nJ; uroporphyrinuria=NK; gout tophaceous=nK; hypersensitivity reaction type i disease=nk; pineoblastoma=Nk; tuberculosis of intestines=nL; terminal insomnia=NL; subacute bacterial endocarditis=Nl; ankylosing spondylitis=nl; familial retinoblastoma=Nm; major affective disorder 1=nm; asthma attack=NM; transient ischemia=nM; diarrhea due to drug=nN; homocystinuria=Nn; chronic nonspecific lung disease=NN; major affective disorder 5=nn; silicosis=NO; chronic tophaceous gout=nO; major affective disorder 8=no; congenital disorder of glycosylation type 1a=No; major affective disorder 9=np; thyroid medullary carcinoma=nP; hypermethioninemia with deficiency of s-adenosylhomocysteine hydrolase=Np; bladder calculus=NP; cleft palate=Nq; retinal degeneration=nQ; major affective disorder 7=nq; splenic disease=NQ; major affective disorder 4=nr; fundus dystrophy=nR; pyridoxine deficiency anemia=Nr; ureteral benign neoplasm=NR; major affective disorder 2=ns; cleft lip=Ns; chronobiology disease=NS; pleural cancer=nS; joubert syndrome 3=Nt; major affective disorder 6=nt; tongue cancer=nT; oligospermia=NT; 'as if' personality=nu; peanut allergic reaction=NU; human t-cell lymphotropic virus 1 infection=Nu; intellectual disability=nU; thyroid cancer=nV; macular degeneration=nv; turners in animals=Nv; congenital nystagmus=NV; cerebellar disease=Nw; uterine disease=NW; retinitis pigmentosa=nW; creatine deficiency, x-linked=nw; gout=nX; mental retardation, x-linked 1=nx; barakat syndrome=NX; leber congenital amaurosis=Nx; gastroenteritis=Ny; erythropoietic protoporphyria=nY; neoplasm recurrence, local=ny; periodic syndrome=NY; parvoviridae infections=NZ; mental retardation, x-linked=nz; cystic kidney=Nz; sguamous cell neoplasm=nZ; alzheimers disease=o; malignant glioma=O; neuroendocrine carcinoma=oa; triglyceride storage disease with impaired long-chain fatty acid oxidation=oA; motor neuron disease=OA; primary infection nos=Oa; infection induced=Ob; protein deficiency=oB; neuritis=OB; hyperuricemia=ob; placental choriocarcinoma=oc; gliosarcoma=OC; parkinson disease, familial, type 1=Oc; bipolar i disorder=oC; dental white spot=Od; choriocarcinoma=od; myopathy=oD; combined oxidative phosphorylation deficiency 6=OD; dysembryoplastic neuroepithelial turner=oe; cowchock syndrome=OE; substance abuse=oE; asbestosis=Oe; scrub typhus=Of; distal spinal muscular atrophy=OF; multiple acyl-coa dehydrogenase deficiency=oF; gallbladder adenocarcinoma=of; rectal turners=Og; papillary thyroid carcinoma=og; rhabdoid cancer=OG; metabolic syndrome=oG; pneumococcal infections=OH; rectal neoplasm=Oh; melioidosis=oh; spastic syndrome=oH; rectum cancer=Oi; *Chlamydia trachomatis* infection=oI; vascular lesions=OI; malignant pleural mesothelioma=oi; leiomyoma=oJ; neuroectodermal turner=OJ; neuromyelitis optica=oj; congenital dyserythropoietic anemia, type ii=Oj; pelizaeus-merzbacher-like disease, autosomal recessive, 2=OK; ischemias colitis=ok; immunodeficiency with hyper-iqm, type 2=Ok; kashin-beck disease=oK; hemophagocytic lymphohistiocytosis, familial, 2=oL; sitosterolemia=ol; minicore myopathy with external ophthalmoplegia=Ol; porphyria, acute hepatic=OL; fanconi anemia, complementation group a=oM; nematode infections=OM; insulin resistance syndrome=om; hereditary autoinflammatory diseases=Om; memory disorders=oN; polygenic hypercholesterolemia=on; pituitary adenoma, familial isolated=ON; periodic fever=On; familial isolated pituitary adenoma=OO; lipid metabolism disorder=oo; light fixation seizure syndrome=Oo; precursor b-cell lymphoblastic leukemia-lymphoma=oO; neoplasms, experimental=oP; pituitary adenoma, growth hormone-secreting=OP; autosomal recessive hyper-igm syndrome=Op; xanthomatosis=op; gallbladder disease 4=eg; sialadenitis=Oq; Philadelphia chromosome positive=oQ; gigantism and acromegaly=OQ; selective ige deficiency disease=Or; acute intermittent porphyria=OR; Philadelphia chromosome-positive acute lymphoblastic leukemia=oR; syndrome=or; cll/sll=Os; hypereosinophilic syndrome, idiopathyic=oS; pituitary-dependent cushing's disease=OS; biliary tract cancer=os; pituitary carcinoma=OT; bile duct carcinoma=ot; x-linked hyper igm syndrome=Ot; chronic disease=oT; macroglobulinemia=Ou; acute undifferentiated leukemia=oU; hormone producing pituitary cancer=OU; polyneuropathy, hearing loss, ataxia, retinitis pigmentosa, and cataract=ou; lymphoplasmacytic lymphoma=Ov; growth hormone secreting pituitary adenoma=OV; polyneuropathy=ov; leukaemia secondary=oV; b acute lymphoblastic leukemia with t(9=oW; alcohol-induced disorders, nervous system=Ow; acth-secreting pituitary adenoma=OW; usher syndrome=ow; t(9;22)(g34;g11)=oX; neuritis, autoimmune, experimental=Ox; coronary aneurysm=ox; leber congenital amaurosis 4=OX; retinitis pigmentosa, juvenile, aipl1-related=OY; arterial pressure=oy; vasculitic neuropathy=Oy; g11.2)=oY; retinal dystrophy, early onset severe=OZ; immunoglobulin a deficiency 1=oz; meningoencephalyitis=Oz; bcr-abll=oZ; human immunodeficiency virus infectious disease=P; cholera=p; t-cell adult acute lymphocytic leukemia=pA; cone dystrophy=Pa; pre b-cell acute lymphoblastic leukemia=pa; breast fibrocystic disease=PA; malignant disease=pb; polyglandular autoimmune syndrome type i=Pb; chronic arthritis=PB; progressive multifocal leukoencephalyopathy=pB; autoimmune polyendocrinopathy syndrome, type 1=Pc; monocytosis=pc; schimke immunoosseous dysplasia=PC; localized scleroderma=pC; ouabain resistance=pd; hypoprebetalipoproteinemia, acanthocytosis, retinitis pigmentosa, and pallidal degeneration=PD; burkitt lymphoma=pD; autoimmune polyendocrinopathy syndrome, type i, autosomal dominant=Pd; pantothenate kinase-associated neurodegeneration=PE; rubella=pE; granulocytosis=pe; autoimmune polyendocrinopathy syndrome, type i, with reversible metaphyseal dysplasia=Pe; idiopathyic hypoparathyroidism=Pf; bowel dysfunction=PE; polycythemia vera=pF; leukaemia recurrent=pf; hepatitis immune=Pg; nail-patella syndrome=pG; stage, chronic myelogenous leukemia=pg; adrenal gland disease=PG; eosinophilia=pH; indolence=ph; hypospadias=PH; polyglandular autoimmune type ii=Ph; diabetic cataract=PI; bacterial infectious disease=pi; b- and t-cell mixed leukemia=pI; recurrent herpes simplex=Pi; juvenile myelomaonocytic leukemia=pJ; temporal arteritis=PJ; myelodysplastic myeloproliferative cancer=pj; autoimmune primary adrenal insufficiency=Pj; autoimmune polyendocrine syndrome=Pk; eye disease=pk; campomelic dysplasia=pK; galactosemia=PK; cerebral palsy=pl; dyschromatosis symmetrica hereditaria=pL; sensory peripheral neuropathy=PL; alopecia areata=Pl; endometriosis of ovary=PM; hypoparathyroidism=Pm; azoospermia, nonobstructive=pM; thymus lymphoma=pm; male pseudohermaphroditism due to deficiency of testicular 17,20-desmelase=PN; guillain-barre syndrome=Pn; prostate disease=pN; polycythemia=pn; respiratory failure=po; thyroid hormone resistance syndrome=pO; keratoconjunctivitis sicca=Po; dentinogenesis imperfecta—shield's type ii=PO; primary immunodeficiency disease=pp; prostatic cancer, castration-resistant=PP; beta thalassemia=pP; chronic mucocutaneous candidiasis=Pp; mitochondrial encephalyomyopathy=pQ; cervical cancer metastasis=PQ; anemia=pq; adenylate kinase deficiency, hemolytic anemia due to=Pq; renal clear cell carcinoma=pR; pancytopenia=pr; adrenal carcinoma=PR; deficiency of adenylate kinase=Pr; hematopoietic system disease=ps; hemophilia b=Ps; hemophagocytic lymphohistiocytosis=pS; androgen insensitivity syndrome=PS; fanconi's anemia=pt; mammographic density=PT; von willebrand disease, type 1=pT; xerosis=Pt; paranoid ideation=PU; primary ciliary dyskinesia=Pu; epidermaodysplasia verruciformis=pu; tricho-dento-osseous syndrome=pU; vitisligo-associated multiple autoimmune disease susceptibility 1=pV; mild dementia=PV; hemorrhagic thrombocythemia=pv; lyme disease=Pv; thymoma=pw; oral infection=Pw; bile acid synthesis defect, congenital, 2=PW; meningococcal infections=pW; plasmacytoma=px; motor skills disorders=Px; pregnancy complications, cardiovascular=pX; gonadoblastoma=PX; long gt syndrome 11=Py; amyotrophyic lateral sclerosis 1=PY; esophagus adenocarcinoma=py; pseudomonas infections=pY; macular dystrophy, corneal type 1=PZ; myelofibrosis=pz; tendinopathy=pZ; arsenic poisoning=Pz; carcinoma, hepatocellular=q; miller dieker syndrome=Q; breast-ovarian cancer, familial, susceptibility to, 1=Qa; neuroticism=qa; paranoid schizephrenia=qA; proteus syndrome=QA; vitisligo=qB; megalanecephaly polymicrogyria-polydactyly hydrocephalyus syndrome=Qb; uremic syndrome=qb; carcinosarcoma=QB; paraplegia=QC; stress, psychological=qc; von willebrand's disease=qC; milroy's disease=Qc; lymphedema, hereditary, ii=Qd; hemolytic-uremic syndrome=qD; superficial ulcer=qd; skin carcinoma=QD; alzheimer disease 5=Qe; pure red-cell aplasia=qE; childhood asthma=qe; langerhans-cell histiocytosis=QE; prostate cancer, hereditary, 7=Qf; coccidioidomycosis=qF; hematocrit=qf; papillary adenocarcinoma=QF; glucosephosphate dehydrogenase deficiency=qG; overweight and obesity=qg; pten hamartoma turner syndrome=Qg; embryonal rhabdomyosarcoma=QG; ovarian cystadenoma=QH; cowden syndrome 6=Qh; carcinogenicity=qh; duodenal ulcer=qH; hemorrhagic disease=qI; methamphetamine abuse=Qi; diminished ovarian reserve=qi; kidney rhabdoid cancer=QI; progesterone resistance=Qj; acute gastroenteritis=qj; pharyngitis=qJ; lung squamous cell carcinoma=QJ; abo incompatibility=qk; hereditary elliptocytosis=qK; stage, non-small cell lung cancer=Qk; papillary follicular thyroid adenocarcinoma=QK; psychiatric symptom=Ql; erdheim-chester disease=QL; cardioembolic stroke=ql; invasive ductal carcinoma=qL; clinical infection=qm; collecting duct carcinoma=QM; colon cancer stage iv=Qm; blood group incompatibility=qM; gastric cancer, intestinal=qn; macroencephaly=Qn; bilateral breast cancer=qN; large cell carcinoma=QN; sporadic breast cancer=qO; acute retention of urine=Qo; retinal cancer=QO; fast acetylator phenotype=qo; grade iii astrocytoma=qP; multiple symptoms=Qp; myxoid liposarcoma=QP; neuroendocrine turner=qp; anal squamous cell carcinoma=QQ; leukemia, natural killer cell large granular lymphocytic=Qq; multiple endocrine neoplasmia type 1=qq; juvenile pilocytic astrocytoma=qQ; atypical lipomatous turner=QR; beta ketothiolase deficiency=qR; open-angle glaucoma=qr; anastomosis, roux-en-y=Qr; ovarian serous cystadenocarcinoma=QS; corpus callosum agenisi neuronopathy=qS; essential hypertension=qs; schizephrenia 8=Qs; sickle cell anemia=qt; intestinal benign neoplasm=Qt; chronic nk-cell lymphocytosis=QT; chronic active hepatitis=qT; obsessive-compulsive disorder=qu; multiple endocrine neoplasmia type 2a=QU; mesenchymal cell neoplasm=Qu; beta thalassemia trait=qU; connective tissue benign neoplasm=QV; multiple endocrine neoplasmia type 2b=Qv; fetal erythroblastosis=qv; invasive pulmonary aspergillosis=qV; hypoinsulinemiac hypoglycemia with hemihypertrophy=QW; aggressive cancer=qW; common wart=Qw; alpha thalassemia=qw; gingivitis=qX; rett syndrome=Qx insulin resistant diabetes=QX; neonatal jaundice=qx; anal margin carcinoma=Qy; atypical teratoid rhabdoid turner=qY; stomatitis=qy; familial partial lipodystrophy=QY; motor peripheral neuropathy=qZ; factor viii deficiency=qz; microcephaly=QZ; acoustic neuroma=Qz; precancerous lesions=R; meckel syndrome type 1=r; follicular thyroid carcinoma=ra; carotid artery thrombosis=Ra; spondyloepiphyseal dysplasia, kimberley type=rA; pallidoluysian degeneration=RA; occupational diseases=rB; monster=Rb; substance use disorder=RB; salivary gland adenoid cystic carcinoma=rb; mixed oligodendroglioma-astrocytoma=rc; intervertebral disc displacement=rC; syndactyly of toes with fusion of bones=Rc; danish type familial amyloid cardiomyopathy=RC; cervix uteri carcinoma in situ=Rd; parvovirus b19=RD; morbid obesity=rd; sacroiliitis=rD; tendon injuries=rE; cervix carcinoma=re; manganese poisoning=Re; anti-diuresis=RE; disorder of achilles tendon=rF; hyperinsulinis=rf; lead poisoning, nervous system=Rf; single turner=RF; lumbar disc disease=rG; isobutyryl-coa dehydrogenase deficiency=rg; acral pseudolymphomatous angiokeratoma of children (apache)=RG; lead poisoning, nervous system, adult=Rg; hand osteoarthritis=rH; childhood obesity=rh; dysalbuminemiac hyperthyroxinemia=RH; genitourinary cancer=Rh; high-oxygen-affinity hemoglobin=RI; erythema nodosum=ri; tyrosinemia=Ri; idiopathyic scoliosis=rI; social phobia=Rj; macroalbuminuric diabetic nephropathy=RJ; anastomosis=rj; osteoarthritis of distal interphalangeal joint=rJ; osmotic diarrhea=rk; tendinosis=rK; acute viral hepatitis=RK; porphyria=Rk; acute porphyria=Rl; fetal anemia=RL; collagenopathy, type 2 alpha 1=rL; intestinal infectious disease=rl; osteochondrodysplasia=rM; acute intermittent porphyri=Rm; dysproteinemia=RM; portal veins thrombosis=rm; arthropathy=rN; uveitis=rn; protoporphyria, erythropoietic, x-linked dominant=Rn; dental disorder=RN; tenth disease=RO; facioscapulohumeral muscular dystrophy=rO; thalassemia intermedia=Ro; fibromyalgia=ro; pyoderma gangrenosum=rp; multiple epiphyseal dysplasia=rP; pyridoxine-responsive sideroblastic anemia=Rp; mixed germ cell cancer=RP; mumps=RQ; subacute sclerosisng panencephalyitis=rq; x chromosome-linked pyridoxine responsive sideroblastic anemia=Rq; atrial heart septal defect=rQ; microcytic anemia=Rr; laryngeal carcinoma=rR; irritable bowel syndrome=rr; pericardial effusion=RR; acyl-coa dehydrogenase family, member 9, deficiency of=rs; autonomic neuropathy=RS; mucopolysaccharidosis vi=Rs; tropical spastic paraparesis=rS; hyperlipoproteinemia type iv=RT; progeria=rT; preneoplasmtic state=rt; hypoproteinemia, hypercatabolic=Rt; hyperthyroxinemia, familial dysalbuminemiac=Ru; aseptic meningitis=RU; 2-methylbutyrylglycinuria=ru; achondroplasia=rU; miller fisher syndrome=RV; zinc, elevated plasma=Rv; osteochondritis dissecans=rV; prader-willi syndrome=rv; kwashiorkor=RW; cardiac arrest=rw; dowling-degos disease=rW; ehlers-danlos syndrome, type vii, autosomal dominant=Rw; hemangioblastoma=RX; tagi polymorphism=rX; duchenne and decker muscular dystrophy=Rx spondyloepimetaphyseal dysplasia, aggrecan type=rx spondyloepiphyseal dysplasia, congenita=ry; persistent infection=rY; hereditary angioedema=RY; isolated somatotropin deficiency=Ry; dysferlinopathy=Rz; familial osteochondritis dissecans=rz; dry eyes=rZ; hyperthyroxinemia=RZ; dysmorphic features=S; amyotrophy, hereditary neuralgic=s; cholangiolocellular carcinoma=Sa; stroke, lacunar=sA; stomach disease=SA; mammary adenocarcinoma=sa; croup=Sb; middle cerebral artery occlusion=sB; occupational dermatitis=SB; smallpox=sb; psychological symptom=sC; ethylmalonic encephalyopathy=SC; congenital hypothyroidism=Sc; amine acid metabolic disorder=sc; dry eye syndrome=sd; senior loken syndrome=SD; temporal pain=sD; gout, hprt-related=Sd; de barsy syndrome=Se; apraxia, oculomotor, cogan type=SE; fungal infectious disease=sE; leptospirosis=se; teratoma=sf; hereditary macular dystrophy=SF; intracranial aneurysm=sF; subcapsular cataract=Sf; papillary renal cell carcinoma=sg; spastic diplegia=SG; dysgenesis of corpus callosum=Sg; migraine=sG; pre-eclampsia=sH; alcohol sensitivity, acute=Sh; hyperprolinemia type 2=SH; chromophobe adenocarcinoma=sh; prostate cancer stage=Si; brain diseases, metabolic=SI; hartnup disease=si; huntington's disease=si; micropapillary carcinoma=Sj; mental suffering=SJ; intermediate coronary syndrome=sj; sarcoidosis=sJ; fibromyxosarcoma=Sk; cohen syndrome=sk; hypertrophyic cardiomyopathy=sK; convulsions/seizures=SK; epithelioid sarcoma=Sl; friedreich ataxia=sL; neurological morbidity=SL; spinocerebellar ataxia-7=sl; microphthalmia, isolated 8=Sm; phoria=SM; endomyocardial fibrosis=sM; brachydactyly=sm; pulmonary sarcoidosis=sN; hoyeraal hreidarsson syndrome=sn; status epilepticu=SN; choanal atresi=Sn; aortic valve stenosis=sO; hangover, susceptibility to (finding)=So; methylmalonate semialdehyde dehydrogenase deficiency=SO; cystic disease=so; aortic valve ID disease=sP; alcohol withdrawal delirium=Sp; 3-hydroxyisobutyric aciduria=SP; neuronal ceroid lipofuscinosis=sp; severe acute respiratory syndrome=sQ; pyridoxine-dependent epilepsy=SQ; melanosis=Sq; anisometropia=sq; secondary pulmonary hypertension=SR; non-smoker=Sr; middle cerebral artery infarction=sR; angle-closure glaucoma=sr; hangover=Ss; myocarditis=sS; dyskeratosis congenita=ss; lactic acidosis=SS; alcohol flush reaction=St; aortic valve insufficiency=sT; glycogen storage disease xii=ST; familial melanoma=st; hangover effect=Su; aortic valve disease 2=su; hereditary fructose intolerance syndrome=SU; proteinuria=sU; melanosis coli=Sv; diabetic cardiomyopathyies=sv; borna disease=SV; vesicoureteral reflux=sV; alcohol problem=Sw; ventricular remodeling=sw; long gt syndrome 2=SW; mitral valve prolapse=sW; congenital disorder of glycosylation, type ip=SX; drunk=Sx; atrial fibrillation=sX cardiac fibrosis=sx;

brain small vessel disease with hemorrhage=sY; coronavirus infections=sy; multiple lacunar infarcts=Sy; congenital disorder of glycosylatio=SY; chronic heart failure=sz; congenital disorder of glycosylation type 1e=SZ; chlorpropamide-alcohol flushing=Sz; thrombophilia due to activated protein c resistance=sZ; precursor cell lymphoblastic leukemia-lymphoma=t; carcinoma=T; allanson pantzar mcleod syndrome=ta; puerperal disorders=tA; congenital disorder of glycosylation type 1g=Ta; malignant histiocytosis=TA; congenital disorder of glycosylation, type is=Tb; liver inflammatory pseudotumor=TB; sarcoidosis, susceptibility to, 1=tB; mass syndrome=tb; coronary heart disease, susceptibility to, 5=tC; congenital disorder of glycosylation type 1k=Tc; mixed anxiety and depressive disorder=TC; microvascular complications of diabetes, susceptibility to, 1=tc; angiotensin i-converting enzyme, benign serum increase=tD; albuminuria=td; congenital disorder of glycosylation type ii=Td; bardet-biedl syndrome=TD; alstrom syndrome=TE; congenital disorder of glycosylation type 1d=Te; homocysteinemia=tE; segmental glomerulosclerosis=te; vascular system injuries=tf; mild cognitive impairment=tF; congenital disorder of glycosylation type 1h=Tf; ichthyosisform erythroderma, brocg congenital, nonbullous form=TF; self-healing collodion baby=TG; abortion, habitual=tg; congenital disorder of glycosylation type 1I=Tg; pregnancy complications, hematologic=tG; chronic closed-angle glaucoma=Th; hyperlipoproteinemia type ii=th; congenital toxoplasmosis=TH; altitude sickness=tH; experimental organism basal cell carcinoma=tI; bronchial hyperreactivity=ti; neuroblastoma, susceptibility to, 3=Ti; generalized atherosclerosis=TI; kantaputra gorlin syndrome=Tj; pigmented villonodular synovitis=TJ; activated protein c resistance=tj; generalized glycogen storage disease of infants=tJ; infant, premature, diseases=tk; aspirin resistance=tK; asthma, aspirin-induced=TK; ewing sarcoma/peripheral primitive neuroectodermal turner=Tk; thrombophilia, hereditary=tl; asthma, diminished response to antileukotriene treatment in=TL; neural crest turner=Tl; scarring=tL; leukoaraiosis=tM; hyperhomocystinemia=TM; microvascular angina=tm; disorder of pericardium=Tm; peptic ulcer hemorrhage=tn; pleural disease=Tn; asthma, exercise-induced=TN; chronic berylliosis=tN; gastric lymphoma=To; moderate persistent asthma=TO; infection of amniotic sac and membranes=tO; psychoses, substance-induced=to; lymphatic metastasis=tp; aggressive periodontitis=TP; pulmonary edema of mountaineers=tP; urticaria pigmentosa=Tp; bronchitis=TQ; seasonal affective disorder=tQ; gangliocytoma=Tq; atrioventricular canal defect=tq; ichthyosis, lamellar, 5=TR; mastocytosis=Tr; panic disorder 1=tR; sleep deprivation=tr; insulin sensitivity=tS; pulmonary plasma cell granuloma=Ts; ichthyosis, congenital, autosomal recessive 3=TS; microvascular complications of diabetes, susceptibility to, 3=ts; bladder adenocarcinoma=Tt; heat stress disorders=tt; wolcott-rallison syndrome=TT; aortic stiffness=tT; water intoxication=tu; hypocalciuric hypercalcemia, familial, type 1=TU; spindle cell carcinoma=Tu; hypercortisolemia=tU; pleomorphic lipoma=TV; reflux nephropathy=tV; ganglioneuroblastoma=Tv; emphysema=tv; endometrial stromal sarcoma=Tw; schizophrenics=tW; graft occlusion, vascular=tw; nephrocalcinosis=TW; pulmonary blastoma=Tx; sarcopenia=tx; amyloid angiopathy=tX; hypophosphatasisa=TX; embryonal cancer=TY; aspirin intolerance=tY; adenosguamous carcinoma=Ty; critical illness=ty; alexithymia=tZ; genetic diseases, inborn=tz; primary lateral sclerosis juvenile=TZ; pleomorphic carcinoma=Tz; large intestine cancer=U; breast cancer=u; kuhnt-junius degeneration=UA; infant, very low birth weight=uA; amyotrophyic lateral sclerosis 2, juvenile=Ua; age-associated memory impairment=ua; chronic cough=ub; hereditary spastic paralysis, infantile onset ascending=Ub; cutis lax=UB; chronic urticaria=uB; amelogenesis imperfecta, hypoplastic/hypomaturation, x-linked 1=UC; lone atrial fibrillation=uC; complicated hereditary spastic paraplegia=Uc; beryllium disease=uc; diabetic foot=ud; upper motor neuron disease=Ud; osteopathyia striata cranial sclerosis=UD; ablepharon macrostomia syndrome=uD; aortic aneurysm of unspecified site without mention of rupture=uE; Japanese encephalyitis=UE; lateral sclerosis=Ue; nodular glomerulosclerosis=ue; fibrosis of pancreas=uF; frontonasal dysplasia=Uf; female urogenital diseases=UF; lacunar infarction=uf; macroangiopathy=ug; frontonasal dysplasia 3=Ug; chronic colitis=UG; diabetic peripheral neuropathy=uG; acrania=Uh; stalking=uH; diabetic microangiopathy=uh; ovarian dysgenesis=UH; midline facial cleft—tessier cleft 0=Ui; clostridium=ui; dry cough=uI; streak gonad=UI; parietal foramina 2=Uj; difficile (disorder)=uj; post mi=uJ; anovulatory=UJ; klinefelter's syndrome, male with more than two x chromosomes=UK; frontonasal dysplasia 2=Uk; cardiovascular morbidity=uK; end organ damage=uk; craniosynostosis 5, susceptibility to=Ul; anorchia=UL; coronary artery atheroma=uL; cognitive deterioration=ul; primary vesicoureteric reflux=uM; cerebral white matter lesion=um; inflammatory polyarthritis=UM; hereditary multiple exostoses=Um; parietal foramin=Un; chronic anterior uveitis=UN; pulmonary hypertension due to chronic exposure to high altitude=uN; recurrent pregnancy loss=un; unspecified convalescence=uo; bile acid synthesis defect, congenital, 4=Uo; chronic small plague psoriasis=uO; intersex conditions=UO; prostate cancer, familial=Up; persistent dry cough=uP; pseudohermaphroditism=UP; anoxemia=up; hypersensitivity vasculitis=UQ; oxyphilic adenoma=Qq; skin fold (abnormality)=uQ; thrombophilia due to thrombin defect=uq; left ventricular dilatation=uR; gonadal dysgenesis=UR; primary iga nephropathy=ur; amelogenesis imperfecta=Ur; chronic thromboembolic pulmonary hypertension=uS; brain injury, chronic=us; hypogonadism=US; endocarditis=Us; klinefelter's syndrome=UT; convalescence=ut; ventricular dilatation=uT; central nervous system cancer=Ut; acute mountain sickness=uu; left atrial hypertrophy=uU; anovulation=UU; neurogenic bladder=Uu; ovarian hyperstimulation syndrome=UV; nephroangiosclerosis=uv; silent myocardial ischemia=uV; bacteriuria=Uv; Sertoli cell-only syndrome=UW; renal infectious disease=Uw; overanxious disorder=uW; genetic hypertension=uw; persistent mullerian duct syndrome=UX; cutis laxa, autosomal recessive, type i=Ux; completed suicide=ux chronic systolic heart failure=uX; proliferative retinopathy=uy; geographic atrophy=Uy; chronic uremia=uY; cri du chat=UY; hard drusen=Uz; cakut=uz; sex differentiation disease=UZ; low density lipoprotein receptor mutation=uZ; colorectal cancer=V; neurodegenerative disease=v; renal artery disease=va; alport syndrome, mental retardation, midface hypoplasia, and elliptocytosis=Va; pad mass=VA; urinary tract obstruction=vA; asthma with copd=vb; femoral artery occlusion=VB; pulmonary edema=vB; neurogenic inflammation=Vb; mitral valve insufficiency=vC; extravasation of diagnostic and therapeutic materials=Vc; pulmonary arterial hypertension associated with portal hypertension=VC; connective tissue disease=vc; diabetic neuropathy=vD; heart valve disease=vd; goiter=VD; megaloblastic anemia=Vd; spastic paraplegia 63, autosomal recessive=Ve; hypertensive heart disease=vE; anterior ischemias optic neuropathy=ve; extramedullary plasmacytoma=VE; migraine with aura=vf; superficial urinary bladder cancer=VF; pontocerebellar hypoplasia=Vf; hyperandrogenism=vF; musculoskeletal system disease=vg; erythrocyte amp deaminase deficiency=Vg; ectopic pregnancy=VG; nephrosclerosis=vG; renal hypertension=vh; aneurysm of ascending aorta=VH; diabetic angiopathy=vH; glycogen storage disease vi=Vh; telangiectatic focal nodular hyperplasia=VI; myopathy, centronuclear, autosomal recessive=Vi; raynaud disease=vi; hepatorenal syndrome=vI; nephrosis=vJ; autosomal recessive centronuclear myopathy=Vj; peripheral vascular disease=vj; lymphedema=VJ; autoimmune disease of the nervous system=Vk; coronary thrombosis=vK; berylliosis=vk; capillary leak syndrome=VK; periodontitis=vl; optic nerve disease=vL; vasculogenic impotence=VL; congenital structural myopathy=Vl; orphan diseases=Vm; viral pneumonia=vm; angiosarcoma=VM; wegener's granulomatosis=vM; glycine encephalopathy=Vn; caroli disease=VN; microinvasive gastric cancer=vn; cushing's syndrome=vN; interstitial nephritis=vo; adrenal gland hyperfunction=vO; stage i lung cancer=VO; gnathomiasis=Vo; inherited blood coagulation disease=vP; nephritis=vp; von hippel-lindau disease=VP; prothrombin g20210a mutation=Vp; pyelonephritis=vq; hepatitis=vQ; craniometaphyseal dysplasia, autosomal dominant=VQ; amyotrophyic lateral sclerosis 9=Vq; chondrocalcinosis 2=VR; portal hypertension=vr; secondary hyperparathyroidism=vR; amyotrophyic lateral sclerosis, sporadic=Vr; malaria, susceptibility to=VS; retinal detachment=vS; acute-phase reaction=Vs; malignant hypertension=vs; gout acute=Vt; capillary disease=vT; human anaplasmosis due to anaplasma phagocytophilum=VT; hydrocephalyus=vt; nephronophthisis=vU; obstructive chronic pancreatitis=Vu; schwartz-lelek syndrome=VU; borderline personality disorder=vu; cerebral atherosclerosis=vV; familial chondrocalcinosis=VV; proctitis=Vv; antisocial personality disorder=vv; alveolar soft part sarcoma=Vw; lipoid nephrosis=vw; migraine without aura=vW; calcium pyrophosphate dihydrate deposition=VW; pterygium=Vx; hereditary spherocytosis=VX; alport syndrome=vx; alcoholic cardiomyopathy=vX; carotid stenosis=vY; meconium aspiration syndrome=vy; ankylosis=VY; anaphylaxis=Vy; cardiac arrhythmia, ankyrin-b-related=VZ; astrocytoma, low grade=Vz; hydronephrosis=vz; transient cerebral ischemia=vZ; adenoma=W; glioblastoma multiforme=w; generalized dystonia=WA; takayasu's arteritis=wA; intestinal volvulu=Wa; retinopathy of prematurity=wa; bethlem myopathy=WB; mental retardation, autosomal recessive 37=Wb; familial nephrotic syndrome=wB; intracranial arterial disease=wb; neuroma=Wc; miyoshi muscular dystrophy 3=WC; glycogen storage disease v=wC; retinal artery occlusion=wc; focal segmental glomerulosclerosis=wd; muscular dystrophy, limb-girdle, type 2I=WD; glycogen storage disease ii=wD; cyclothymic disorder=Wd; contact dermatitis=wE; proliferative diabetic retinopathy=we; fukuyama muscular dystrophy=WE; chondrocalcinosis=We; disorder of skeletal system=WF; bronchiolitis obliterans=wF; diabetic retinopathy=wf; opioid-related disorders=Wf; acute pancreatitis=wG; distal muscular dystrophy=WG; background diabetic retinopathy=wg; dopamine receptor d2, reduced brain density of=Wg; uterine fibroid=wh; language disorder=Wh; renal artery obstruction=wH; common variable immunodeficiency=WH; seborrheic dermatitis=WI; retinal vascular occlusion=wi; neuroleptic malignant syndrome=Wi; anuria=wI; exfoliation syndrome=wj; familial mediterranean fever=wJ; cocaine dependencye=Wj; sucrase-isomaltase deficiency, congenital=WJ; epidemic diarrhea=WK; brain infarction=wK; complex regional pain syndrome=wk; child development disorders, pervasive=Wk; chromosome 8, monosomy 8p=WL; kbg syndrome=Wl; cellulitis=wL; aortic disease=wl; intermittent claudication=wM; scimitar syndrome=Wm; familial lipoprotein lipase deficiency=wm; leukostasis=WM; azoospermia=wn; brucella melitensis brucellosis=WN; congenital diaphragmatic hernia=wN; thrombocytopenia chromosome breakage=Wn; tricuspid valve insufficiency=wO; marfan syndrome=wo; renal oncocytoma=WO; temporal lobe neoplasm=Wo; gallbladder disease=Wp; turner syndrome=wp; parapsoriasis=WP; seminoma=wP; persian gulf syndrome=wQ; diastrophyic dysplasia=wq; nephronophthisis 16=Wq; methylmalonic aciduria chib type=WQ; major depressive disorder=wr; uremia=wR; spinocerebellar ataxia, autosomal recessive 10=Wr; hemangioma, capillary infantile=WR; dysgerminoma of ovary=wS; osteogenesis imperfecta, levin type=Ws; seckel syndrome 1=WS; angioedema=ws; normal pressure hydrocephalyus=wt; embryonic cyst=Wt; acute pyelonephritis=wT; mental retardation-hypotonic facies syndrome, x-linked, 1=WT; werner syndrome=wU; diabetic gastroparesis=Wu; rheumatic fever=wu; growth retardation, alopecia, pseudoanodontia and optic atrophy=WU; alpha thalassemia-mental retardation syndrome=WV; sarcoma 180=Wv; testis seminoma=wV; renovascular hypertension=wv; retinal vein occlusion=ww; agoraphobia=wW; severe intellectual disabilityies=WW; myoclonic dystonia=Ww; reflex sympathyetic dystrophy=wx; dystonia 24=Wx; inhalation anthrax=WX; panic disorder=wX; pulmonary embolism=wY; breast medullary carcinoma=WY; primary dystonia=Wy; germ cell cancer=wy; nijmegen breakage syndrome=WZ; chronic fatigue syndrome=wZ; cervical dystonia=Wz; gaucher's disease=wz; colonic benign neoplasm=x; ovarian cancer=X; perinatal necrotizing enterocolitis=xa; epstein-barr virus hepatitis=Xa; xanthinuri=XA; fatigability=xA; erythrokeratndermaia variabilis 3=XB; vascular dementia=xb; gingival hypertrophy=Xb; slow channel syndrome=xB; myasthenic syndrome=xC; gastric cardia adenocarcinoma=Xc; polycystic kidney disease=xc; disorder of copper metabolism=XC; familial olivopontocerebellar atrophy=xD; lissencephaly, x-linked, 1=Xd; hepatopulmonary syndrome=xd; mental retardation, x-linked, syndromeic 5=XD; paratuberculosis=Xe; anxiety neurosis=xE; psoriatic arthritis=xe; dandy-walker syndrome=XE; anxiety state=xF; hyperhomocysteinemia=xf; asymptomatic diseases=Xf; pustular psoriasis=XF; cerebral arteriosclerosis=xG; ocular hypertension=xg; bladder pain syndrome=Xg; branchio oculo facial syndrome=XG; parkinsonism, experimental=xH; systolic heart failure=xh; acute peritonitis=Xh; alveolar rhabdomyosarcoma=XH; familial benign hypercalcemia, type 3=XI; muscular dystrophy=xI; peniale cancer=Xi; diastolic heart failure=xi; hypercalcemi=XJ; arrhythmogenic right ventricular cardiomyopathy=xj; learning disability=xJ; penias carcinoma=Xj; obstructive sleep apnea=xk; penias sguamous cell carcinoma=Xk; blood platelet disease=xK; hermansky pudlak syndrome 2=XK; cardiac acres=xl; orbital disease=xL; bare lymphocyte syndrome 2=Xl; bartter syndrome, type 3=XL; thanatophoric dysplasia, type i=xm; movement disease=xM; endometriosis of uterus=Xm; usher syndrome, type 1b=XM; thanatophoric dysplasia=xN; end-plate acetylcholinesterase deficiency=xn; mhc class ii deficiency=Xn; congenital pigmentation=XN; thyroiditis=xO; urethritis=Xo; hemorrhagic fever with renal syndrome=XO; isaacs syndrome=xo; chediak-higashi syndrome=XP; organophosphate poisoning=xp; ovarian clear cell adenocarcinoma=Xp; centronuclear myopathy=xP; bartter disease=XQ; amphetamine-related disorders=xq; gonorrhe=Xq; congenital myasthenic syndrome=xQ; myeloproliferative disorder, chronic, with eosinophilia=Xr; frontotemporal dementia=xR; growth disorders=xr; cyclic hematopoiesis=XR; albinism with hemorrhagic diathesis and pigmented reticuloendothelial cells=XS; alzheimer disease type 2=xs; lambert-eaton myasthenic syndrome=xS; pregnancy loss, recurrent, susceptibility to, 3=Xs; prenatal injuries=xt; treacher collins syndrome=Xt; epidermaolysis bullosa with pyloric atresia=XT; herpesviridae infections=xT; collagen arthritis=xU; spastic paraplegia 47, autosomal recessive=XU; angiomyolipoma=Xu; myasthenia gravis, autoimmune, experimental=xu; hereditary sensory-motor neuropathy, type i=xV; lymphangioleiomyomatosis=Xv; stress disorders, traumatic=xv; cerebellar function=XV; subependymal giant cell astrocytoma=Xw; hemolytic disorder=xW; cognitive deficits=xw; inherited epidermaolysis bullosa=XW; migraineous vertigo=XX; epidermal differentiation complex=Xx; acute stress=xx; varicella zoster=xX; pseudorabies=xY; absence of sensation=xy; propionic acidemia=XY; food allergy=Xy; *Plasmodium vivax* infection=xZ; epidermaolysis bullosa=XZ; congenital myasthenia=xz; eosinophili=Xz; breast carcinoma=y; neuropathy=Y; junctional epidermaolysis bullosa=Ya; skin cancer=yA; *Plasmodium vivax* malaria=ya; adenoviral infections=YA; acrodysostosis=yB; gastric adenoma=YB; rh isoimmunization=yb; bullous pemphigoid=Yb; genital herpes=yc; spastic paraplegia 51, autosomal recessive=Yc; congenital hypertrophy of retinal pigment epithelium=YC; vascular cancer=yC; ileal diseases=yd; spastic paraplegia-50, autosomal recessive=Yd; polyposis of gastric fundus without polyposis coli=YD; kallmann syndrome=yD; intestinal adenocarcinoma=YE; spastic paraplegia 52, autosomal recessive=Ye; pituitary adenoma=yE; anemia of chronic disease=ye; juvenile polyposis coli=YF; embryoma=yF; irritant dermatitis=yf; spastic paraplegia 48, autosomal recessive=Yf; nevi and melanomas=Yg; serous cystadenocarcinoma=yg; blood in stool=YG; kaposi's sarcoma=yG; mycosis fungoides=yh; plant diseases=Yh; early myoclonic encephalyopathy=yH; clinical sepsis=YH; stevens-johnson syndrome=yi; cerebral cortex myoclonus=yI; poroma=YI; nodular malignant melanoma=Yi; clubfoot=Yj; neoplasm invasiveness=yJ; polyp of duodenum=YJ; granular corneal dystrophy type i=yj; mucous membrane hyperplasia=YK; acrodystrophyic neuropathy=yk; hereditary hemochromatosis=yK; nicotine dependency=Yk; pregnancy in diabetics=yL; ileal pouch=YL; sleeping sickness=Yl; total hypotrichosis, mari type=yl; iron deficiency=yM; hypotrichosis simplex=Ym; pseudohypoparathyroidism, type ib=ym; duodenal benign neoplasm=YM; toxoplasmosis=yN; autosomal dominant retinitis pigmentosa=yn; rectal disease=YN; mosaic variegated aneuploidy syndrome=Yn; hemochromatosis=yO; duodenum cancer=YO; bitter taste=yo; desmoid disease, hereditary=Yo; duodenum adenocarcinoma=YP; intestinal polyps=Yp; inflammatory pain=yp; infantile cerebellar-retinal degeneration=yP; neuroepithelioma=yq; seborrheic keratosis=YQ; intestinal polyposis=Yq; dyslexia=yQ; pulmonary cystic fibrosis=yr; rhizomelic chondrodysplasia punctata, type 1=yR; parathyroid carcinoma=YR; ectrodactyly, ectodermal dysplasia, and cleft lip/palate syndrome 1=Yr; desmoid turner caused by somatic mutation=Ys; deficiency of oxidase=yS; rectum adenocarcinoma=YS; taste sweet=ys; acquired aplastic anemia=yt; protein s deficiency=YT; brain tumor-polyposis syndrome 2 (disorder)=Yt; peroxisomal acyl-coa oxidase deficiency=yT; osteoporosis, postmenopausal=yU; renal sclerosis with hypertension=yu; nevoid basal cell carcinoma syndrome=YU; congenital plasminogen deficiency=Yu; acinar cell carcinoma=YV; carcinoid turner=Yv; autoimmune thyroid disease=yV; clumsiness—motor delay=yv; autoimmune diabetes=yW; jejunal neoplasm=YW; bone cancer=yw; traditional serrated adenoma=Yw; parathyroid gland disease=yx; immunopathology=yX; hyperprothrombinemia=Yx; anal carcinoma=YX; cryptorchidism=yy; congenital hypertrophy=Yy; generalized vitisligo=yY; signet ring cell adenocarcinoma=YY; nephrogenic diabetes insipidus=yz; convulsive disorder=yZ; extrahepatic bile duct carcinoma=YZ; *Bacteroides fragilis*=Yz; amyotrophyic neuralgia=Z; liver disease=z; duodenal disease=Za; transient global amnesia=ZA; cyanotic congenital heart disease=zA; aniridia type 1=za; smooth muscle turner=ZB; gilles de la tourette syndrome=zb; pseudomyxoma peritonei=Zb; pancreatic disorders (not diabetes)=zB; distemper=zC; palindromic rheumatism=zc; myoepithelial carcinoma=Zc; intraocular retinoblastoma=ZC; hairy cell leukemia=zD; glucose-6-phosphate dehydrogenase deficiency=zd; pediatric intraocular retinoblastoma=ZD; small intestine adenocarcinoma=Zd; leopard syndrome=ze; pulmonary venoocclusive disease=ZE; otitis media=zE; hepatocellular fibrolamellar carcinoma=Ze; fish-eye disease=ZF; generalized anxiety disorder=zf; osteogenesis imperfecta=zF; pilomatrixoma=Zf; renal osteodystrophy=zG; basaloid sguamous cell carcinoma=Zg; branchiootorenal syndrome=zg; cholesteryl ester transfer protein deficiency=ZG; combined hyperlipidaemia=ZH; synovitis=zH; mixed-type liposarcoma=Zh; systemic mastocytosis=zh; noonan syndrome=zi; mixed hyperlipidemia=ZI; eccrine porocarcinoma=Zi; osteopetrosis=zI; bone giant cell turner=zJ; lafora disease=zj; intussusception=Zj; familial hyperchylomicronemia syndrome=ZJ; hyperlipoproteinemia type v=ZK; lymphoproliferative syndrome, x-linked, 2=Zk; progressive myoclonus epilepsy=zk; giant cell turner=zK; mesangial proliferative glomerulonephritis=zl; hyperlipoproteinemia type iii=ZL; primary systemic amyloidosis=Zl; reticulosarcoma=zL; chronic inflammatory demyelinating polyradiculoneuropathy=zm; bone disease=zM; lentivirus infections=ZM; candidiasis, cutaneous=Zm; epilepsy with generalized tonic-clonic seizures=zn; infection by *Candida albicans*=Zn; steatocystoma multiplex=ZN; acrodermatitis enteropathyica=zN; mycoplasma infections=zO; hyperalphalipoproteinemia 1=ZO; restless legs syndrome=zo; localized amyloidosis=Zo; enzymopathy=zP; dentatorubral-pallidoluysian atrophy=zp; dysgammaglobulinemia=Zp; macular degeneration, age-related, 1=ZP; hepatic lipase deficiency=ZQ; gomez lopez hernandez syndrome=zq; agammaglobulinemia=Zq; primary immune deficiency disorder=zQ; hyperalgesia, thermal=zR; asthenozoospermia=ZR; oral candidiasis=Zr; hyper-igm immunodeficiency syndrome, type 1=zr; renal ischaemia=zS; hepatorenal form of glycogen storage disease=ZS; infectious mononucleosis=Zs; combined immunodeficiency with autoimmunity and spondylometaphyseal dysplasia=zs; lenticular opacities=Zt; spondyloenchondrodysplasia=zt; hypobetalipoproteinemia, familial=ZT; mechanical allodynia=zT; hydatidiform mole, recurrent, 1=ZU; micronuclei, chromosome-defective=Zu; fowlpox=zu; breast disease=zU; hypobetalipoproteinemia, familial, apolipoprotein b=ZV; oestrogen deficiency=zv; papillomavirus infections=Zv; breast cyst=zV; hypobetalipoproteinemia, familial, 1=ZW; polydactyly=zW; subcutaneous fibrosis=Zw; callosities=zw; hypobetalipoproteinemia, familial, 2=ZX; prostatitis=zX; pneumoniatis=Zx; corneal pannus=zx; reaction to colouring=zy; adenocarcinoma in situ=zY; beta thalassemia=ZY; keratosis=Zy; monoclonal gammopathy=zZ; meningitis=Zz; acanthocytosis=ZZ; tophus=zz;

DESCRIPTION OF THE FIGURES

FIG. 1a shows that engineered, unmodified mouse Epo mRNA yielded higher protein levels in mice than the corresponding pseudouridine modified sequence. 1 µg of either unmodified or pseudouridine modified mRNA encoding erythropoietin was complexed with TransIT and intraperitoneally injected into mice. Serum erythropoietin (EH) levels were determined at different times (1, 2, or 3 days) after administration.

FIG. 1b shows that low nanogram doses of engineered, unmodified mouse Epo mRNA gave rise to substantial protein levels in murine serum. The indicated amounts of TransIT-complexed unmodified Epo mRNA were administered intraperitoneally. As a control, 100 U of recombinant human EH protein (hEPO) were given intraperitoneally. Serum EH levels were determined 24 hours after treatment. Unmodified, engineered mRNA harboring the nucleotides A, U, G, and C; ψ, engineered mRNA in which pseudouridine replaces U. n=4 for all groups.

FIG. 2a shows that sequence engineered Epo mRNA elicited strong reticulocyte responses in mice after intraperitoneal injection with either TransIT-complexed mRNA (1 µg) or recombinant erythropoietin (EH) protein (hEPO: 100 U, MmEpo: 800 ng). mRNA was either unmodified or harbored pseudouridine. The level of reticulocytes was determined 4 days after treatment.

FIG. 2b shows that low nanogram doses of engineered but unmodified mouse Epo mRNA elicited substantial reticulocyte responses in mice upon intraperitoneal administration of the indicated doses of TransIT-complexed Epo mRNA or 100 U of hEPO. Reticulocytes were quantified 4 days after injection.

FIG. 2c shows that sequence-engineered mouse Epo mRNA substantially increased the hematocrit in mice upon treatment with either TransIT-complexed mRNA (1 µg) or recombinant EH protein (hEPO: 100 U, MmEpo: 800 ng) on day 0 and 14. The hematocrit was measured on day IB. mRNA was either unmodified or harbored pseudouridine. unmodified engineered mRNA harboring the nucleotides A, U, G, and C; ψ, engineered mRNA in which pseudouridine replaces U; hEPO, recombinant human Epo protein; MmEpo, recombinant murine Epo protein. n=4 for all groups.

FIG. 3a shows that engineered, unmodified Epo mRNA allowed long-term/continued treatment of mice as protein yield from intraperitoneally administered mouse Epo mRNA was not affected by repeated treatments. Mice were repeatedly injected with 1 µg of either unmodified or pseudouridine-modified mRNA as well as 0.1 µg of unmodified mRNA at an interval of 2 weeks. Plasma erythropoietin (EH) levels were determined 24 hours after each treatment.

FIG. 3b shows that intraperitoneally injected mouse Epo mRNA increased reticulocyte counts even after multiple dosing. Mice received multiple doses of TransIT-complexed mRNA (log, either unmodified or pseudouridine-modified) or MmEpo (0.8 µg) at a biweekly interval starting on day 0 and were analyzed for reticulocytes 4 days after treatments.

FIG. 3c shows that repeated intraperitoneal injections of Epo mRNA elicited a strong and sustained increase of the hematocrit. Mice received multiple doses of TransIT-complexed mRNA (1 µg, either unmodified or pseudouridine-modified) or MmEpo (0.8 µg) at a biweekly interval starting on day 0 and were analyzed for the hematocrit at various times. n=4 for all groups.

FIG. 4a (figure's left column) shows that intravenous mRNA injection into pigs gave rise to high serum erythropoietin (EH) levels as well as to substantial physiological effects. Animals received 1.3 mg of lipid nanoparticle (LNP) encapsulated porcine Epo mRNA (0.055 mg/kg) on day 0 and were analyzed for EH levels and hematological parameters at various times. Protein levels before treatment were below the limit of detection of the assay. Distinct symbols were assigned to individual animals.

FIG. 4b (figure's right column) shows that intravenous mRNA injection into macaques increased EH levels, reticulocyte numbers as well as the hematocrit. Animals received 100 µg of LNP encapsulated *M. fascicularis* Epo mRNA (0.037 mg/kg) and were analyzed for EH levels and hematological parameters before and at various times after treatment. Distinct symbols were assigned to individual animals.

Figure 1:
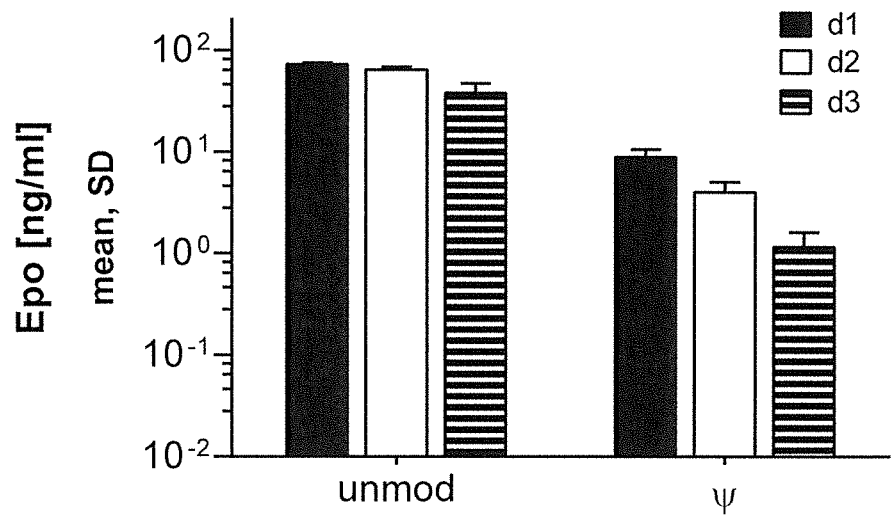
FIG. 1.
Figure 1:
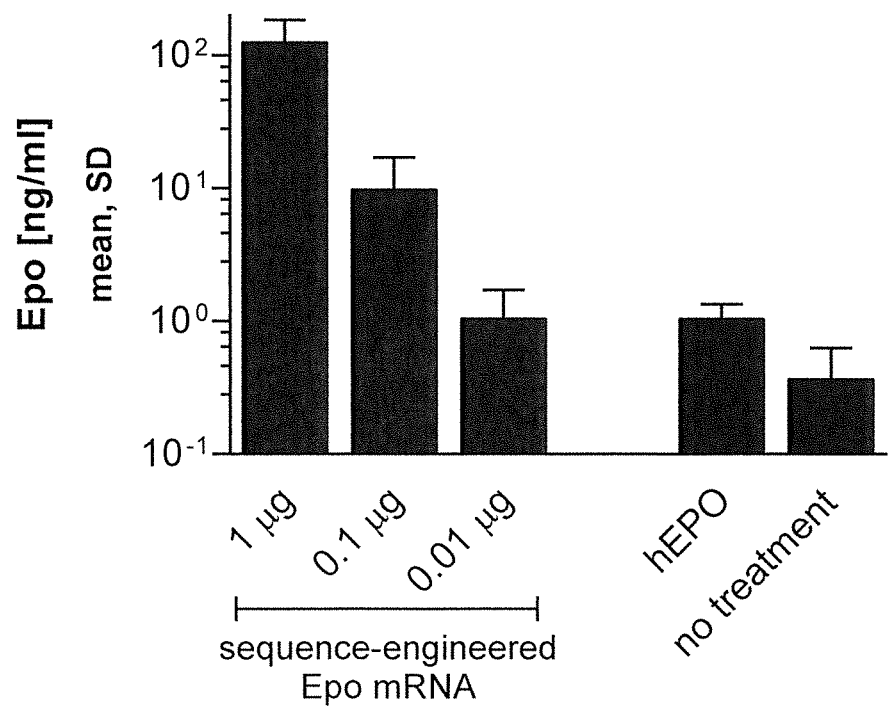

"Pre" corresponds to prevalue before treatment, n=3 for pig experiment, n=4 for macaque study.

EXAMPLES

In the following, particular examples illustrating various embodiments and aspects of the invention are presented. However, the present invention shall not to be limited in scope by the specific embodiments described herein. The following preparations and examples are given to enable those skilled in the art to more clearly understand and to practice the present invention. The present invention, however, is not limited in scope by the exemplified embodiments, which are intended as illustrations of single aspects of the invention only, and methods which are functionally equivalent are within the scope of the invention. Indeed, various modifications of the invention in addition to those described herein will become readily apparent to those skilled in the art from the foregoing description, accompanying figures and the examples below. All such modifications fall within the scope of the appended claims.

Example 1: Preparation of DNA and mRNA Constructs

For the present examples, DNA sequences encoding *Mus musculus* erythropoietin (MmEpo), pig erythropoietin (*Sus scrofa*; SsEpo), and macaque erythropoietin (*Macaca fascicularis*; MfEpo) were prepared and used for subsequent RNA in vitro transcription reactions. The obtained mRNA constructs were used for further in vitro and in vivo experiments. The respective amino acid sequences, the mRNA sequences of MmEpo, SsEpo, and MfEpo as well as preparation details are provided below.

For mRNA sequence engineering, the codons of the open reading frame were adapted according to a proprietary optimization protocol as described in EP 1392341 and EP 1800597 in order to improve translation and half-life of the mRNA. To provide the optimized ORF sequence with an optimal combination of untranslated sequences, it was subjected to a screening process applying preselected sequences. For this preselection of efficacious regulatory sequences, various biological sources were screened for potent enhancer and stabilizer elements (further information is described in patent publications WO 2013/143598 and WO 2013/143599).

For mouse (*Mus musculus*; MmEpo), pig (*Sus scrofa*; SsEpo), and macaque (*Macaca fascicularis*; MfEpo) erythropoietin, only the corresponding RNA sequences of the ORF cassettes (excluding the flanking cloning sites AAGCTT and ACTAGT indicated by three dots in each 5' and 3' end of the respective sequence) are shown.

MmEpo
(SEQ ID NO: 78365)
. . . AUGGGCGUGCCCGAGCGGCCGACCCUGCUCCUGCUGCUCAGCC
UGCUGCUCAUCCCCCUGGGGCUGCCCGUCCUCUGCGCCCCCCGCGCCU
GAUCUGCGACUCCCGGGUGCUGGAGCGCUACAUCCUCGAGGCCAAGGAG
GCGGAGAACGUGACCAUGGGCUGCGCCGAGGGGCCCCGGCUGAGCGAGA
ACAUCACGGUCCCCGACACCAAGGUGAACUUCUACGCCUGGAAGCGCAU
GGAGGUGGAGGAGCAGGCCAUCGAGGUCUGGCAGGGCCUGUCCCUCCUG
AGCGAGGCCAUCCUGCAGGCGCAGGCCCUCCUGGCCAACUCCAGCCAGC
CCCCGGAGACACUGCAGCUCCACAUCGACAAGGCCAUCUCCGGGCUGCG
GAGCCUGACCUCCCUCCUGCGCGUGCUGGGCGCGCAGAAGGAGCUCAUG
AGCCCGCCCGACACGACCCCCCGGCCCCGCUGCGGACCCUGACCGUGG
ACACGUUCUGCAAGCUCUUCCGCGUCUACGCCAACUUCCUGCGGGCAA
GCUGAAGCUCUACACCGGGGAGGUGUGCCGCCGGGGCGACCGCUG
A . . .

SsEpo
(SEQ ID NO: 78367)
. . . AUGGGCGCCCGCGAGUGCCCCGCCCGGCUGCUCCUGCUGAGCC
UCCUGCUGCUCCCGCUGGGGCUGCCCGUGCUCGGCGCGCCCCCGCGCCU
GAUCUGCGACUCCCGGGUCCUGGAGCGCUACAUCCUCGAGGCCAAGGAG
GGGGAGAACGCCACCAUGGGCUGCGCCGAGAGCUGCUCCUUCAGCGAGA
ACAUCACCGUGCCGGACACGAAGGUGAACUUCUACGCCUGGAAGCGGAU
GGAGGUCCAGCAGCAGGCGAUGGAGGUGUGGCAGGGGCUGGCCCUGCUC
UCCGAGGCCAUCCUGCAGGGCCAGGCCCUGCUCGCGAACAGCUCCCAGC
CCAGCGAGGCCCUGCAGCUGCACGUGGACAAGGCCGUCUCCGGCCUCCG
CAGCCUGACCUCCCUGCUCCGGGCCUGGGGGCCCAGAAGGAGGCGAUC
CCCCUGCCCGACGCCAGCCCGUCCAGCGCCACCCCGCUCCGCACCUUCG
CCGUGGACACGCUGUGCAAGCUGUUCCGGAACUACUCCAACUUCCUCCG
CGGCAAGCUGACCCUGUACACCGGGGAGGCCUGCCGGCGCCGGGACCGC
UGA . . .

MfEpo
(SEQ ID NO: 78369)
. . . AUGGGCGUGCACGAGUGCCCGGCCUGGCUCUGGCUGCUGCUCA
GCCUGGUGAGCCUGCCCCUGGGGCUGCCCGUCCCCGGCGCCCCGCCGCG
GCUGAUCUGCGACUCCCGCGUGCUGGAGCGGUACCUCCUCGAGGCCAAG
GAGGCGGAGAACGUGACCAUGGGCUGCUCCGAGAGCUGCUCCCUGAACG

-continued
AGAACAUCACGGUCCCCGACACCAAGGUGAACUUCUACGCCUGGAAGCG
GAUGGAGGUGGGGCAGCAGGCCGUCGAGGUCUGGCAGGGCCUGGCCCUC
CUGAGCGAGGCCGUGCUGCGCGGCCAGGCCGUGCUGGCCAACUCCAGCC
AGCCCUUCGAGCCGCUGCAGCUCCACAUGGACAAGGCCAUCUCCGGGCU
GCGCAGCAUCACCACCCUCCUGCGGGCGCUGGGCGCGCAGGAGGCCAUC
AGCCUGCCCGACGCCGCCAGCGCCGCCCCGCUGCGCACCAUCACCGCGG
ACACGUUCUGCAAGCUCUUCCGGGUCUACUCCAACUUCCUGCGCGGCAA
GCUGAAGCUCUACACCGGGGAGGCCUGCCG
GCGCGGCGACCGGUGA . . .

The corresponding full-length constructs are shown in SEQ ID NO: 78366 (MmEpo, R3134), SEQ ID NO: 78368 (SsEpo, R340) and SEQ ID NO: 78370 (MfEpo, R3516). The constructs were prepared by introducing a 5'-TOP-UTR derived from the ribosomal protein 32L or HSD17B4, modifying the wild type coding sequence by introducing a GC-optimized sequence for stabilization, followed by a stabilizing sequence derived from the albumin-3'-UTR, a stretch of 64 adenosines (poly(A)-sequence), a stretch of cytosines (poly(C)-sequence), and a histone stem loop.

mRNA was produced according to CureVac's PUREmessenger® technology. In brief, enzymatically linearized plasmid harboring the sequence of interest downstream of a T7 promoter was transcribed in vitro using T7 RNA polymerase (Thermo Scientific). MfEpo (R3516) RNA was enzymatically capped. MmEpo (R3134) and SsEpo (R340) were co-transcriptionally capped. For this, m7G capping using cap analog (m7GpppG) and 2'-O-methyltransferase kits (CellScript Script Cap m7G Capping System) were used. Further, an additional poly(A) sequence was generated by enzymatic polyadenylation using a commercially available polyadenylation kits and corresponding protocols known in the art (CellScript A-Plus Poly(A) Polymerase Tailing Kit).

For experiments with chemically-modified nucleosides, 100% replacement was used for mRNAs harboring chemically-modified nucleosides. All mRNAs lacking modified nucleosides (sequence-engineered or not) as well as all nucleoside-modified mRNAs were purified according to the same protocol by reversed-phase chromatography using a PLRP-S stationary phase and an acetonitrile gradient in a triethylammonium acetate buffer (Karikó et al., 2011, Nucleic Acids Res 39: e142).

Example 2: Formulation of mRNA Constructs

For intraperitoneal administration, mRNAs were formulated with TransIT-mRNA (Mirus Bio, Madison, USA) according to Karikó et al. (2012, Mol Ther 20: 948-953). Intravenous administration of mRNA to macaques or pigs was conducted using mRNA encapsulated in LNPs by Acuitas Therapeutics (Vancouver, Canada; LNP formulation according to Jayaraman et al., 2012, Angew Chem Int Ed Engl 51: B529-8533; Maier et al., 2013, Mol Ther 21:1570-157B; and Coelho et al. 2013, N Engl J Med 369:819-829). LNPs were prepared using a self-assembly process in which an aqueous solution of mRNA at pH 4.0 is rapidly mixed with a solution of lipids dissolved in ethanol. LNPs contained an ionizable cationic lipid/phosphatidylcholine/cholesterol/PEG-lipid (50:10:38.5:1.5 mol/mol), encapsulated RNA-to-total lipid ratio of 0.05 (wt/wt) and a diameter of BO nm. At blood pH, LNPs exhibited a net neutral surface charge but become positively charged in acidified endosomes following ApoE-mediated endocytosis by hepatocytes in vivo, which resulted in endosome disruption and release of mRNA into the cytoplasm.

Example 3: Analysis of In Vivo Erythropoietin Protein Levels and Physiological Parameters Reticulocytes, Hematocrit and EPO-Specific Antibody Responses EH Level Measurements For quantification of EH levels in mice, a mouse EH ELISA kit (RED Systems, Wiesbaden, Germany) was also used to determine EH levels in the plasma of treated mice. For plasma preparation, a few microliters of blood were collected, heparinized, and centrifuged.

For quantification of EH levels in pigs, blood samples were collected into serum vials, kept at room temperature for at least 20 minutes, and centrifuged. Porcine EH levels in the supernatant were measured using a mouse EH ELISA kit (RED Systems) with cross reactivity to pig EH and recombinant pig EH protein (Cusabio, Wuhan, China) as standard.

For quantification of EH levels in serum of cynomolgus monkeys a human EH ELISA kit was used (RED Systems) that cross reacts with macaque EH.

Detection of EPO-Specific Antibody Responses

Induction of EPO-specific antibodies in response to repeated treatments with Epo mRNA was analyzed by enzyme-linked immunosorbent assay (ELISA). Therefore, plates were coated with mouse EH protein and incubated with plasma from mice 4 weeks after they received six, injections of mRNA or control solution within 3 weeks. As positive control, a rat anti-mouse EH antibody (RED Systems) was applied in the ELISA. EPO-specific antibodies were detected with goat anti-mouse and anti-rat IgG antisera labelled with peroxidase. The ELISA allowed detection of a concentration of anti-EPO antibody as low as about 100 µg/ml.

Physiological parameters, such as the number of reticulocytes and the hematocrit, were measured as follows:

Reticulocyte Count Measurements

For determination of reticulocyte counts in mice, a small volume of blood was drawn from animals, mixed with an appropriate amount of heparin, and analyzed using Retic-COUNT (BD Biosciences, Heidelberg, Germany) according to the manufacturer's instructions. Stained cells were analyzed on a FACS Canto (BD Biosciences). Reticulocyte levels are given as percentage of total red blood cells.

For determination of reticulocyte counts in pigs, blood was drawn from the cranial vein and collected into ethylenediaminetetraacetate (EDTA)-coated vials. Reticulocytes were measured using a Sysmex, XT-2000iV automated hematology analyzer at Aurigon. Reticulocyte levels are given as percentage of total red blood cells.

For determination of reticulocyte counts in cynomolgus monkeys, blood was collected from a suitable vein, EDTA was added as anticoagulant, and reticulocytes were counted with an Advia 120 hematology system at Huntingdon.

Hematocrit Determinations

For mice, the volume ratio of blood cells was determined using hematocrit capillaries (KABE Labortechnik, Nombrecht-Elsenroth, Germany). In brief, capillaries were filled with heparinized blood, sealed on one end with wax, (Hirschmann Laborgerate, Eberstadt, Germany), centrifuged, and analyzed according to the manufacturer's instructions.

For pigs and macaques, hematocrits were determined with a Sysmex, XT-2000iV and Advia 120 hematology analyzer, respectively.

Example 4: Administration of mRNA Coding for Epo to Mice, Pigs and NHP

Erythropoietin encoding mRNA as described above was administered to mice, pigs and NHP (cynomolgus monkeys).

BALB/c female mice 7-9 weeks of age were purchased from Janvier Labs (Le Denest-Saint-Isle, France). For intraperitoneal injections, TransIT-formulated mRNA encoding murine EH as described above was administered in a total volume of 100 pl (either 5 ng, 50 ng, or 500 ng or respectively 0E5 mg/kg, depending on the experiment).

Hungarian large white, domestic pigs (female, approximately 20 kg) were housed and experiments were conducted at ATRC Aurigon Toxi-Coop Research Center (Dunakeszi, Hungary). For intraperitoneal injection, 360 µg of TransIT-formulated mRNA encoding porcine EPO as described above was administered in a total volume of 25 ml. Animals received two injections on consecutive days. For intravenous administration, pigs received 1.3 mg (0E5 mg/kg) of porcine Epo mRNA formulated with LNPs in phosphate-buffered saline pH 7.4. The total volume per animal was 26 ml.

Cynomolgus monkeys (2.5-2.8 kg) were housed and experiments were performed at Huntingdon Life Science (Huntingdon, UK). Animals received a single intravenous injection of a weight-adjusted dose (0.037 mg/kg) similar to that in mice, corresponding to a dose of LNP-formulated mRNA (100 µg) encoding EPO from *Macaca fascicularis* as described above in phosphate buffered saline pH 7.4. The total volume for intravenous injections was 2 ml.

Example 5: Mice In Vivo Epo Levels Upon Administration of mRNA Coding for Epo

TransIT-complexed sequence-engineered mEpo mRNA was administered intraperitoneal to mice as described above. As apparent from FIG. 1a, sequence-engineered but unmodified mRNA in mice yielded in high protein expression and also was superior to nucleoside-modified variants. As apparent, 1 µg of either unmodified or pseudouridine modified mRNA encoding erythropoietin was complexed with TransIT and intraperitoneally injected into mice. Serum erythropoietin (EPO) levels were determined at different times (I, 2, or 3 days) after administration.

Further, as apparent from FIG. 1b low nanogram doses of engineered, unmodified mouse Epo mRNA gave rise to substantial protein levels in murine serum (amounts of TransIT-complexed unmodified Epo mRNA which were administered intraperitoneally are indicated). As a control, 100 U of recombinant human EPO protein (hEPO) were given intraperitoneally.

Figure 2:
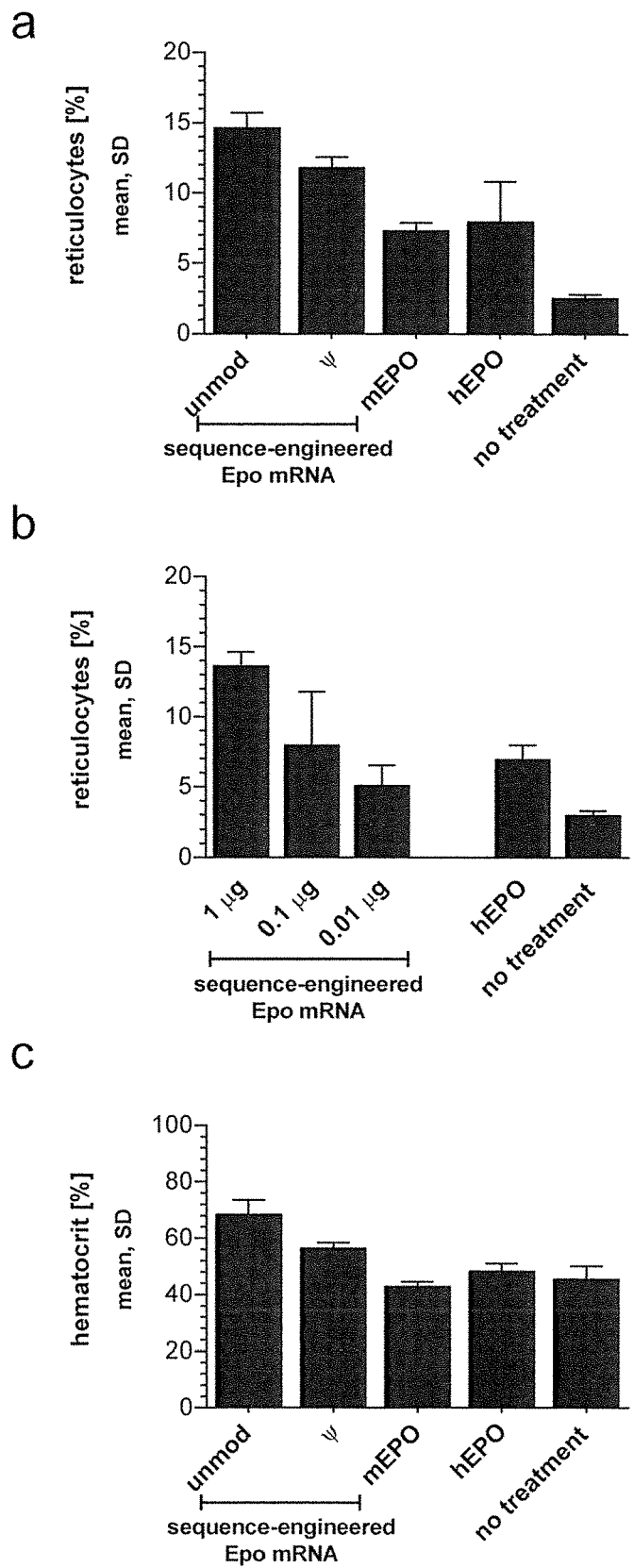
FIG. 2.

Administration of MmEpo-encoding mRNA caused a burst release of reticulocytes representing precursors of mature erythrocytes into the blood stream as apparent from increased reticulocyte numbers in mice (FIG. 2a). As apparent, sequence-engineered mRNA outperformed its pseudouridine-modified counterpart (P<0.01, Student's t-test); all doses down to 10 ng of unmodified mRNA significantly increased reticulocyte numbers (FIG. 2b) (P<0.05 for 10 ng versus untreated, Student's t-test). Likewise, sequence-engineered mouse Epo mRNA substantially increased the hematocrit in mice (FIG. 2O).

Also, as apparent from Example 9 "Measurement of cytokine secretion in mice and NHP" further below, chemically unmodified mRNA did not stimulate a suppressive (immune) response.

Example 6: EPO Expression and Corresponding Physiological Responses Upon Repeated Treatments in Mice For evaluating physiological responses upon repeated treatments in mice, mice received a highly effective dose of TransIT-complexed sequence-engineered mRNA, either unmodified or pseudouridine-modified, every other week. As apparent from FIG. 3a, during the treatment period, doses did not lose efficacy with respect to serum EPO levels obtained 24 hours after administration (P=0.235 for log mRNA, analysis of variance).

Figure 3:
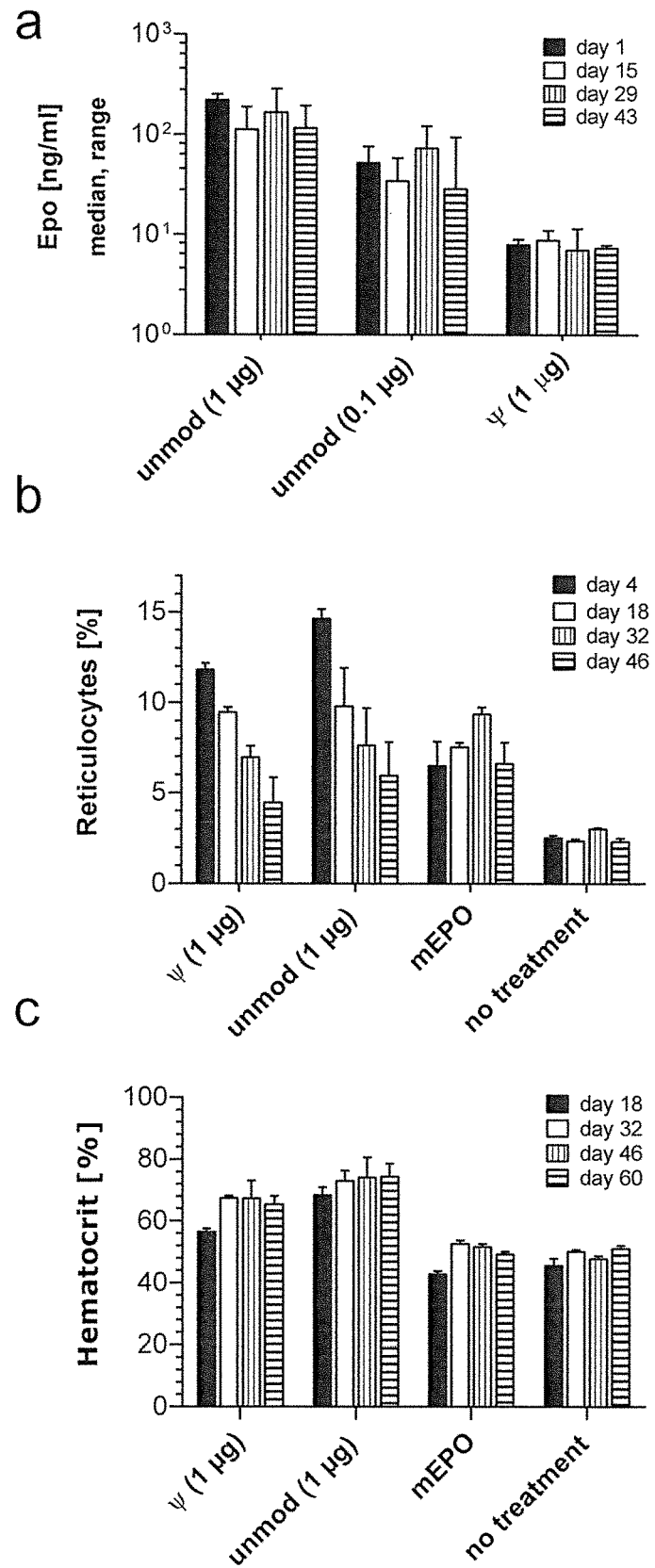
FIG. 3.

As apparent from FIG. 3b, sequence-engineered mRNA elicited higher protein levels than its nucleoside-modified counterpart. In contrast to constant EPO responses, reticulocyte responses to sequential injections declined to some extent over time.

As opposed to mice receiving murine recombinant EPO protein, mRNA-injected animals were characterized by strongly elevated hematocrits (P<0.01 for 1 µg versus untreated on all days, Student's t-test) as well as erythropoiesis induced splenomegaly in the absence of any other disturbances of the spleen (FIG. 30).

Figure 4:
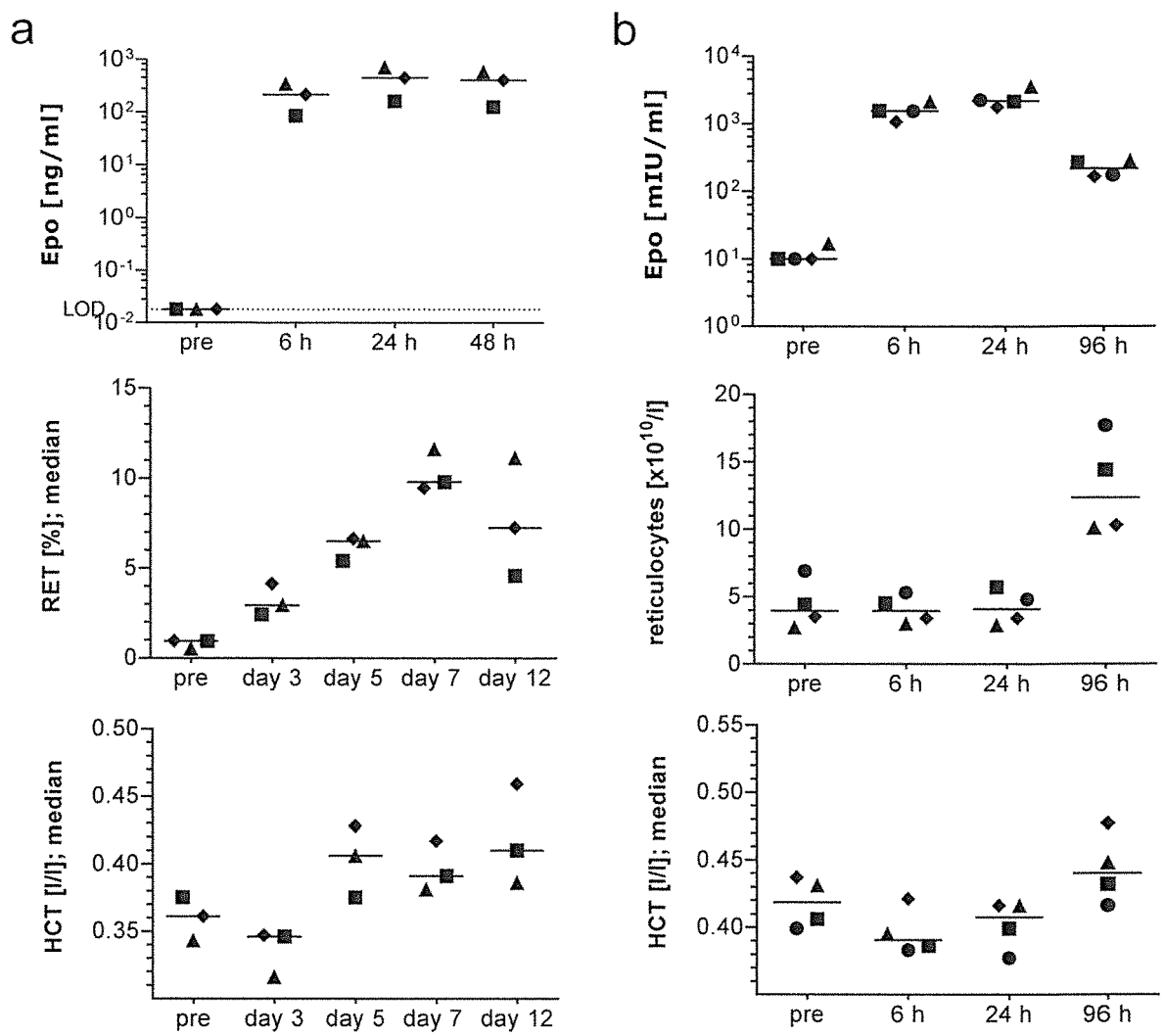
FIG. 4.

Example 7: Pigs In Vivo Epo Levels Upon Administration of mRNA Coding for Epo As described above, pigs were treated with a single intravenous dose of sequence-engineered, unmodified mRNA (1055 mg/kg) encapsulated in LNPs. The resulting high serum EPO levels are shown in FIG. 4a. As a consequence, reticulocyte numbers were strongly increased and animals showed a substantial and sustained elevation of the hematocrit (P<0.05 for day 12 versus pretreatment, Student's t-test) (see FIG. 4a).

Example 8: NHP In Vivo Epo Levels Upon Administration of mRNA Coding for Epo NHP showed very high serum EPO levels and strong physiological responses in vivo after single intravenous dose of sequence-engineered, unmodified mRNA encapsulated in LNPs (FIG. 4b). As a consequence, reticulocyte numbers were strongly increased and animals showed a substantial and meaningful raise of the hematocrit (increase for each individual from pretreatment to 9G hours after treatment; P<0.05 for 9G hours versus pretreatment, Student's t-test). (FIG. 4b).

As apparent from Example 9 "Measurement of cytokine secretion in mice and NHP" further below, chemically unmodified mRNA did not stimulate a suppressive (immune) response.

Example 9: Measurement of Cytokine Secretion in Mice and NHP

Mice received B injections of TransIT-complexed mRNA or control solutions within 3 weeks. B hours after the first and last treatment, blood was collected, heparinized, and plasma preparations were analyzed for various cytokines. TNFA, IL-G and IFNG were measured by Cytometric Bead Array (CBA) analysis (BD Biosciences, Heidelberg, Germany).

Macaques received a single injection of LNP-encapsulated M. fascicularis Epo mRNA. Before and B hours after treatment, blood was drawn and samples were analyzed for cytokines using the MILLIPLEX, Map Non-human primate cytokine magnetic bead panel kit (Merck Millipore, Schwalbach, Germany) at Huntingdon.

Results: immunostimulation of mRNA was at background levels.

None of the mice showed any substantial cytokine release upon mRNA administration; all measurements lay within the range observed for the formulation reagent only (data not shown). Similar results were obtained after six, administrations within 3 weeks (data not shown).

Further, similar to mice, there was no detectable cytokine release upon treatment in NHP upon single intravenous injection of a weight-adjusted dose (0.037 mg/kg) similar to that in mice as described above. (data not shown).

---

SEQUENCE LISTING (78370 sequences)

SEQ ID NO: 1 - protein, 414 aa, Artificial Sequence
  37135__Homo_sapiens__NP_443070
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 2 - protein, 361 aa, Artificial Sequence
  37500__Homo_sapiens__NP_001008492
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 3 - protein, 350 aa, Artificial Sequence
  37865__Homo_sapiens__NP_061979
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 4 - protein, 470 aa, Artificial Sequence
  38231__Homo_sapiens__NP_001185642
MPGFYSVMTDEEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 5 - protein, 346 aa, Artificial Sequence
  38596__Homo_sapiens__NP_001009939
MDSLAAPQDRLVEQLLSPRTQAQRRLKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEGALRLREAAQHAHPHAYARPQGRDVRRALRELPRALHPADDQQTDPGQPHGEPHPDPAAAHPGRRD

SEQ ID NO: 6 - protein, 434 aa, Artificial Sequence
  38961__Homo_sapiens__NP_055944
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNNPWLCTE

SEQ ID NO: 7 - protein, 436 aa, Artificial Sequence
  39326__Homo_sapiens__NP_001011553
MSVSARSAAAEERSVNSSTMAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8 - protein, 586 aa, Artificial Sequence
  40057__Homo_sapiens__NP_001106963
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 9 - protein, 454 aa, Artificial Sequence
  40422__Homo_sapiens__NP_653311
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 10 - protein, 429 aa, Artificial Sequence
  40787__Homo_sapiens__NP_060713
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 11 - protein, 312 aa, Artificial Sequence
  41153__Homo_sapiens__NP_001147930
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCLRPLDIEFLQRLCRTVNVVPVIARADSLTMEEREAFRRRIQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 12 - protein, 432 aa, Artificial Sequence
  41883__Homo_sapiens__NP_997249
MAERTMAMPTQIPADGDTQKENNIRCLTTIGHFGFECLPNQLVSRSIRQGFTFNILCVGETGIGKSTLIDTLFNTNLKDNKSSHFYSNVGLQIQTYELQESNVQLKLTVVETVGYGDQIDKEASYQPIVDYIDAQFEAYLQEELKIKRSLFEYHDSRVHVCLYFISPTGHSLKSLDLLTMKNLDSKVNIIPLIAKADTISKNDLQTFKNKIMSELISNGIQIYQLPTDEETAAQANSSVSGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 13 - protein, 495 aa, Artificial Sequence
  A1BG__Homo_sapiens__NP_570602
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 14 - protein, 586 aa, Artificial Sequence
  A1CF__Homo_sapiens__NP_001185747
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 15 - protein, 1474 aa, Artificial Sequence
  A2M__Homo_sapiens__NP_000005
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 16 - protein, 1454 aa, Artificial Sequence
  A2ML1__Homo_sapiens__NP_653271
MWAQLLLGMLALSPAIAEELPNYLVTLPARLNFPSVQKVCLDLSPGYSDVKFTVTLETKDKTQKLLEYSGLKKRHLHCISFLVPPPAGGTEEVATIRVSGVGNNISFEEKKKVLIQRQGNGTFVQTDKPLYTPGQQVYFRIVTMDSNFVPVNDKYSMVELQDPNSNRIAQWLEVVPEQGIVDLSFQLAPEAMLGTYTVAVAEGKTFGTFSVEEYVLPKFKVEVVEPKELSTVQESFLVKICCRYTYGKPMLGAVQVSVCQKANTYWYREVEREQLPDKCRNLSGQTDKTGCFSAPVDMATFDLIGYAYSHQINIVATVVEEGTGVEANATQNIYISPQMGSMTFEDTSNFYHPNFPFSGKIRVRGHDDSFLKNHLVFLVIYGTNGTFNQTLVTDNNGLAPFTLETSGWNGTDVSLEGKFQMEDLVYNPEQVPRYYQNAYLHLRPFYSTTRSFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADEAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQRNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 17 - protein, 340 aa, Artificial Sequence
  A4GNT__Homo_sapiens__NP_057245
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 18 - protein, 513 aa, Artificial Sequence
  AAAS__Homo_sapiens__NP_001166937
MCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNCTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPCGIIQGEPGAQPQLITFHPSFNKGALLSVGWSTGRIAHIPLYFVNAQFPRFSPVLGRAQEPPAGGGGSIHDLPLFTETSPTSAPWDPLPGPPPVLPHSPHSHL

SEQ ID NO: 19 - protein, 672 aa, Artificial Sequence
  AACS__Homo_sapiens__NP_076417
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 20 - protein, 399 aa, Artificial Sequence
  AADAC__Homo_sapiens__NP_001077
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQLLDDPDVKIKLKIQSLIYPALQPLDVDLPSYQENSNFLFLSKSLMVRFWSEYFTTDRSLEKAMLSRQHVPVESSHLFKFVNWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 21 - protein, 315 aa, Artificial Sequence
  AAGAB__Homo_sapiens__NP_078942
MAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVAKAFWMAIGGDRDEIEGLSSDEEH

SEQ ID NO: 22 - protein, 961 aa, Artificial Sequence
  AAK1__Homo_sapiens__NP_055726
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQQPAIAQFPVVSQGGSQQQLMQNFYQQQQQQQQQQQQQQLATALHQQQLMTQQAALQQKPTMAAGQQPQPQPAAAPQPAPAQEPAIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIEKADVAVESLIPGLEPPVPQRLPSQTESVTSNRTDSLTGEDSLLDCSLLSNPTTDLLEEFAPTAISAPVHKAAEDSNLISGFDVPEGSDKVAEDEFDPIPVLITKNPQGGHSRNSSGSSESSLPNLARSLLLVDQLIDL

SEQ ID NO: 23 - protein, 252 aa, Artificial Sequence
  AANAT__Homo_sapiens__NP_001160051
MEPQSMKGQKRPFGGPWRLKVLGGPPWLRRTLPKLGRPKEAPVARMSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 24 - protein, 155 aa, Artificial Sequence
  AARD__Homo_sapiens__NP_001020528
MGPGDFRRCRERISQGLQGLPGRAELWFPPRPACDFFGDGRSTDIQEEALAASPLLEDLRRRLTRAFQWAVQRAISRRVQEAAAAAAAREEQSWTGVEATLARLRAELVEMHFQNHQLARTLLDLNMKVQQLKKEYELEITSDSQSPKDDAANPE

SEQ ID NO: 25 - protein, 985 aa, Artificial Sequence
  AARS2__Homo_sapiens__NP_065796
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGVFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 26 - protein, 968 aa, Artificial Sequence
  AARS__Homo_sapiens__NP_001596
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 27 - protein, 998 aa, Artificial Sequence
  AASDH__Homo_sapiens__NP_001273597
MKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 28 - protein, 309 aa, Artificial Sequence
  AASDHPPT__Homo_sapiens__NP_056238
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKS

SEQ ID NO: 29 - protein, 926 aa, Artificial Sequence
  AASS__Homo_sapiens__NP_005754
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGYMKALNGFVKLGLINREALPAFRPEANPLTWKQLLCDLVGISPSSEHDVLKEAVLKKLGGDNTQLEAAEWLGLLGDEQVPQAESILDALSKHLVMKLSYGPEEKDMIVMRDSFGIRHPSGHLEHKTIDLVAYGDINGFSAMAKTVGLPTAMAAKMLLDGEIGAKGLMGPFSKEIYGPILERIKAEGIIYTTQSTIKP

SEQ ID NO: 30 - protein, 560 aa, Artificial Sequence
  AATF__Homo_sapiens__NP_036270
MAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 31 - protein, 1374 aa, Artificial Sequence
  AATK__Homo_sapiens__NP_001073864
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 32 - protein, 500 aa, Artificial Sequence
  ABAT__Homo_sapiens__XP_011520703
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 33 - protein, 2277 aa, Artificial Sequence
  ABCA12__Homo_sapiens__NP_056472
MFTYIKIITSGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 34 - protein, 5058 aa, Artificial Sequence
  ABCA13__Homo_sapiens__NP_689914
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNEDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 35 - protein, 2261 aa, Artificial Sequence
  ABCA1__Homo_sapiens__NP_005493
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 36 - protein, 2436 aa, Artificial Sequence
  ABCA2__Homo_sapiens__NP_001597
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 37 - protein, 1704 aa, Artificial Sequence
  ABCA3__Homo_sapiens__NP_001080
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 38 - protein, 1642 aa, Artificial Sequence
  ABCA5__Homo_sapiens__NP_758424
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 39 - protein, 1617 aa, Artificial Sequence
  ABCA6__Homo_sapiens__NP_525023
MNMKQKSVYQQTKALLCKNFLKKWRMKRESLLEWGLSILLGLCIALFSSSMRNVQFPGMAPQNLGRVDKFNSSSLMVVYTPISNLTQQIMNKTALAPLLKGTSVIGAPNKTHMDEILLENLPYAMGIIFNETFSYKLIFFQGYNSPLWKEDFSAHCWDGYGEFSCTLTKYWNRGFVALQTAINTAIIEITTNHPVMEELMSVTAITMKTLPFITKNLLHNEMFILFFLLHFSPLVYFISLNVTKERKKSKNLMKMMGLQDSAFWLSWGLIYAGFIFIISIFVTIIITFTQIIVMTGFMVIFILFFLYGLSLVALVFLMSVLLKKAVLTNLVVFLLTLFWGCLGFTVFYEQLPSSLEWILNICSPFAFTTGMIQIIKLDYNLNGVIFPDPSGDSYTMIATFSMLLLDGLIYLLLALYFDKILPYGDERHYSPLFFLNSSSCFQHQRTNAKVIEKEIDAEHPSDDYFEPVAPEFQGKEAIRIRNVKKEYKGKSGKVEALKGLLFDIYEGQITAILGHSGAGKSSLLNILNGLSVPTEGSVTIYNKNLSEMQDLEEIRKITGVCPQFNVQFDILTVKENLSLFAKIKGIHLKEVEQEVQRILLELDMQNIQDNLAKHLSEGQKRKLTFGITILGDPQILLLDEPTTGLDPFSRDQVWSLLRERRADHVILFSTQSMDEADILADRKVIMSNGRLKCAGSSMFLKRRWGLGYHLSLHRNEICNPEQITSFITHHIPDAKLKTENKEKLVYTLPLERTNTFPDLFSDLDKCSDQGVTGYDISMSTLNEVFMKLEGQSTIEQDFEQVEMIRDSESLNEMELAHSSFSEMQTAVSDMGLWRMQVFAMARLRFLKLKRQTKVLLTLLLVFGIAIFPLIVENIMYAMLNEKIDWEFKNELYFLSPGQLPQEPRTSLLIINNTESNIEDFIKSLKHQNILLEVDDFENRNGTDGLSYNGAIIVSGKQKDYRFSVVCNTKRLHCFPILMNIISNGLLQMFNHTQHIRIESSPFPLSHIGLWTGLPDGSFFLFLVLCSISPYITMGSISDYKKNAKSQLWISGLYTSAYWCGQALVDVSFFILILLLMYLIFYIENMQYLLITSQIVFALVIVTPGYAASLVFFIYMISFIFRKRRKNSGLWSFYFFFASTIMFSITLINHFDLSILITTMVLVPSYTLLGFKTFLEVRDQEHYREFPEANFELSATDFLVCFIPYFQTLLFVFVLRCMELKCGKKRMRKDPVFRISPQSRDAKPNPEEPIDEDEDIQTERIRTATALTTSILDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFDEEIDTTMRWKLLPHSDEP

SEQ ID NO: 40 - protein, 2146 aa, Artificial Sequence
  ABCA7__Homo_sapiens__NP_061985
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEGALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 41 - protein, 1624 aa, Artificial Sequence
  ABCA9__Homo_sapiens__NP_525022
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQILCSIGYVSSLVFLTYVISFIFRNGRKNSGIWSFFFLIVVIFSIVATDLNEYGFLGLFFGTMLIPPFTLIGSLFIFSEISPDSMDYLGASESEIVYLALLIPYLHFLIFLFILRCLEMNCRKKLMRKDPVFRISPRSNAIFPNPEEPEGEEEDIQMERMRTVNAMAVRDFDETPVIIASCLRKEYAGKKKNCFSKRKKKIATRNVSFCVKKGEVIGLLGHNGAGKSTTIKMITGDTKPTAGQVILKGSGGGEPLGFLGYCPQENALWPNLTVRQHLEVYAAVKGLRKGDAMIAITRLVDALKLQDQLKAPVKTLSEGIKRKLCFVLSILGNPSVVLLDEPSTGMDPEGQQQMWQVIRATFRNTERGALLTTHYMAEAEAVCDRVAIMVSGRLRCIGSIQHLKSKFGKDYLLEMKLKNLAQMEPLHAEILRLFPQAAQQERFSSLMVYKLPVEDVRPLSQAFFKLEIVKQSFDLEEYSLSQSTLEQVFLELSKEQELGDLEEDFDPSVKWKLLLQEEP

SEQ ID NO: 42 - protein, 1321 aa, Artificial Sequence
  ABCB11__Homo_sapiens__NP_003733
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 43 - protein, 1280 aa, Artificial Sequence
  ABCB1__Homo_sapiens__NP_000918
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 44 - protein, 1279 aa, Artificial Sequence
  ABCB4__Homo_sapiens__NP_000434
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 45 - protein, 1257 aa, Artificial Sequence
  ABCB5__Homo_sapiens__NP_001157413
MENSERAEEMQENYQRNGTAEEQPKLRKEAVGSIEIFRFADGLDITLMILGILASLVNGACLPLMPLVLGEMSDNLISGCLVQTNTTNYQNCTQSQEKLNEDMTLLTLYYVGIGVAALIFGYIQISLWIITAARQTKRIRKQFFHSVLAQDIGWFDSCDIGELNTRMTDDIDKISDGIGDKIALLFQNMSTFSIGLAVGLVKGWKLTLVTLSTSPLIMASAAACSRMVISLTSKELSAYSKAGAVAEEVLSSIRTVIAFRAQEKELQRYTQNLKDAKDFGIKRTIASKVSLGAVYFFMNGTYGLAFWYGTSLILNGEPGYTIGTVLAVFFSVIHSSYCIGAAVPHFETFAIARGAAFHIFQVIDKKPSIDNFSTAGYKPESIEGTVEFKNVSFNYPSRPSIKILKGLNLRIKSGETVALVGLNGSGKSTVVQLLQRLYDPDDGFIMVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 46 - protein, 842 aa, Artificial Sequence
  ABCB6__Homo_sapiens__NP_005680
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 47 - protein, 752 aa, Artificial Sequence
  ABCB7__Homo_sapiens__NP_001258625
MALLAMHSWRWAAAAAAFEKRRHSAILIRPLVSVSGSGPQWRPHQLGALGTARAYQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 48 - protein, 735 aa, Artificial Sequence
  ABCB8__Homo_sapiens__NP_001269220
MLVHLFRVGIRGGPFPGRLLPPLRFQTFSAVRNTWRNGKTGQLHKAEGEYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 49 - protein, 703 aa, Artificial Sequence
  ABCB9__Homo_sapiens__NP_001229942
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 50 - protein, 1492 aa, Artificial Sequence
  ABCC10__Homo_sapiens__NP_001185863
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 51 - protein, 1382 aa, Artificial Sequence
  ABCC11__Homo_sapiens__NP_115972
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 52 - protein, 1359 aa, Artificial Sequence
  ABCC12__Homo_sapiens__NP_150229
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPVILIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCITYHLLYFNCALRWFALRMDVLMNILTFTVALLVTLSFSSISTSSKGLSLSYIIQLSGLLQVCVRTGTETQAKFTSVELLREYISTCVPECTHPLKVGTCPKDWPSRGEITFRDYQMRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 53 - protein, 1531 aa, Artificial Sequence
  ABCC1__Homo_sapiens__NP_004987
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 54 - protein, 1545 aa, Artificial Sequence
  ABCC2__Homo_sapiens__NP_000383
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 55 - protein, 572 aa, Artificial Sequence
  ABCC3__Homo_sapiens__NP_001137542
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLP

SEQ ID NO: 56 - protein, 859 aa, Artificial Sequence
  ABCC4__Homo_sapiens__NP_001098985
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 57 - protein, 208 aa, Artificial Sequence
  ABCC5__Homo_sapiens__NP_001018881
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPNFQDGCILRSE

SEQ ID NO: 58 - protein, 99 aa, Artificial Sequence
  ABCC6__Homo_sapiens__NP_001072996
MAAPAEPCAGQGVWNQTEPEPAATSLLSLCFLRTAGVWVPPMYLWVLGPIYLLFIHHHGRGYLRMSPLFKAKMVAAIPGSLEPGNVRGRQGTGWNLVKS

SEQ ID NO: 59 - protein, 1581 aa, Artificial Sequence
  ABCC8__Homo_sapiens__NP_000343
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 60 - protein, 1549 aa, Artificial Sequence
  ABCC9__Homo_sapiens__NP_005682
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 61 - protein, 745 aa, Artificial Sequence [sequence omitted]

SEQ ID NO: 62 - protein, 740 aa, Artificial Sequence
  ABCD2__Homo_sapiens__XP_011536329
MTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPKYALLDECTSAVSIDVEGKIFQAAKGAGISLLSITHRPSLWKYHTHLLQFDGEGGWRFEQLDTAIRLTLSEEKQKLESQLAGIPKMQQRLNELCKILGEDSVLKTIKNEDETS

SEQ ID NO: 63 - protein, 347 aa, Artificial Sequence
  ABCD3__Homo_sapiens__XP_011540179
MGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 64 - protein, 606 aa, Artificial Sequence
  ABCD4__Homo_sapiens__NP_005041
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 65 - protein, 599 aa, Artificial Sequence
  ABCE1__Homo_sapiens__NP_002931
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLKERNVEDLSGGELQRFACAVVCIQKADIFMFDEPSSYLDVKQRLKAAITIRSLINPDRYIIVVEHDLSVLDYLSDFICCLYGVPSAYGVVTMPFSVREGINIFLDGYVPTENLRFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 66 - protein, 845 aa, Artificial Sequence
  ABCF1__Homo_sapiens__NP_001020262
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 67 - protein, 634 aa, Artificial Sequence
  ABCF2__Homo_sapiens__NP_005683
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNVCTLTLASLPRP

SEQ ID NO: 68 - protein, 678 aa, Artificial Sequence
  ABCG1__Homo_sapiens__NP_004906
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 69 - protein, 611 aa, Artificial Sequence
  ABCG2__Homo_sapiens__NP_001244315
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMVCWSISQPLHLGCHGFSTSAFHDMDLRLCSIMNFWDKTSAQDSMQQETILVTMQHVLAKNIW

SEQ ID NO: 70 - protein, 646 aa, Artificial Sequence
  ABCG4__Homo_sapiens__NP_001135977
MAEKALEAVGCGLGPGAVAMAVTLEDGAEPPVLTTHLKKVENHITEAQRFSHLPKRSAVDIEFVELSYSVREGPCWRKRGYKTLLKCLSGKFCRRELIGIMGPSGAGKSTFMNILAGYRESGMKGQILVNGRPRELRTFRKMSCYIMQDDMLLPHLTVLEAMMVSANLKLSEKQEVKKELVTEILTALGLMSCSHTRTALLSGGQRKRLAIALELVNNPPVMFFDEPTSGLDSASCFQVVSLMKSLAQGGRTIICTIHQPSAKLFEMFDKLYILSQGQCIFKGVVTNLIPYLKGLGLHCPTYHNPADFIIEVASGEYGDLNPMLFRAVQNGLCAMAEKKSSPEKNEVPAPCPPCPPEVDPIESHTFATSTLTQFCILFKRTFLSILRDTVLTHLRFMSHVVIGVLIGLLYLHIGDDASKVFNNTGCLFFSMLFLMFAALMPTVLTFPLEMAVFMREHLNYWYSLKAYYLAKTMADVPFQVVCPVVYCSIVYWMTGQPAETSRFLLFSALATATALVAQSLGLLIGAASNSLQVATFVGPVTAIPVLLFSGFFVSFKTIPTYLQWSSYLSYVRYGFEGVILTIYGMERGDLTCLEERCPFREPQSILRALDVEDAKLYMDFLVLGIFFLALRLLAYLVLRYRVKSER

SEQ ID NO: 71 - protein, 651 aa, Artificial Sequence
  ABCG5__Homo_sapiens__NP_071881
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 72 - protein, 673 aa, Artificial Sequence
  ABCG8__Homo_sapiens__NP_071882
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAELRLRQCADTRVGNMYVRGLSGGERRRVSIGVQLLWNPGILILDEPTSGLDSFTAHNLVKTLSRLAKGNRLVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGAEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMALAAAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 73 - protein, 362 aa, Artificial Sequence
  ABHD12B__Homo_sapiens__NP_001193602
MDAQDCQAAASPEPPGPPARSCVAAWWDMVDRNLRYFPHSCSMLGRKIAALYDSFTSKSLKEHVFLPLIDMLIYFNFFKAPFLVDLKKPELKIPHTVNFYLRVEPGVMLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 74 - protein, 398 aa, Artificial Sequence
  ABHD12__Homo_sapiens__NP_001035937
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 75 - protein, 525 aa, Artificial Sequence
  ABHD16A__Homo_sapiens__NP_001170986
MPPPALFLSSLYPRLEFQNDFYRSCIRRSSPQPPPNLAWRPESLYSGELAGGGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 76 - protein, 288 aa, Artificial Sequence
  ABHD17B__Homo_sapiens__NP_001020951
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVNL

SEQ ID NO: 77 - protein, 425 aa, Artificial Sequence
  ABHD2__Homo_sapiens__XP_005254890
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 78 - protein, 349 aa, Artificial Sequence
  ABHD5__Homo_sapiens__NP_057090
MAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 79 - protein, 337 aa, Artificial Sequence
  ABHD6__Homo_sapiens__NP_065727
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 80 - protein, 481 aa, Artificial Sequence
  ABI1__Homo_sapiens__NP_001012768
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 81 - protein, 513 aa, Artificial Sequence
  ABI2__Homo_sapiens__NP_001269854
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 82 - protein, 1075 aa, Artificial Sequence
  ABI3BP__Homo_sapiens__NP_056244
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 83 - protein, 360 aa, Artificial Sequence
  ABI3__Homo_sapiens__NP_001128658
MAELQQLQEFEIPTGREALRGNHSALLRVADYCEDNYVQATDKRKALEETMAFTTQALASVAYQVGNLAGHTLRMLDLQGAALRQVEARMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSASSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 84 - protein, 1130 aa, Artificial Sequence
  ABL1__Homo_sapiens__NP_005148
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 85 - protein, 1064 aa, Artificial Sequence
  ABL2__Homo_sapiens__NP_001129472
MVLGTVLLPPNSYGRDQDTSLCCLCTEASESALPDLTDHFASCVEDGFEGDKTGGSSPEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 86 - protein, 718 aa, Artificial Sequence
  ABLIM1__Homo_sapiens__NP_001003407
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 87 - protein, 645 aa, Artificial Sequence
  ABLIM2__Homo_sapiens__NP_001123555
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 88 - protein, 354 aa, Artificial Sequence
  ABO__Homo_sapiens__NP_065202
MAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 89 - protein, 381 aa, Artificial Sequence
  ABRA__Homo_sapiens__NP_631905
MAPGEKESGEGPAKSALRKIRTATLVISLARGWQQWANENSIRQAQEPTGWLPGGTQDSPQAPKPITPPTSHQKAQSAPKSPPRLPEGHGDGQSSEKAPEVSHIKKKEVSKTVVSKTYERGGDVSHLSHRYERDAGVLEPGQPENDIDRILHSHGSPTRRRKCANLVSELTKGWRVMEQEEPTWRSDSVDTEDSGYGGEAEERPEQDGVQVAVVRIKRPLPSQVNRFTEKLNCKAQQKYSPVGNLKGRWQQWADEHIQSQKLNPFSEEFDYELAMSTRLHKGDEGYGRPKEGTKTAERAKRAEEHIYREMMDMCFIICTMARHRRDGKIQVTFGDLFDRYVRISDKVVGILMRARKHGLVDFEGEMLWQGRDDHVVITLLK

SEQ ID NO: 90 - protein, 813 aa, Artificial Sequence
  ABR__Homo_sapiens__NP_001153218
MPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 91 - protein, 272 aa, Artificial Sequence
  ABT1__Homo_sapiens__NP_037507
MEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKRSYTKDYTEGWVEFRDKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 92 - protein, 331 aa, Artificial Sequence
  ACAA1__Homo_sapiens__NP_001123882
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGITSENVAERFGISREKQDTFALASQQKAARAQSKGCFQAEIVPVTTTVHDDKGTKRSITVTQDEGIRPSTTMEGLAKLKPAFKKDGSTTAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 93 - protein, 397 aa, Artificial Sequence
  ACAA2__Homo_sapiens__NP_006102
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 94 - protein, 2383 aa, Artificial Sequence
  ACACA__Homo_sapiens__NP_942131
MWWSTLMSILRARSFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 95 - protein, 2458 aa, Artificial Sequence
  ACACB__Homo_sapiens__XP_011536564
MVLLLCLSCLIFSCLTFSWLKIWGKMTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASENPKLPELLCKNGVAFLGPPSEAMWALGDKIASTVVAQTLQVPTLPWSGSGLTVEWTEDDLQQGKRISVPEDVYDKGCVKDVDEGLEAAERIGFPLMIKASEGGGGKGIRKAESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGVPLHRLKDIRLLYGESPWGVTPISFETPSNPPLARGHVIAARITSENPDEGFKPSSGTVQELNFRSSKNVWGYFSVAATGGLHEFADSQFGHCFSWGENREEAISNMVVALKELSIRGDFRTTVEYLINLLETESFQNNDIDTGWLDYLIAEKVQAEKPDIMLGVVCGALNVADAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQRYRSGIRGYMKTVVLDLLRRYLRVEHHFQQAHYDKCVINLREQFKPDMSQVLDCIFSHAQVAKKNQLVIMLIDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 96 - protein, 1090 aa, Artificial Sequence
  ACAD10__Homo_sapiens__NP_001130010
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKRQGFAVLPKLVSNSWAQAIYPPYPPKVVRLQVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 97 - protein, 415 aa, Artificial Sequence
  ACAD8__Homo_sapiens__NP_055199
MLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 98 - protein, 621 aa, Artificial Sequence
  ACAD9__Homo_sapiens__NP_054768
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 99 - protein, 430 aa, Artificial Sequence [sequence omitted]

SEQ ID NO: 100 - protein, 432 aa, Artificial Sequence
  ACADSB__Homo_sapiens__NP_001600
MEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 101 - protein, 412 aa, Artificial Sequence
  ACADS__Homo_sapiens__NP_000008
MAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 102 - protein, 655 aa, Artificial Sequence
  ACADVL__Homo_sapiens__NP_000009
MQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 103 - protein, 2431 aa, Artificial Sequence
  ACAN__Homo_sapiens__NP_001126
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 104 - protein, 427 aa, Artificial Sequence
  ACAT1__Homo_sapiens__NP_000010
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 105 - protein, 426 aa, Artificial Sequence
  ACAT2__Homo_sapiens__NP_001290182
MGSHPVLRIWGNRRATAASLGRSGGRLSSPRLLRVVAPTLTFAQTSRCSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 106 - protein, 528 aa, Artificial Sequence
  ACBD3__Homo_sapiens__NP_073572
MAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQEKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFWEFATDNYDIGFGVYFEWTDSPNTAVSVHVSESSDDDEEEEENIGCEEKAKKNANKPLLDEIVPVYRRDCHEEVYAGSHQYPGRGVYLLKFDNSYSLWRSKSVYYRVYYTR

SEQ ID NO: 107 - protein, 341 aa, Artificial Sequence
  ACBD4__Homo_sapiens__NP_001129176
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPASLWAVTLPTPPQSPIHPGTWTPRFSVIPWSSWSLSWFGQSSGQHLEESVIPGTAPCPPQRKRGCGAARRGPRSWTCGCWGQFEHYRRACRRCRRGCRAWRACPGPLSRGRSPGPVLGHGPLGSRGPRCSSSSCGPSSSSGSSECFGPKRGDCQWRGLCSQLRLSCCALSLPRV

SEQ ID NO: 108 - protein, 490 aa, Artificial Sequence
  ACBD5__Homo_sapiens__NP_001035938
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 109 - protein, 282 aa, Artificial Sequence
  ACBD6__Homo_sapiens__NP_115736
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 110 - protein, 501 aa, Artificial Sequence
  ACCS__Homo_sapiens__NP_115981
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 111 - protein, 544 aa, Artificial Sequence
  ACD__Homo_sapiens__NP_001075955
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 112 - protein, 805 aa, Artificial Sequence [sequence omitted]

SEQ ID NO: 113 - protein, 1306 aa, Artificial Sequence
  ACE__Homo_sapiens__NP_000780
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 114 - protein, 275 aa, Artificial Sequence [sequence omitted]

SEQ ID NO: 115 - protein, 230 aa, Artificial Sequence
  ACER3__Homo_sapiens__NP_001287882
MAPAADREGYWGPTTSTLDWCEENYSVTWYIAEFLVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 116 - protein, 526 aa, Artificial Sequence
  ACHE__Homo_sapiens__NP_001269378
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 117 - protein, 1328 aa, Artificial Sequence
  ACIN1__Homo_sapiens__NP_001158286
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSTKGVPAGNSDTEGGQPGRKRRWGASTATTQKKPSISITTESLKEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 118 - protein, 338 aa, Artificial Sequence
  ACKR1__Homo_sapiens__NP_001116423
MASSGYVLQAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 119 - protein, 384 aa, Artificial Sequence
  ACKR2__Homo_sapiens__NP_001287
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 120 - protein, 362 aa, Artificial Sequence
  ACKR3__Homo_sapiens__XP_005246155
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 121 - protein, 350 aa, Artificial Sequence
  ACKR4__Homo_sapiens__NP_848540
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 122 - protein, 1155 aa, Artificial Sequence
  ACLY__Homo_sapiens__NP_001290203
MGAGKSPAGPGQKPDPGKLPAAGVLRILRGSSGLWKKRRARTSAETGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 123 - protein, 336 aa, Artificial Sequence
  ACMSD__Homo_sapiens__NP_612199
MKIDIHSHILPKEWPDLKKRFGYGGWVQLQHHSKGEAKLLKDGKVFRVVRENCWDPEVRIREMDQKGVTVQALSTVPVMFSYWAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 124 - protein, 889 aa, Artificial Sequence
  ACO1__Homo_sapiens__NP_002188
MSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGLTPREFNSYGSRRGNDAVMARGTFANIRLLNRFLNKQAPQTIHLPSGEILDVFDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 125 - protein, 780 aa, Artificial Sequence
  ACO2__Homo_sapiens__NP_001089
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 126 - protein, 117 aa, Artificial Sequence
  ACOT13__Homo_sapiens__NP_001153566
MVRKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 127 - protein, 421 aa, Artificial Sequence
  ACOT1__Homo_sapiens__NP_001032238
MAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCRVRHERYFLPPGVRREPVRAGRVRGTLFLPPEPGPFPGIVDMFGTGGGLLEYRASLLAGKGFAVMALAYYNYEDLPKTMETLHLEYFEEAVNYLLSHPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 128 - protein, 483 aa, Artificial Sequence
  ACOT2__Homo_sapiens__NP_006812
MSNKLLSPHPHSVVLRSEFKMASSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPEPGPFPGIVDMFGTGGGLLEYRASLLAGKGFAVMALAYYNYEDLPKTMETLHLEYFEEAMNYLLSHPEVKGPGVGLLGISKGGELCLSMASFLKGITAAVVINGSVANVGGTLHYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 129 - protein, 439 aa, Artificial Sequence
  ACOT9__Homo_sapiens__NP_001028755
MRRAALRLCALGKGQLTPGRGLTQGPQNPKKQGIFHIHEVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 130 - protein, 622 aa, Artificial Sequence
  ACOX1__Homo_sapiens__NP_001171968
MILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 131 - protein, 681 aa, Artificial Sequence
  ACOX2__Homo_sapiens__NP_003491
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 132 - protein, 624 aa, Artificial Sequence
  ACOX3__Homo_sapiens__NP_001095137
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRAERRCSCPGRRDRSS

SEQ ID NO: 133 - protein, 580 aa, Artificial Sequence
  ACOXL__Homo_sapiens__NP_001136279
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQLLDLCDSVKDDARRVISTFNIPHTYLHAPIAGISNPRAAWAFYPAPLQPRPREEARSRRPKLGAKL

SEQ ID NO: 134 - protein, 112 aa, Artificial Sequence
  ACP1__Homo_sapiens__NP_001035739
MAEQATKSVLFVCLGNICRSPIAEAVFRKLVTDQNISENWRVDSAATSGYEIGNPPDYRGQSCMKRHGIPMSHVARQVPSLDLKLCVLCFSGSLTAVLFLTGTWAGPQTQEL

SEQ ID NO: 135 - protein, 391 aa, Artificial Sequence
  ACP2__Homo_sapiens__NP_001289419
MAGKRSGWSRAALLQLLLGVNLVVMPPTRARSLRFVTLEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 136 - protein, 325 aa, Artificial Sequence
  ACP5__Homo_sapiens__NP_001104506
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 137 - protein, 401 aa, Artificial Sequence
  ACP6__Homo_sapiens__XP_011507903
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKDLQVASITGMKKILGLFQPH

SEQ ID NO: 138 - protein, 386 aa, Artificial Sequence
  ACPP__Homo_sapiens__NP_001090
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 139 - protein, 543 aa, Artificial Sequence
  ACRBP__Homo_sapiens__NP_115878
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 140 - protein, 691 aa, Artificial Sequence
  ACRC__Homo_sapiens__XP_011529367
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAPDDSSDDSEAPDDSSDDSEAPDDSSDDSEASDDSSDDSEASDDSSDDSEAPDDKSDDSDVPEDKSDDSDVPDDNSDDLEVPVPAEDLCNEGQIASDEEELVEAAAAVSQHDSSDDAGEQDLGENLSKPPSDPEANPEVSERKLPTEEEPAPVVEQSGKRKSKTKTIVEPPRKRQTKTKNIVEPPRKRQTKTKNIVEPLRKRKAKTKNVSVTPGHKKRGPSKKKPGAAKVEKRKTRTPKCKVPGCFLQDLEKSKKYSGKNLKRNKDELVQRIYDLFNRSVCDKKLPEKLRIGWNNKMVKTAGLCSTGEMWYPKWRRFAKIQIGLKVCDSADRIRDTLIHEMCHAASWLIDGIHDSHGDAWKYYARKSNRIHPELPRVTRCHNYKINYKVHYECTGCKTRIGCYTKSLDTSRFICAKCKGSLVMVPLTQKDGTRIVPHV

SEQ ID NO: 141 - protein, 421 aa, Artificial Sequence
  ACR__Homo_sapiens__NP_001088
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 142 - protein, 265 aa, Artificial Sequence
  ACRV1__Homo_sapiens__NP_001603
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 143 - protein, 724 aa, Artificial Sequence
  ACSBG1__Homo_sapiens__NP_055977
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 144 - protein, 666 aa, Artificial Sequence
  ACSBG2__Homo_sapiens__NP_001276107
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 145 - protein, 576 aa, Artificial Sequence
  ACSF3__Homo_sapiens__NP_777577
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 146 - protein, 664 aa, Artificial Sequence
  ACSL1__Homo_sapiens__NP_001273640
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 147 - protein, 720 aa, Artificial Sequence
  ACSL3__Homo_sapiens__NP_976251
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 148 - protein, 739 aa, Artificial Sequence
  ACSL5__Homo_sapiens__NP_057318
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 149 - protein, 722 aa, Artificial Sequence
  ACSL6__Homo_sapiens__NP_001009185
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 150 - protein, 577 aa, Artificial Sequence
  ACSM1__Homo_sapiens__NP_001305819
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRLQLSKAKGIVTIDALASEVDSIASQCPSLKTKLLVSDHSREGWLDFRSLVKSASPEHTCVKSKTLDPMVIFFTSGTTGFPKMAKHSHGLALQPSFPGSRKLRSLKTSDVSWCLSDSGWIVATIWTLVEPWTAGCTVFIHHLPQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQVIDDKGSILPPNTEGNIGIRIKPVRPVSLFMCYEGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 151 - protein, 577 aa, Artificial Sequence
  ACSM2B__Homo_sapiens__NP_001098539
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 152 - protein, 586 aa, Artificial Sequence
  ACSM3__Homo_sapiens__NP_005613
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEVVKAFVVLNPDYKSHDQEQLIKEIQEHVKKTTAPYKYPRKVEFIQELPKTISGKTKRNELRKKEWKTI

SEQ ID NO: 153 - protein, 568 aa, Artificial Sequence
  ACSS1__Homo_sapiens__NP_001239605
MRRRKERQPWDRFHFLHFAPHGRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 154 - protein, 714 aa, Artificial Sequence
  ACSS2__Homo_sapiens__NP_001070020
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQGKLKEKSKRVQPQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 155 - protein, 686 aa, Artificial Sequence
  ACSS3__Homo_sapiens__NP_078836
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 156 - protein, 377 aa, Artificial Sequence
  ACTA1__Homo_sapiens__NP_001091
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 157 - protein, 377 aa, Artificial Sequence
  ACTA2__Homo_sapiens__XP_011538318
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 158 - protein, 375 aa, Artificial Sequence
  ACTB__Homo_sapiens__NP_001092
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 159 - protein, 376 aa, Artificial Sequence
  ACTBL2__Homo_sapiens__NP_001017992
MTDNELSALVVDNGSGMCKAGFGGDDAPRAVFPSMIGRPRHQGVMVGMGQKDCYVGDEAQSKRGVLTLKYPIEHGVVTNWDDMEKIWYHTFYNELRVAPDEHPILLTEAPLNPKINREKMTQIMFEAFNTPAMYVAIQAVLSLYASGRTTGIVMDSGDGVTHIVPIYEGYALPHAILRLDLAGRDLTDYLMKILTERGYNFTTTAEREIVRDVKEKLCYVALDFEQEMVRAAASSSPERSYELPDGQVITIGNERFRCPEAIFQPSFLGIESSGIHETTFNSIMKCDVDIRKDLYANTVLSGGSTMYPGIADRMQKEIITLAPSTMKIKIIAPPERKYSVWIGGSILASLSTFQQMWISKQEYDEAGPPIVHRKCF

SEQ ID NO: 160 - protein, 377 aa, Artificial Sequence
  ACTC1__Homo_sapiens__NP_005150
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 161 - protein, 375 aa, Artificial Sequence
  ACTG1__Homo_sapiens__NP_001605
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 162 - protein, 333 aa, Artificial Sequence
  ACTG2__Homo_sapiens__NP_001186822
MCEEETTALVCDNGSGLCKAGFAGDDAPRAVFPSIVGRPRHQIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 163 - protein, 429 aa, Artificial Sequence
  ACTL6A__Homo_sapiens__NP_004292
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 164 - protein, 426 aa, Artificial Sequence
  ACTL6B__Homo_sapiens__NP_057272
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 165 - protein, 391 aa, Artificial Sequence
  ACTL8__Homo_sapiens__XP_011540513
MSLLPPRESPAASSSTSVPPTSASAMAARTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 166 - protein, 416 aa, Artificial Sequence
  ACTL9__Homo_sapiens__NP_848620
MDASRPKSSESQSSLEAPRPGPNPSPNVVNKPLQRDSPGMVADRLPPKTGAVVIDMGTGTCKVGFAGQASPTYTVATILGCQPKKPATSGQSGLQTFIGEAARVLPELTLVQPLRSGIVVDWDAAELIWRHLLEHDLRVATHDHPLLFSDPPFSPATNREKLVEVAFESLRSPAMYVASQSVLSVYAHGRVSGLVVDTGHGVTYTVPVFQGYNLLHATERLDLAGNNLTAFLAEMLLQAGLPLGQQDLDLVENIKHHYCYVASDFQKEQARPEQEYKRTLKLPDGRTVTLGKELFQCPELLFNPPEVPGLSPVGLSTMAKQSLRKLSLEMRADLAQNVLLCGGSSLFTGFEGRFRAELLRALPAETHVVVAAQPTRNFSVWIGGSILASLRAFQSCWVLREQYEEQGPYIVYRKCY

SEQ ID NO: 167 - protein, 892 aa, Artificial Sequence
  ACTN1__Homo_sapiens__NP_001093
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 168 - protein, 894 aa, Artificial Sequence
  ACTN2__Homo_sapiens__NP_001094
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 169 - protein, 901 aa, Artificial Sequence
  ACTN3__Homo_sapiens__NP_001095
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDRLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSCDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKQNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 170 - protein, 911 aa, Artificial Sequence
  ACTN4__Homo_sapiens__NP_004915
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 171 - protein, 376 aa, Artificial Sequence
  ACTR1A__Homo_sapiens__NP_005727
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 172 - protein, 376 aa, Artificial Sequence
  ACTR1B__Homo_sapiens__NP_005726
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 173 - protein, 399 aa, Artificial Sequence
  ACTR2__Homo_sapiens__NP_001005386
MDSQGRKVVVCDNGTGFVKCGYAGSNFPEHIFPALVGRPIIRSTTKVGNIEIKNNKKMDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 174 - protein, 348 aa, Artificial Sequence
  ACTR3B__Homo_sapiens__NP_001035225
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKPEFFQVCHTKKDYEEYGPSICRHNPVFGVMS

SEQ ID NO: 175 - protein, 367 aa, Artificial Sequence
  ACTR3__Homo_sapiens__NP_001264069
MKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 176 - protein, 607 aa, Artificial Sequence
  ACTR5__Homo_sapiens__NP_079131
MAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAEDYVEELHKWRCPDYYENNVHKMQLPFSSKLLGSTLTSEEKQERRQQQLRRLQELNARRREEKLQLDQERLDRLLYVQELLEDGQMDQFHKALIELNMDSPEELQSYIQKLSIAVEQAKQKILQAEVNLEVDVVDSKPETPDLEQLEPSLEDVESMNDFDPLFSEETPGVEKPVTTVQPVFNLAAYHQLFVGTERIRAPEIIFQPSLIGEEQAGIAETLQYILDRYPKDIQEMLVQNVFLTGGNTMYPGMKARMEKELLEMRPFRSSFQVQLASNPVLDAWYGARDWALNHLDDNEVWITRKEYEEKGGEYLKEHCASNIYVPIRLPKQASRSSDAQASSKGSAAGGGGAGEQA

SEQ ID NO: 177 - protein, 376 aa, Artificial Sequence
  ACTRT1__Homo_sapiens__NP_612146
MFNPHALDVPAVIFDNGSGLCKAGLSGEIGPRHVISSVLGHCKFNVPLARLNQKYFVGQEALYKYEALHLHYPIERGLVTGWDDMEKLWKHLFERELGVKPSQQPVLMTEPSLNPREIREKLAEMMFETFSVPGFYLSNHAVAALYASACVTGLVVDSGDGVTCTVPIFEGYSLPHAVTKLCMAGRDITEHLTRLLFASGFNFPCILNKAVVNNIKEKLCYIALEPEKELRKSRGEVLGAYRLPDGHVIHFGDELYQVPEVLFAPDQLGIHSPGLSKMVSSSIMKCDTDIQNKLYADIVLSGGTTLLPGLEERLMKEVEQLASKGTPIKITASPDRCFSAWIGASIMTSMSSFKQMWVTSADFKEYGTSVVQRRCF

SEQ ID NO: 178 - protein, 505 aa, Artificial Sequence
  ACVR1B__Homo_sapiens__NP_004293
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 179 - protein, 443 aa, Artificial Sequence
  ACVR1C__Homo_sapiens__NP_001104501
MLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 180 - protein, 509 aa, Artificial Sequence
  ACVR1__Homo_sapiens__NP_001096
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 181 - protein, 513 aa, Artificial Sequence
  ACVR2A__Homo_sapiens__NP_001265508
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 182 - protein, 512 aa, Artificial Sequence
  ACVR2B__Homo_sapiens__NP_001097
MTAPWVALALLWGSLCAGSGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 183 - protein, 503 aa, Artificial Sequence
  ACVRL1__Homo_sapiens__NP_001070869
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 184 - protein, 408 aa, Artificial Sequence
  ACY1__Homo_sapiens__NP_001185824
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 185 - protein, 319 aa, Artificial Sequence
  ACY3__Homo_sapiens__NP_542389
MCSLPVPREPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 186 - protein, 99 aa, Artificial Sequence
  ACYP2__Homo_sapiens__NP_612457
MSTAQSLKSVDYEVFGRVQGVCFRMYTEDEARKIGVVGWVKNTSKGTVTGQVQGPEDKVNSMKSWLSKVGSPSSRIDRTNFSNEKTISKLEYSNFSIRY

SEQ ID NO: 187 - protein, 565 aa, Artificial Sequence
  ADAD1__Homo_sapiens__NP_001152757
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 188 - protein, 363 aa, Artificial Sequence
  ADA__Homo_sapiens__NP_000013
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 189 - protein, 748 aa, Artificial Sequence
  ADAM10__Homo_sapiens__NP_001101
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 190 - protein, 769 aa, Artificial Sequence
  ADAM11__Homo_sapiens__NP_002381
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 191 - protein, 735 aa, Artificial Sequence
  ADAM12__Homo_sapiens__NP_001275904
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 192 - protein, 824 aa, Artificial Sequence
  ADAM15__Homo_sapiens__NP_001248393
MRLALLWALGLLGAGSPLPSWPLPNIVLSWGVLGPAGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 193 - protein, 824 aa, Artificial Sequence
  ADAM17__Homo_sapiens__NP_003174
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 194 - protein, 918 aa, Artificial Sequence
  ADAM19__Homo_sapiens__NP_150377
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 195 - protein, 776 aa, Artificial Sequence
  ADAM20__Homo_sapiens__XP_005268209
MVQLHQDTDPQIPKGQPCTLNSSEGGARPAVPHTLFSSALDRWLHNDSFIMAVGEPLVHIRVTLLLLWFGMFLSISGHSQARPSQYFTSPEVVIPLKVISRGRGAKAPGWLSYSLRFGGQRYIVHMRVNKLLFAAHLPVFTYTEQHALLQDQPFIQDDCYYHGYVEGVPESLVALSTCSGGFLGMLQINDLVYEIKPISVSATFEHLVYKIDSDDTQFPPMRCGLTEEKIAHQMELQLSYNFTLKQSSFVGWWTHQRFVELVVVVDNIRYLFSQSNATTVQHEVFNVVNIVDSFYHPLEVDVILTGIDIWTASNPLPTSGDLDNVLEDFSIWKNYNLNNRLQHDVAHLFIKDTQGMKLGVAYVKGICQNPFNTGVDVFEDNRLVVFAITLGHELGHNLGMQHDTQWCVCELQWCIMHAYRKVTTKFSNCSYAQYWDSTISSGLCIQPPPYPGNIFRLKYCGNLVVEEGEECDCGTIRQCAKDPCCLLNCTLHPGAACAFGICCKDCKFLPSGTLCRQQVGECDLPEWCNGTSHQCPDDVYVQDGISCNVNAFCYEKTCNNHDIQCKEIFGQDARSASQSCYQEINTQGNRFGHCGIVGTTYVKCWTPDIMCGRVQCENVGVIPNLIEHSTVQQFHLNDTTCWGTDYHLGMAIPDIGEVKDGTVCGPEKICIRKKCASMVHLSQACQPKTCNMRGICNNKQHCHCNHEWAPPYCKDKGYGGSADSGPPPKNNMEGLNVMGKLRYLSLLCLLPLVAFLLFCLHVLFKKRTKSKEDEEG

SEQ ID NO: 196 - protein, 722 aa, Artificial Sequence
  ADAM21__Homo_sapiens__NP_003804
MAVDGTLVYIRVTLLLLWLGVFLSISGYCQAGPSQHFTSPEVVIPLKVISRGRSAKAPGWLSYSLRFGGQKHVVHMRVKKLLVSRHLPVFTYTDDRALLEDQLFIPDDCYYHGYVEAAPESLVVFSACFGGFRGVLKISGLTYEIEPIRHSATFEHLVYKINSNETQFPAMRCGLTEKEVARQQLEFEEAENSALEPKSAGDWWTHAWFLELVVVVNHDFFIYSQSNISKVQEDVFLVVNIVDSMYKQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRGVFLPLIVIPSLSVLTFLFTVGLLMYLRQCSGPKETKAHSSG

SEQ ID NO: 197 - protein, 870 aa, Artificial Sequence
  ADAM22__Homo_sapiens__NP_057435
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 198 - protein, 832 aa, Artificial Sequence
  ADAM23__Homo_sapiens__NP_003803
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 199 - protein, 775 aa, Artificial Sequence
  ADAM28__Homo_sapiens__NP_055080
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPVSTPKDSNPKA

SEQ ID NO: 200 - protein, 820 aa, Artificial Sequence
  ADAM29__Homo_sapiens__NP_001265056
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 201 - protein, 716 aa, Artificial Sequence
  ADAM2__Homo_sapiens__NP_001265042
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 202 - protein, 812 aa, Artificial Sequence
  ADAM33__Homo_sapiens__NP_001269376
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 203 - protein, 754 aa, Artificial Sequence
  ADAM7__Homo_sapiens__NP_003808
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 204 - protein, 824 aa, Artificial Sequence
  ADAM8__Homo_sapiens__NP_001100
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 205 - protein, 819 aa, Artificial Sequence
  ADAM9__Homo_sapiens__NP_003807
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 206 - protein, 391 aa, Artificial Sequence
  ADAMDEC1__Homo_sapiens__NP_001138743
MILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 207 - protein, 1103 aa, Artificial Sequence
  ADAMTS10__Homo_sapiens__NP_112219
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 208 - protein, 1594 aa, Artificial Sequence
  ADAMTS12__Homo_sapiens__NP_112217
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPAHPCELYCRPIDGQFSEKMLDAVIDGTPCFEGGNSRNVCINGICKMVGCDYEIDSNATEDRCGVCLGDGSSCQTVRKMFKQKEGSGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 209 - protein, 1427 aa, Artificial Sequence
  ADAMTS13__Homo_sapiens__NP_620594
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 210 - protein, 1223 aa, Artificial Sequence
  ADAMTS14__Homo_sapiens__NP_542453
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 211 - protein, 950 aa, Artificial Sequence
  ADAMTS15__Homo_sapiens__NP_620686
MLLLGILTLAFAGRTAGGSEPEREVVVPIRLDPDINGRRYYWRGPEDSGDQGLIFQITAFQEDFYLHLTPDAQFLAPAFSTEHLGVPLQGLTGGSSDLRRCFYSGDVNAEPDSFAAVSLCGGLRGAFGYRGAEYVISPLPNASAPAAQRNSQGAHLLQRRGVPGGPSGDPTSRCGVASGWNPAILRALDPYKPRRAGFGESRSRRRSGRAKRFVSIPRYVETLVVADESMVKFHGADLEHYLLTLLATAARLYRHPSILNPINIVVVKVLLLRDRDSGPKVTGNAALTLRNFCAWQKKLNKVSDKHPEYWDTAILFTRQDLCGATTCDTLGMADVGTMCDPKRSCSVIEDDGLPSAFTTAHELGHVFNMPHDNVKVCEEVFGKLRANHMMSPTLIQIDRANPWSACSAAIITDFLDSGHGDCLLDQPSKPISLPEDLPGASYTLSQQCELAFGVGSKPCPYMQYCTKLWCTGKAKGQMVCQTRHFPWADGTSCGEGKLCLKGACVERHNLNKHRVDGSWAKWDPYGPCSRTCGGGVQLARRQCTNPTPANGGKYCEGVRVKYRSCNLEPCPSSASGKSFREEQCEAFNGYNHSTNRLTLAVAWVPKYSGVSPRDKCKLICRANGTGYFYVLAPKVVDGTLCSPDSTSVCVQGKCIKAGCDGNLGSKKRFDKCGVCGGDNKSCKKVTGLFTKPMHGYNFVVAIPAGASSIDIRQRGYKGLIGDDNYLALKNSQGKYLLNGHFVVSAVERDLVVKGSLLRYSGTGTAVESLQASRPILEPLTVEVLSVGKMTPPRVRYSFYLPKEPREDKSSHPKDPRGPSVLHNSVLSLSNQVEQPDDRPPARWVAGSWGPCSASCGSGLQKRAVDCRGSAGQRTVPACDAAHRPVETQACGEPCPTWELSAWSPCSKSCGRGFQRRSLKCVGHGGRLLARDQCNLHRKPQELDFCVLRPC

SEQ ID NO: 212 - protein, 1224 aa, Artificial Sequence
  ADAMTS16__Homo_sapiens__NP_620687
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDLKFQVNMSFCNPKTRPVTGLVPCKVSACPPSWSVGNWSACSRTCGGGAQSRPVQCTRRVHYDSEPVPASLCPQPAPSSRQACNSQSCPPAWSAGPWAECSHTCGKGWRKRAVACKSTNPSARAQLLPDAVCTSEPKPRMHEACLLQRCHKPKKLQWLVSAWSQCSVTCERGTQKRFLKCAEKYVSGKYRELASKKCSHLPKPSLELERACAPLPCPRHPPFAAAGPSRGSWFASPWSQCTASCGGGVQTRSVQCLAGGRPASGCLLHQKPSASLACNTHFCPIAEKKDAFCKDYFHWCYLVPQHGMCSHKFYGKQCCKTCSKSNL

SEQ ID NO: 213 - protein, 1095 aa, Artificial Sequence
  ADAMTS17__Homo_sapiens__NP_620688
MCDGALLPPLVLPVLLLLVWGLDPGTAVGDAAADVEVVLPWRVRPDDVHLPPLPAAPGPRRRRRPRTPPAAPRARPGERALLLHLPAFGRDLYLQLRRDLRFLSRGFEVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKINIQVTKLVLLRQRPAKLSIGHHGERSLESFCHWQNEEYGGARYLGNNQVPGGKDDPPLVDAAVFVTRTDFCVHKDEPCDTVGIAYLGGVCSAKRKCVLAEDNGLNLAFTIAHELGHNLGMNHDDDHSSCAGRSHIMSGEWVKGRNPSDLSWSSCSRDDLENFLKSKVSTCLLVTDPRSQHTVRLPHKLPGMHYSANEQCQILFGMNATFCRNMEHLMCAGLWCLVEGDTSCKTKLDPPLDGTECGADKWCRAGECVSKTPIPEHVDGDWSPWGAWSMCSRTCGTGARFRQRKCDNPPPGPGGTHCPGASVEHAVCENLPCPKGLPSFRDQQCQAHDRLSPKKKGLLTAVVVDDKPCELYCSPLGKESPLLVADRVLDGTPCGPYETDLCVHGKCQKIGCDGIIGSAAKEDRCGVCSGDGKTCHLVKGDFSHARGTALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGGERRTIVSCTRIVNKTTTLVNDSDCPQASRPEPQVRRCNLHPCQSRWVAGPWSPCSATCEKGFQHREVTCVYQLQNGTHVATRPLYCPGPRPAAVQSCEGQDCLSIWEASEWSQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPNS

SEQ ID NO: 214 - protein, 1221 aa, Artificial Sequence
  ADAMTS18__Homo_sapiens__NP_955387
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKYAPKPPTEDTYLRFDEYGSSGRPRRSAGKSQKGLNVETLVVADKKMVEKHGKGNVTTYILTVMNMVSGLFKDGTIGSDINVVVVSLILLEQEPGGLLINHHADQSLNSFCQWQSALIGKNGKRHDHAILLTGFDICSWKNEPCDTLGFAPISGMCSKYRSCTINEDTGLGLAFTIAHESGHNFGMIHDGEGNPCRKAEGNIMSPTLTGNNGVFSWSSCSRQYLKKFLSTPQAGCLVDEPKQAGQYKYPDKLPGQIYDADTQCKWQFGAKAKLCSLGFVKDICKSLWCHRVGHRCETKFMPAAEGTVCGLSMWCRQGQCVKFGELGPRPIHGQWSAWSKWSECSRTCGGGVKFQERHCNNPKPQYGGLFCPGSSRIYQLCNINPCNENSLDFRAQQCAEYNSKPFRGWFYQWKPYTKVEEEDRCKLYCKAENFEFFFAMSGKVKDGTPCSPNKNDVCIDGVCELVGCDHELGSKAVSDACGVCKGDNSTCKFYKGLYLNQHKANEYYPVVLIPAGARSIEIQELQVSSSYLAVRSLSQKYYLTGGWSIDWPGEFPFAGTTFEYQRSFNRPERLYAPGPTNETLVFEILMQGKNPGIAWKYALPKVMNGTPPATKRPAYTWSIVQSECSVSCGGGYINVKAICLRDQNTQVNSSFCSAKTKPVTEPKICNAFSCPAYWMPGEWSTCSKACAGGQQSRKIQCVQKKPFQKEEAVLHSLCPVSTPTQVQACNSHACPPQWSLGPWSQCSKTCGRGVRKRELLCKGSAAETLPESQCTSLPRPELQEGCVLGRCPKNSRLQWVASSWSECSATCGLGVRKREMKCSEKGFQGKLITFPERRCRNIKKPNLDLEETCNRRACPAHPVYNMVAGWYSLPWQQCTVTCGGGVQTRSVHCVQQGRPSSSCLLHQKPPVLRACNTNFCPAPEKREDPSCVDFFNWCHLVPQHGVCNHKFYGKQCCKSCTRKI

SEQ ID NO: 215 - protein, 1207 aa, Artificial Sequence
  ADAMTS19__Homo_sapiens__NP_598377
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLSVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 216 - protein, 967 aa, Artificial Sequence
  ADAMTS1__Homo_sapiens__NP_008919
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 217 - protein, 1910 aa, Artificial Sequence
  ADAMTS20__Homo_sapiens__NP_079279
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSCSASCGKGRKYREVFCIDQFQRKLEDTNCSQVQKPPTHKACRSVRCPSWKANSWNECSVTCGSGVQQRDVYCRLKGVGQVVEEMCDQSTRPCSQRRCWSQDCVQHKGMERGRLNCSTSCERKDSHQRMECTDNQIRQVNEIVYNSSTISLTSKNCRNPPCNYIVVTADSSQCANNCGFSYRQRITYCTEIPSTKKHKLHRLRPIVYQECPVVPSSQVYQCINSCLHLATWKVGKWSKCSVTCGIGIMKRQVKCITKHGLSSDLCLNHLKPGAQKKCYANDCKSFTTCKEIQVKNHIRKDGDYYLNIKGRIIKIYCADMYLENPKEYLTLVQGEENFSEVYGFRLKNPYQCPFNGSRREDCECDNGHLAAGYTVFSKIRIDLTSMQIKTTDLLFSKTIFGNAVPFATAGDCYSAFRCPQGQFSINLSGTGMKISSTAKWLTQGSYTSVSIRRSEDGTRFFGKCGGYCGKCLPHMTTGLPIQVI

SEQ ID NO: 218 - protein, 1211 aa, Artificial Sequence
  ADAMTS2__Homo_sapiens__NP_055059
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 219 - protein, 1205 aa, Artificial Sequence
  ADAMTS3__Homo_sapiens__NP_055058
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRRTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 220 - protein, 837 aa, Artificial Sequence
  ADAMTS4__Homo_sapiens__NP_005090
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQAQALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 221 - protein, 930 aa, Artificial Sequence
  ADAMTS5__Homo_sapiens__NP_008969
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDGSPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRLYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 222 - protein, 1117 aa, Artificial Sequence
  ADAMTS6__Homo_sapiens__NP_922932
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLDSGRGTCLDNEPPKRDFLYPAVAPGQVYDADEQCRFQYGATSRQCKYGEVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGVQRQEVVCKRLDDNSIVQNNYCDPDSKPPENQRACNTEPCPPEWFIGDWLECSKTCDGGMRTRAVLCIRKIGPSEEETLDYSGCLTHRPVEKEPCNNQSCPPQWVALDWSECTPKCGPGFKHRIVLCKSSDLSKTFPAAQCPEESKPPVRIRCSLGRCPPPRWVTGDWGQCSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 223 - protein, 1686 aa, Artificial Sequence
  ADAMTS7__Homo_sapiens__NP_055087
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAEKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNAGWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSGPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 224 - protein, 889 aa, Artificial Sequence
  ADAMTS8__Homo_sapiens__NP_008968
MLPAPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 225 - protein, 1935 aa, Artificial Sequence
  ADAMTS9__Homo_sapiens__NP_891550
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 226 - protein, 1762 aa, Artificial Sequence
  ADAMTSL1__Homo_sapiens__NP_001035362
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQGGWPGELLASWEAQDSAERNTTSEEDPGAEQVLLHLPFTMVTEQRRLDDILGNLSQQPEELRDLYSKHLVAQLAQEIFRSHLEHQDTLLKPSERRTSPVTLSPHKHVSGFSSSLRTSSTGDAGGGSRRPHRKPTILRKISAAQQLSASEVVTHLGQTVALASGTLSVLLHCEAIGHPRPTISWARNGEEVQFSDRILLQPDDSLQILAPVEADVGFYTCNATNALGYDSVSIAVTLAGKPLVKTSRMTVINTEKPAVTVDIGSTIKTVQGVNVTINCQVAGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 227 - protein, 951 aa, Artificial Sequence
  ADAMTSL2__Homo_sapiens__NP_001138792
MDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 228 - protein, 1691 aa, Artificial Sequence
  ADAMTSL3__Homo_sapiens__NP_997400
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 229 - protein, 1130 aa, Artificial Sequence
  ADAMTSL4__Homo_sapiens__XP_011507946
MLAPRRAPSTPRCLRSFCDQSAPASPWGSRGGAMENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEAPLLPLRHAFFLLPGAGSGDSTGVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 230 - protein, 471 aa, Artificial Sequence
  ADAMTSL5__Homo_sapiens__NP_998769
MDSAPLFPRPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGRAHRLLHYCGSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 231 - protein, 385 aa, Artificial Sequence
  ADAP1__Homo_sapiens__NP_001271237
MFQFVFSRVYCINPARRKWKEFEKMLGCAEEGHASLGRDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGASDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 232 - protein, 381 aa, Artificial Sequence
  ADAP2__Homo_sapiens__NP_060874
MGDRERNKKRLLELLRAPDTGNAHCADCGAADPDWASYKLGIFICLNCCGVHRNFPDISRVKSVRLDFWDDSIVEFMIHNGNLRVKAKFEARVPAFYYIPQANDCLVLKEQWIRAKYERREFMADGETISLPGNREGFLWKRGRDNSQFLRRKFVLLAREGLLKYFTKEQGKSPKAVISIKDLNATFQTEKIGHPHGLQITYRRDGHTRNLFVYHESGKEIVDWFNALRAARLQYLKMAFPELPESELVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPSEKEQQEWLESLRGVLSSPLTPLNRLTASTESGRSSR

SEQ ID NO: 233 - protein, 714 aa, Artificial Sequence
  ADARB1__Homo_sapiens__NP_056649
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKVH

SEQ ID NO: 234 - protein, 739 aa, Artificial Sequence
  ADARB2__Homo_sapiens__NP_061172
MASVLGSGRGSGGLSSQLKCKSKRRRRRRSKRKDKVSILSTFLAPFKHLSPGITNTEDDDTLSTSSAEVKENRNVGNLAARPPPSGDRARGGAPGAKRKRPLEEGNGGHLCKLQLVWKKLSWSVAPKNALVQLHELRPGLQYRTVSQTGPVHAPVFAVAVEVNGLTFEGTGPTKKKAKMRAAELALRSFVQFPNACQAHLAMGGGPGPGTDFTSDQADFPDTLFQEFEPPAPRPGLAGGRPGDAALLSAAYGRRRLLCRALDLVGPTPATPAAPGERNPVVLLNRLRAGLRYVCLAEPAERRARSFVMAVSVDGRTFEGSGRSKKLARGQAAQAALQELFDIQMPGHAPGRARRTPMPQEFADSISQLVTQKFREVTTDLTPMHARHKALAGIVMTKGLDARQAQVVALSSGTKCISGEHLSDQGLVVNDCHAEVVARRAFLHFLYTQLELHLSKRREDSERSIFVRLKEGGYRLRENILFHLYVSTSPCGDARLHSPYEITTDLHSSKHLVRKFRGHLRTKIESGEGTVPVRGPSAVQTWDGVLLGEQLITMSCTDKIARWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 235 - protein, 931 aa, Artificial Sequence
  ADAR__Homo_sapiens__NP_001020278
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 236 - protein, 144 aa, Artificial Sequence
  ADAT2__Homo_sapiens__NP_001273188
MVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 237 - protein, 367 aa, Artificial Sequence
  ADAT3__Homo_sapiens__NP_612431
MILCSRLCLPQSASLRMEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPAVDPRGLGQPFLVPVPARPPLTRGQFEEARAHWPTSFHEDKQVTSALAGRLFSTQERAAMQSHMERAVWAARRAAARGLRAVGAVVVDPASDRVLATGHDCSCADNPLLHAVMVCVDLVARGQGRGTYDFRPFPACSFAPAAAPQAVRAGAVRKLDADEDGLPYLCTGYDLYVTREPCAMCAMALVHARILRVFYGAPSPDGALGTRFRIHARPDLNHRFQVFRGVLEEQCRWLDPDT

SEQ ID NO: 238 - protein, 647 aa, Artificial Sequence
  ADCK3__Homo_sapiens__NP_064632
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 239 - protein, 503 aa, Artificial Sequence
  ADCK4__Homo_sapiens__NP_001136027
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 240 - protein, 1457 aa, Artificial Sequence
  ADCY10__Homo_sapiens__NP_001161221
MLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 241 - protein, 1119 aa, Artificial Sequence
  ADCY1__Homo_sapiens__NP_066939
MAGAPRGGGGGGGGAGEPGGAERAAGTSRRRGLRACDEEFACPELEALFRGYTLRLEQAATLKALAVLSLLAGALALAELLGAPGPAPGLAKGSHPVHCVLFLALLVVTNVRSLQVPQLQQVGQLALLFSLTFALLCCPFALGGPARGSAGAAGGPATAEQGVWQLLLVTFVSYALLPVRSLLAIGFGLVVAASHLLVTATLVPAKRPRLWRTLGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKAKKSISSHLSTLADFAIEMFDVLDEINYQSYNDFVLRVGINVGPVVAGVIGARRPQYDIWGNTVNVASRMDSTGVQGRIQVTEEVHRLLRRCPYHFVCRGKVSVKGKGEMLTYFLEGRTDGNGSQIRSLGLDRKMCPFGRAGLQGRRPPVCPMPGVSVRAGLPPHSPGQYLPSAAAGKEA

SEQ ID NO: 242 - protein, 1091 aa, Artificial Sequence
  ADCY2__Homo_sapiens__NP_065433
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLVWQILANVIIFICGNLAGAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 243 - protein, 1144 aa, Artificial Sequence
  ADCY3__Homo_sapiens__NP_004027
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 244 - protein, 911 aa, Artificial Sequence
  ADCY5__Homo_sapiens__NP_001186571
MKSQKEGCCSRGDLSIQTGPGGEWAPRRLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 245 - protein, 1168 aa, Artificial Sequence
  ADCY6__Homo_sapiens__NP_056085
MSWFSGLLVPKVDERKTAWGERNGQKRSRRRGTRAGGFCTPRYMSCLRDAEPPSPTPAGPPRCPWQDDAFIRRGGPGKGKELGLRAVALGFEDTEVTTTAGGTAEVAPDAVPRSGRSCWRRLVQVFQSKQFRSAKLERLYQRYFFQMNQSSLTLLMAVLVLLTAVLLAFHAAPARPQPAYVALLACAAALFVGLMVVCNRHSFRQDSMWVVSYVVLGILAAVQVGGALAADPRSPSAGLWCPVFFVYIAYTLLPIRMRAAVLSGLGLSTLHLILAWQLNRGDAFLWKQLGANVLLFLCTNVIGICTHYPAEVSQRQAFQETRGYIQARLHLQHENRQQERLLLSVLPQHVAMEMKEDINTKKEDMMFHKIYIQKHDNVSILFADIEGFTSLASQCTAQELVMTLNELFARFDKLAAENHCLRIKILGDCYYCVSGLPEARADHAHCCVEMGVDMIEAISLVREVTGVNVNMRVGIHSGRVHCGVLGLRKWQFDVWSNDVTLANHMEAGGRAGRIHITRATLQYLNGDYEVEPGRGGERNAYLKEQHIETFLILGASQKRKEEKAMLAKLQRTRANSMEGLMPRWVPDRAFSRTKDSKAFRQMGIDDSSKDNRGTQDALNPEDEVDEFLSRAIDARSIDQLRKDHVRRFLLTFQREDLEKKYSRKVDPRFGAYVACALLVFCFICFIQLLIFPHSTLMLGIYASIFLLLLITVLICAVYSCGSLFPKALQRLSRSIVRSRAHSTAVGIFSVLLVFTSAIANMFTCNHTPIRSCAARMLNLTPADITACHLQQLNYSLGLDAPLCEGTMPTCSFPEYFIGNMLLSLLASSVFLHISSIGKLAMIFVLGLIYLVLLLLGPPATIFDNYDLLLGVHGLASSNETFDGLDCPAAGRVALKYMTPVILLVFALALYLHAQQVESTARLDFLWKLQATGEKEEMEELQAYNRRLLHNILPKDVAAHFLARERRNDELYYQSCECVAVMFASIANFSEFYVELEANNEGVECLRLLNEIIADFDEIISEERFRQLEKIKTIGSTYMAASGLNASTYDQVGRSHITALADYAMRLMEQMKHINEHSFNNFQMKIGLNMGPVVAGVIGARKPQYDIWGNTVNVSSRMDSTGVPDRIQVTTDLYQVLAAKGYQLECRGVVKVKGKGEMTTYFLNGGPSS

SEQ ID NO: 246 - protein, 1080 aa, Artificial Sequence
  ADCY7__Homo_sapiens__NP_001105
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFIGDKLNEDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 247 - protein, 1251 aa, Artificial Sequence
  ADCY8__Homo_sapiens__NP_001106
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 248 - protein, 1353 aa, Artificial Sequence
  ADCY9__Homo_sapiens__NP_001107
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 249 - protein, 176 aa, Artificial Sequence
  ADCYAP1__Homo_sapiens__NP_001093203
MTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 250 - protein, 468 aa, Artificial Sequence
  ADCYAP1R1__Homo_sapiens__NP_001109
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 251 - protein, 737 aa, Artificial Sequence
  ADD1__Homo_sapiens__NP_001110
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 252 - protein, 575 aa, Artificial Sequence
  ADD2__Homo_sapiens__NP_001171984
MPRRRVPGANCKPTGKMSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 253 - protein, 706 aa, Artificial Sequence
  ADD3__Homo_sapiens__NP_058432
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEDAEQELLSDDASSVSQIQSQTQSPQNVPEKLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 254 - protein, 1667 aa, Artificial Sequence
  ADGB__Homo_sapiens__NP_078970
MASKQTKKKEVHRINSAHGSDKSKDFYPFGSNVQSGSTEQKKGKFPLWPEWSEADINSEKWDAGKGAKEKDKTGKSPVFHFFEDPEGKIELPPSLKIYSWKRPQDILFSQTPVVVKNEITFDLFSANEHLLCSELMRWIISEIYAVWKIFNGGILSNYFKGTSGEPPLLPWKPWEHIYSLCKAVKGHMPLFNSYGKYVVKLYWMGCWRKITIDDFLPFDEDNNLLLPATTYEFELWPMLLSKAIIKLANIDIHVADRRELGEFTVIHALTGWLPEVISLHPGYMDKVWELLKEILPEFKLSDEASSESKIAVLDSKLKEPGKEGKEGKEIKDGKEVKDVKEFKPESSLTTLKAPEKSDKVPKEKADARDIGKKRSKDGEKEKFKFSLHGSRPSSEVQYSVQSLSDCSSAIQTSHMVVYATFTPLYLFENKIFSLEKMADSAEKLREYGLSHICSHPVLVTRSRSCPLVAPPKPPPLPPWKLIRQKKETVITDEAQELIVKKPERFLEISSPFLNYRMTPFTIPTEMHFVRSLIKKGIPPGSDLPSVSETDETATHSQTDLSQITKATSQGNTASQVILGKGTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSSKHILSFHSASKKEQEVYVKKKAAQGIQKSPKGRAVSAIQDIGLPLVEEETTSTPTREDSSSTPLQNYKYIIQCSVLYNSWPLTESQLTFVQALKDLKKSNTKAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 255 - protein, 560 aa, Artificial Sequence
  ADGRA1__Homo_sapiens__NP_001077378
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 256 - protein, 1338 aa, Artificial Sequence
  ADGRA2__Homo_sapiens__NP_116166
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 257 - protein, 1321 aa, Artificial Sequence
  ADGRA3__Homo_sapiens__NP_660333
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 258 - protein, 1584 aa, Artificial Sequence
  ADGRB1__Homo_sapiens__XP_011515501
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 259 - protein, 1584 aa, Artificial Sequence
  ADGRB2__Homo_sapiens__NP_001281264
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 260 - protein, 1522 aa, Artificial Sequence
  ADGRB3__Homo_sapiens__NP_001695
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 261 - protein, 874 aa, Artificial Sequence
  ADGRD1__Homo_sapiens__NP_942122
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 262 - protein, 974 aa, Artificial Sequence
  ADGRD2__Homo_sapiens__XP_006717411
MVTGPEEGNSEMDAPWGAGERWLHGAAVDRSGVSLGPPPTPQVNQGTLGPQVAPVAAGEVVKTAGGVCKFSGQRLSWWQAQESCEQQFGHLALQPPDGVLASRLRDPVWVGQREAPLRRPPQRRARTTAVLVFDERTADRAARLRSPLPELAALTACTHVQWDCASPDPAALFSVAAPALPNALQLRAFAEPGGVVRAALVVRGQHAPFLAAFRADGRWHHVCATWEQRGGRWALFSDGRRRAGARGLGAGHPVPSGGILVLGQDQDSLGGGFSVRHALSGNLTDFHLWARALSPAQLHRARACAPPSEGLLFRWDPGALDVTPSLLPTVWVRLLCPVPSEECPTWNPGPRSEGSELCLEPQPFLCCYRTEPYRRLQDAQSWPGQDVISRVNALANDIVLLPDPLSEVHGALSPAEASSFLGLLEHVLAMEMAPLGPAALLAVVRFLKRVVALGAGDPELLLTGPWEQLSQGVVSVASLVLEEQVADTWLSLREVIGGPMALVASVQRLAPLLSTSMTSERPRMRIQHRHAGLSGVTVIHSWFTSRVFQHTLEGPDLEPQAPASSEEANRVQRFLSTQVGSAIISSEVWDVTGEVNVAMTFHLQHRAQSPLFPPHPPSPYTGGAWATTGCSVAALYLDSTACFCNHSTSFAILLQIYEVQRGPEEESLLRTLSFVGCGVSFCALTTTFLLFLVAGVPKSERTTVHKNLTFSLASAEGFLMTSEWAKANEVACVAVTVAMHFLFLVAFSWMLVEGLLLWRKVVAVSMHPGPGMRLYHATGWGVPVGIVAVTLAMLPHDYVAPGHCWLNVHTNAIWAFVGPVLFVLTANTCILARVVMITVSSARRRARMLSPQPCLQQQIWTQIWATVKPVLVLLPVLGLTWLAGILVHLSPAWAYAAVGLNSIQGLYIFLVYAACNEEVRSALQRMAEKKVAEVLRALGVWGGAAKEHSLPFSVLPLFLPPKPSTPRHPLKAPA

SEQ ID NO: 263 - protein, 867 aa, Artificial Sequence
  ADGRE1__Homo_sapiens__NP_001243181
MRGFNLLLFWGCCVMHSWEGHIRPTRKPNTKGNNCRDSTLCPAYATCTNTVDSYYCACKQGFLSSNGQNHFKDPGVRCKDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVVSKYYNSLAKCVLKEEQGDLRDLEFPGTCAAERINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 264 - protein, 765 aa, Artificial Sequence
  ADGRE2__Homo_sapiens__NP_001257981
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHREEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 265 - protein, 786 aa, Artificial Sequence
  ADGRE5__Homo_sapiens__NP_001020331
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 266 - protein, 1346 aa, Artificial Sequence
  ADGRF5__Homo_sapiens__NP_056049
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 267 - protein, 523 aa, Artificial Sequence
  ADGRG1__Homo_sapiens__NP_001277071
MTPQSLLQTTLFLLSLLFLVQGAHGRGHREDFRFCSQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 268 - protein, 1017 aa, Artificial Sequence
  ADGRG2__Homo_sapiens__NP_001073327
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 269 - protein, 549 aa, Artificial Sequence
  ADGRG3__Homo_sapiens__NP_740746
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 270 - protein, 1193 aa, Artificial Sequence
  ADGRG6__Homo_sapiens__NP_001027566
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 271 - protein, 797 aa, Artificial Sequence
  ADGRG7__Homo_sapiens__NP_116176
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVKDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 272 - protein, 1474 aa, Artificial Sequence
  ADGRL1__Homo_sapiens__NP_001008701
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 273 - protein, 1469 aa, Artificial Sequence
  ADGRL3__Homo_sapiens__NP_056051
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 274 - protein, 6306 aa, Artificial Sequence
  ADGRV1__Homo_sapiens__NP_115495
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 275 - protein, 375 aa, Artificial Sequence
  ADH1A__Homo_sapiens__NP_000658
MSTAGKVIKCKAAVLWELKKPFSIEEVEVAPPKAHEVRIKMVAVGICGTDDHVVSGTMVTPLPVILGHEAAGIVESVGEGVTTVKPGDKVIPLAIPQCGKCRICKNPESNYCLKNDVSNPQGTLQDGTSRFTCRRKPIHHFLGISTFSQYTVVDENAVAKIDAASPLEKVCLIGCGFSTGYGSAVNVAKVTPGSTCAVFGLGGVGLSAIMGCKAAGAARIIAVDINKDKFAKAKELGATECINPQDYKKPIQEVLKEMTDGGVDFSFEVIGRLDTMMASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 276 - protein, 375 aa, Artificial Sequence
  ADH1B__Homo_sapiens__NP_000659
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 277 - protein, 380 aa, Artificial Sequence
  ADH4__Homo_sapiens__NP_000661
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 278 - protein, 374 aa, Artificial Sequence
  ADH5__Homo_sapiens__NP_000662
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 279 - protein, 368 aa, Artificial Sequence
  ADH6__Homo_sapiens__NP_000663
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKW

SEQ ID NO: 280 - protein, 386 aa, Artificial Sequence
  ADH7__Homo_sapiens__NP_000664
MFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 281 - protein, 467 aa, Artificial Sequence
  ADHFE1__Homo_sapiens__NP_653251
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVRNPDDLEARSHMHLASAFAGIGFGNAGVHLCHGMSYPISGLVKMYKAKDYNVDHPLVPHGLSVVLTSPAVFTFTAQMFPERHLEMAEILGADTRTARIQDAGLVLADTLRKFLFDLDVDDGLAAVGYSKADIPALVKGTLPQERVTKLAPCPQSEEDLAALFEASMKLY

SEQ ID NO: 282 - protein, 179 aa, Artificial Sequence
  ADI1__Homo_sapiens__NP_060739
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 283 - protein, 80 aa, Artificial Sequence
  ADIG__Homo_sapiens__NP_001018092
MKYPLMPLVNDLTFSFLVFWFCLPVGLLLLLIIWLRFLLSQDSEENDSSVCLDWEPWSKGPAEFCWKGTLHGQEKERPCW

SEQ ID NO: 284 - protein, 244 aa, Artificial Sequence
  ADIPOQ__Homo_sapiens__NP_001171271
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 285 - protein, 375 aa, Artificial Sequence
  ADIPOR1__Homo_sapiens__NP_001277558
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 286 - protein, 386 aa, Artificial Sequence
  ADIPOR2__Homo_sapiens__XP_006719081
MNEPTENRLGCSRTPEPDIRLRKGHQLDGTRRGDNDSHQGDLEPILEASVLSSHHKKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVFFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 287 - protein, 76 aa, Artificial Sequence
  ADIRF__Homo_sapiens__NP_006820
MASKGLQDLKQQVEGTAQEAVSAAGAAAQQVVDQATEAGQKAMDQLAKTTQETIDKTANQASDTFSGIGKKFGLLK

SEQ ID NO: 288 - protein, 345 aa, Artificial Sequence
  ADK__Homo_sapiens__NP_001114
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 289 - protein, 148 aa, Artificial Sequence
  ADM2__Homo_sapiens__NP_001240774
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 290 - protein, 185 aa, Artificial Sequence
  ADM__Homo_sapiens__NP_001115
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 291 - protein, 1102 aa, Artificial Sequence
  ADNP__Homo_sapiens__XP_011527049
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYRDPLYEIVRKHIYREHFQHVAAPYIAKAGEKSLNGAVPLGSNAREESSIHCKRCLFMPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 292 - protein, 270 aa, Artificial Sequence
  ADO__Homo_sapiens__NP_116193
MPRDNMASLIQRIARQACLTFRGSGGGRGASDRDAASGPEAPMQPGFPENLSKLKSLLTQLRAEDLNIAPRKATLQPLPPNLPPVTYMHIYETDGFSLGVFLLKSGTSIPLHDHPGMHGMLKVLYGTVRISCMDKLDAGGGQRPRALPPEQQFEPPLQPREREAVRPGVLRSRAEYTEASGPCILTPHRDNLHQIDAVEGPAAFLDILAPPYDPDDGRDCHYYRVLEPVRPKEASSSACDLPREVWLLETPQADDFWCEGEPYPGPKVFP

SEQ ID NO: 293 - protein, 326 aa, Artificial Sequence
  ADORA1__Homo_sapiens__NP_000665
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 294 - protein, 412 aa, Artificial Sequence
  ADORA2A__Homo_sapiens__NP_001265429
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 295 - protein, 332 aa, Artificial Sequence
  ADORA2B__Homo_sapiens__NP_000667
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 296 - protein, 496 aa, Artificial Sequence
  ADPGK__Homo_sapiens__NP_112574
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 297 - protein, 357 aa, Artificial Sequence
  ADPRH__Homo_sapiens__NP_001278878
MEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSHEGGCGAAMRAMCIGLRFPHHSQLDTLIQVSIESGRMTHHHPTGYLGALASALFTAYAVNSRPPLQWGKGLMELLPEAKKYIVQSGYFVEENLQHWSYFQTKWENYLKLRGILDGESAPTFPESFGVKERDQFYTSLSYSGWGGSSGHDAPMIAYDAVLAAGDSWKELAHRAFFHGGDSDSTAAIAGCWWGVMYGFKGVSPSNYEKLEYRNRLEETARALYSLGSKEDTVISL

SEQ ID NO: 298 - protein, 354 aa, Artificial Sequence
  ADPRHL1__Homo_sapiens__NP_612439
MEKFKAAMLLGSVGDALGYRNVCKENSTVGMKIQEELQRSGGLDHLVLSPGEWPVSDNTIMHIATAEALTTDYWCLDDLYREMVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 299 - protein, 209 aa, Artificial Sequence
  ADPRHL2__Homo_sapiens__XP_011539938
MRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 300 - protein, 466 aa, Artificial Sequence
  ADRA1A__Homo_sapiens__NP_000671
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 301 - protein, 520 aa, Artificial Sequence
  ADRA1B__Homo_sapiens__NP_000670
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 302 - protein, 572 aa, Artificial Sequence
  ADRA1D__Homo_sapiens__NP_000669
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 303 - protein, 465 aa, Artificial Sequence
  ADRA2A__Homo_sapiens__NP_000672
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 304 - protein, 450 aa, Artificial Sequence
  ADRA2B__Homo_sapiens__NP_000673
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 305 - protein, 462 aa, Artificial Sequence
  ADRA2C__Homo_sapiens__NP_000674
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 306 - protein, 477 aa, Artificial Sequence
  ADRB1__Homo_sapiens__NP_000675
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 307 - protein, 413 aa, Artificial Sequence
  ADRB2__Homo_sapiens__NP_000015
MGQPGNGSAFLLAPNRSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 308 - protein, 408 aa, Artificial Sequence
  ADRB3__Homo_sapiens__NP_000016
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 309 - protein, 689 aa, Artificial Sequence
  ADRBK1__Homo_sapiens__NP_001610
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 310 - protein, 688 aa, Artificial Sequence
  ADRBK2__Homo_sapiens__NP_005151
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 311 - protein, 407 aa, Artificial Sequence
  ADRM1__Homo_sapiens__XP_011526804
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 312 - protein, 484 aa, Artificial Sequence
  ADSL__Homo_sapiens__NP_000017
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 313 - protein, 456 aa, Artificial Sequence
  ADSS__Homo_sapiens__NP_001117
MAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 314 - protein, 457 aa, Artificial Sequence
  ADSSL1__Homo_sapiens__NP_689541
MSGTRASNDRPPGAGGVKRGRLQQEAAATGSRVTVVLGAQWGDEGKGKVVDLLATDADIISRCQGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 315 - protein, 248 aa, Artificial Sequence
  ADTRP__Homo_sapiens__NP_001137420
MTKTSTCIYHFLVLSWYTFLNYYISQEGKDEVKPKILANGARWKYMTLLNLLKNRTAGFDIYQPGSFRQLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 316 - protein, 517 aa, Artificial Sequence
  AEBP2__Homo_sapiens__NP_001107648
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 317 - protein, 325 aa, Artificial Sequence
  AEN__Homo_sapiens__NP_073604
MVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGNVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQYWPDDLAHGSRGGAREAQDRRN

SEQ ID NO: 318 - protein, 264 aa, Artificial Sequence
  AES__Homo_sapiens__NP_945320
MCHKNGFPQEGGITAAFLQKRKLRLSKNHRPARAKVTEHVRGTRPGRATAGPAASTRAAGSLFFDRWGNRGPAGCRGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 319 - protein, 814 aa, Artificial Sequence
  AFAP1__Homo_sapiens__NP_001128119
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSWEPEDGFPASCSRGLGEEVLYDNAGLYDNLPPPHIFARYSPADRKASRLSADKLSSNHYKYPASAQSVTNTSSVGRASLGLNSQLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 320 - protein, 725 aa, Artificial Sequence
  AFAP1L1__Homo_sapiens__NP_001139809
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGEWEMKKT

SEQ ID NO: 321 - protein, 818 aa, Artificial Sequence
  AFAP1L2__Homo_sapiens__NP_001001936
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 322 - protein, 1218 aa, Artificial Sequence
  AFF1__Homo_sapiens__NP_001160165
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 323 - protein, 1276 aa, Artificial Sequence
  AFF2__Homo_sapiens__NP_001162593
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 324 - protein, 1251 aa, Artificial Sequence
  AFF3__Homo_sapiens__NP_001020279
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 325 - protein, 1163 aa, Artificial Sequence
  AFF4__Homo_sapiens__NP_055238
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 326 - protein, 797 aa, Artificial Sequence
  AFG3L2__Homo_sapiens__NP_006787
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 327 - protein, 599 aa, Artificial Sequence
  AFM__Homo_sapiens__NP_001124
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 328 - protein, 609 aa, Artificial Sequence
  AFP__Homo_sapiens__NP_001125
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 329 - protein, 346 aa, Artificial Sequence
  AGA__Homo_sapiens__NP_000018
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 330 - protein, 857 aa, Artificial Sequence
  AGAP1__Homo_sapiens__NP_001032208
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 331 - protein, 1192 aa, Artificial Sequence
  AGAP2__Homo_sapiens__NP_001116244
MSRGAGALQRRTTTYLISLTLVKLESVPPPPPSPSAAAAGAAGARGSETGDPGSPRGAEEPGKKRHERLFHRQDALWISTSSAGTGGAEPPALSPAPASPARPVSPAPGRRLSLWAVPPGPPLSGGLSPDPKPGGAPTSSRRPLLSSPSWGGPEPEGRAGGGIPGSSSPHPGTGSRRLKVAPPPPAPKPCKTVTTSGAKAGGGKGAGSRLSWPESEGKPRVKGSKSSAGTGASVSAAATAAAAGGGGSTASTSGGVGAGAGARGKLSPRKGKSKTLDNSDLHPGPPAGSPPPLTLPPTPSPATAVTAASAQPPGPAPPITLEPPAPGLKRGREGGRASTRDRKMLKFISGIFTKSTGGPPGSGPLPGPPSLSSGSGSRELLGAELRASPKAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEAKRKMWKLKSFGSLRNIYKAEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 332 - protein, 396 aa, Artificial Sequence
  AGAP3__Homo_sapiens__NP_001036000
MNFQAGGGQSPQQQQSLAAPGGGGAAAQQLVCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTICATVSNFSSTKRPFQLLPN

SEQ ID NO: 333 - protein, 663 aa, Artificial Sequence
  AGAP4__Homo_sapiens__NP_597703
MGNILTCRVHPSVSLEFDQQQGSVCPSESEIYEAGAGDRMAGAPMAAAVQPAEVTVEVGEDLHMHHVRDREMPEALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 334 - protein, 1066 aa, Artificial Sequence
  AGBL1__Homo_sapiens__NP_689549
MISKGGSEALLQTLVDTARTAPPDYDILLPLFRLLAKVGLRDKKIGRKALELEALDVTLILARKNLSHGQNLLHCLWALRVFASSVSMGAMLGINGAMELLFKVITPYTRKRTQAIRAATEVLAALLKSKSNGRRAVNRGYVTSLLGLHQDWHSHDTANAYVQIRRGLLLCLRHIAALRSGREAFLAAQGMEILFSTTQNCLDDKSMEPVISVVLQILRQCYPTSPLPLVTASSAYAFPVPGCITTEPPHDLPEEDFEDDGDDEVDKDSDTEDGKVEDDDLETDVNKLSSKPGLDRPEEELMQYEVMCLELSYSFEELQSKLGDDLNSEKTQYANHHHIPAAASSKQHCYSKDQSSCGQEREYAVQTSLLCRVKTGRSTVHLGSKKNPGVNLYQNVQSNSLRRDSSESEIPDIQASPKADAWDVDAIFCPRMSASFSNSTRTREVVKVIDKLLQTHLKRVPFHDPYLYMAKARRTSSVVDFKMMAFPDVWGHCPPPTTQPMLERKCGVQRIRIFEDIRRLIQPSDVINKVVFSLDEPWPLQDNASNCLRFFSKFESGNLRKAIQVREFEYDLLVNADVNSTQHQQWFYFKVSGMQAAIPYHFNIINCEKPNSQFNYGMQPTLYSVKEALLGKPTWIRTGHEICYYKNHYRQSTAVAGGASGKCYYTLTFAVTFPHSEDVCYLAYHYPYTYTALMTHLDILEKSVNLKEVYFRQDVLCQTLGGNPCPLVTITAMPESNSDEHLEQFRHRPYQVITARVHPGESNASWVMKGTLEFLVSSDPVARLLRENFIFKIIPMLNPDGVINGNHRCSLSGEDLNRQWLSPSAHLQPTIYHAKGLLYHLSSIGRSPVVFCDFHGHSQKKNVFLYGCSIKETLWQAACTVGTSTILEEVNYRTLPKILDKLAPAFTMSSCSFLVEKSRASTARVVVWREMGVSRSYTMESSYCGCNQGPYQCTQRLLERTKNERAHPVDGLQGLQFGTRELEEMGAMFCLGLLILELKSASCSHQLLAQAATLLSAEEDALDQHLQRLKSSNFLPKHIWFAYHFFAITNFFKMNLLLHVSPVCDT

SEQ ID NO: 335 - protein, 902 aa, Artificial Sequence
  AGBL2__Homo_sapiens__NP_079059
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 336 - protein, 920 aa, Artificial Sequence
  AGBL3__Homo_sapiens__NP_848658
MSEDSEKEDYSDRTISDEDESDEDMFMKFVSEDLHRCALLTADSFGDPFFPRTTQILLEYQLGRWVPRLREPRDLYGVSSSGPLSPTRWPYHCEVIDEKVQHIDWTPSCPEPVYIPTGLETEPLYPDSKEATVVYLAEDAYKEPCFVYSRVGGNRTPLKQPVDYRDNTLMFEARFESGNLQKVVKVAEYEYQLTVRPDLFTNKHTQWYYFQVTNMRAGIVYRFTIVNFTKPASLYSRGMRPLFYSEKEAKAHHIGWQRIGDQIKYYRNNPGQDGRHYFSLTWTFQFPHNKDTCYFAHCYPYTYTNLQEYLSGINNDPVRSKFCKIRVLCHTLARNMVYILTITTPLKNSDSRKRKAVILTARVHPGETNSSWIMKGFLDYILGNSSDAQLLRDTFVFKVVPMLNPDGVIVGNYRCSLAGRDLNRNYTSLLKESFPSVWYTRNMVHRLMEKREVILYCDLHGHSRKENIFMYGCDGSDRSKTLYLQQRIFPLMLSKNCPDKFSFSACKFNVQKSKEGTGRVVMWKMGIRNSFTMEATFCGSTLGNKRGTHFSTKDLESMGYHFCDSLLDYCDPDRTKYYRCLKELEEMERHITLEKVFEDSDTPVIDITLDVESSSRGSDSSESIDSLTYLLKLTSQKKHLKTKKERNSTIASHQNARGQEVYDRGHLLQRHTQSNSDVKDTRPNEPDDYMVDYFRRQLPNQGLDLHHNLKSKIKECISFQSKKTGINWTDDEKRSYKDKGIVQTQEILQYLLPIVHSTKNMQTTQIKQLFNPRTNFQIQHQLNPATCRNIKKYSTSWTAPRNHPFVIQGDVMANSSEWVQSKPHRSLESLSPLKGPKKNKHSQIWAIKNEDIKPLSSKWETASSSFGMDANVLKYKSLQAEETNQQSSKHTALHLTKNKDEQANKNDGQPTLYLKFQRES

SEQ ID NO: 337 - protein, 506 aa, Artificial Sequence
  AGBL4__Homo_sapiens__XP_011540611
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQVREIVDTFRVVLRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEAYMKLGRNVARTFLDYYRLNPVVEKVAIPMPRLRKEKSPPYKHPLLRGPASNYPNSKGDKKSSVNHKDPSTPF

SEQ ID NO: 338 - protein, 404 aa, Artificial Sequence
  AGER__Homo_sapiens__NP_001127
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 339 - protein, 584 aa, Artificial Sequence
  AGFG1__Homo_sapiens__NP_001128659
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTAFRMLSSSCSFGEFTSAFPLQATHSGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGFAAFGQTKPVVTPFGQVAAAGVSSNPFMTGAPTGQFPTGSSSTNPFL

SEQ ID NO: 340 - protein, 481 aa, Artificial Sequence
  AGFG2__Homo_sapiens__NP_006067
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWYVPPDQVKGPTYTKGSASTPVQGSIPEGKPLRTLLGDPAPSLSVAASTSSQPVSQSHARTSQARSTQPPPHSSVKKASTDLLADIGGDPFAAPQMAPAFAAFPAFGGQTPSQGGFANFDAFSSGPSSSVFGSLPPAGQASFQAQPTPAGSSQGTPFGATPLAPASQPNSLADVGSFLGPGVPAAGVPSSLFGMAGQVPPLQSVTMGGGGGSSTGLAFGAFTNPFTAPAAQSPLPSTNPFQPNGLAPGPGFGMSSAGPGFPQAVPPTGAFASSFPAPLFPPQTPLVQQQNGSSFGDLGSAKLGQRPLSQPAGISTNPFMTGPSSSPFASKPPTTNPFL

SEQ ID NO: 341 - protein, 714 aa, Artificial Sequence
  AGGF1__Homo_sapiens__NP_060516
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQEPASALATEDTSLEGSSLAESLRAAAEAAVSQTGFSYDENTGLYFDHSTGFYYDSENQLYYDPSTGIYYYCDVESGRYQFHSRVDLQPYPTSSTKQSKDKKLKKKRKDPDSSATNEEKDLNSEDQKAFSVEHTSCNEEENFANMKKKAKIGIHHKNSPPKVTVPTSGNTIESPLHENISNSTSFKDEKIMETDSEPEEGEITDSQTEDSYDEAITSEGNVTAEDSEDEDEDKIWPPCIRVIVIRSPVLQIGSLFIITAVNPATIGREKDMEHTLRIPEVGVSKFHAEIYFDHDLQSYVLVDQGSQNGTIVNGKQILQPKTKCDPYVLEHGDEVKIGETVLSFHIHPGSDTCDGCEPGQVRAHLRLDKKDESFVGPTLSKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 342 - protein, 350 aa, Artificial Sequence
  AGK__Homo_sapiens__XP_005250080
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGK

SEQ ID NO: 343 - protein, 445 aa, Artificial Sequence
  AGMO__Homo_sapiens__NP_001004320
MKNPEAQQDVSVSQGFRMLFYTMKPSETSFQTLEEVPDYVKKATPFFISLMLLELVVSWILKGKPPGRLDDALTSISAGVLSRLPSLFFRSIELTSYIYIWENYRLFNLPWDSPWTWYSAFLGVDFGYYWFHRMAHEVNIMWAGHQTHHSSEDYNLSTALRQSVLQIYTSWIFYSPLALFIPPSVYAVHLQFNLLYQFWIHTEVINNLGPLELILNTPSHHRVHHGRNRYCIDKNYAGVLIIWDKIFGTFEAENEKVVYGLTHPINTFEPIKVQFHHLFSIWTTFWATPGFFNKFSVIFKGPGWGPGKPRLGLSEEIPEVTGKEVPFSSSSSQLLKIYTVVQFALMLAFYEETFADTAALSQVTLLLRVCFIILTLTSIGFLLDQRPKAAIMETLRCLMFLMLYRFGHLKPLVPSLSSAFEIVFSICIAFWGVRSMKQLTSHPWK

SEQ ID NO: 344 - protein, 825 aa, Artificial Sequence
  AGO2__Homo_sapiens__NP_001158095
MYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

(The sequence listing continues in the following parts.)

---

The invention claimed is:

1. A method of treating or preventing hereditary spastic paraplegia, wherein the method comprises administering to a subject in need thereof an effective amount of a purified RNA comprising at least one coding sequence encoding a CYP7B1 protein that is at least 95% identical to the amino acid sequence of SEQ ID NO: 2846, wherein the coding sequence comprises a nucleic acid sequence selected from the group consisting of nucleic acid sequences according to any one of SEQ ID NOs: 28960, 42017, 55074, 15903, and 68131 or a sequence at least 80% identical to any one of SEQ ID NOs: 28960, 42017, 55074, 15903, and 68131.

2. The method according to claim 1, wherein the at least one coding sequence encodes a CYP7B1 protein according to the amino acid sequence of SEQ ID NO: 2846.

3. The method according to claim 1, wherein the RNA is an mRNA, a viral RNA or a replicon RNA.

4. The method according to claim 1, wherein the RNA is a modified RNA.

5. The method according to claim 4, wherein the the G/C content of the at least one coding sequence of the RNA is increased compared to the G/C content of the corresponding coding sequence of the corresponding wild type RNA, and/or wherein the C content of the at least one coding sequence of the RNA is increased compared to the C content of the corresponding coding sequence of the corresponding wild type RNA, and/or wherein the codons in the at least one coding sequence of the RNA are adapted to human codon usage, wherein the codon adaptation index (CAI) is increased or maximised in the at least one coding sequence of the RNA, wherein the amino acid sequence encoded by the RNA is not modified compared to the amino acid sequence encoded by the corresponding wild type RNA.

6. The method according to claim 1, wherein the RNA comprises a 5'-CAP structure, a 5'-untranslated region (5'-UTR), and/or at least one 3'-untranslated region element (3'-UTR element).

7. The method according to claim 1, wherein the RNA comprises at least one histone stem-loop.

8. The method according to claim 7, wherein the at least one histone stem loop comprises a nucleic acid sequence according to SEQ ID NO: 2451.

9. The method according to claim 1, wherein the at least one RNA comprises a poly(A) sequence, and/or a poly(C) sequence.

10. The method according to claim 9, wherein the poly(A) sequence comprises 10 to 200, 10 to 100, 40 to 80 or 50 to 70 adenosine nucleotides.

11. The method according to claim 9, wherein the poly(C) sequence comprises 10 to 200, 10 to 100, 20 to 70, 20 to 60 or 10 to 40 cytosine nucleotides.

12. The method according to claim 1, wherein the RNA comprises, in 5' to 3' direction, the following elements:
a) a 5'-CAP structure,
b) at least one coding sequence comprising a nucleic acid sequence selected from the group consisting of nucleic acid sequences according to any one of SEQ ID NO: 28960, 42017, 55074, 15903, and 68131 or a having at least 80% identity to any one of SEQ ID NO: 28960, 42017, 55074, 15903, and 68131,
c) a poly(A) tail,
d) optionally a poly(C) tail,
e) optionally a histone stem-loop.

13. The method according to claim 6, wherein the RNA comprises a 3'-UTR element and wherein the 3'-UTR element comprises a nucleic acid sequence derived from a 3'-UTR of a gene.

14. The method according to claim 13, wherein the 3'-UTR element comprises a nucleic acid sequence derived from a 3'-UTR of a gene selected from the group consisting of an albumin gene, an α-globin gene, a β-globin gene, a tyrosine hydroxylase gene, a lipoxygenase gene, and a collagen alpha gene, or from a homolog, a fragment or a variant thereof.

15. The method according to claim 14, wherein the 3'-UTR element comprises a nucleic acid sequence derived from a 3'-UTR of an α-globin gene.

16. The method of claim 1, wherein the purified RNA is formulated in a composition with one or more liposome, lipoplex or lipid nanoparticle (LNP).

17. The method of claim 16, wherein the purified RNA is formulated in a composition with one or more LNP comprising an ionizable or cationic lipid.

18. The method of claim 17, wherein the composition is administered by injection.

* * * * *

UNITED STATES PATENT AND TRADEMARK OFFICE
CERTIFICATE OF CORRECTION

PATENT NO. : 11,078,247 B2
APPLICATION NO. : 16/098844
DATED : August 3, 2021
INVENTOR(S) : Mariola Fotin-Mleczek and Ingmar Hoerr It is certified that error appears in the above-identified patent and that said Letters Patent is hereby corrected as shown below:

In the Claims

Claim 5, Column 775, Line 1, delete "wherein the" and insert --wherein-- therefor.

Signed and Sealed this
Twenty-eighth Day of June, 2022

Katherine Kelly Vidal
*Director of the United States Patent and Trademark Office*